United States Patent 11,578,366 (COMPOSITIONS AND METHODS OF USING RNA FRAGMENTS) - sequence listing, part 2

SEQ ID NO: 37604 - DNA, 28 bp, Homo sapiens
cccggacacggacaggattgacagattg

SEQ ID NO: 37605 - DNA, 29 bp, Homo sapiens
cccggacacggacaggattgacagattga

SEQ ID NO: 37606 - DNA, 16 bp, Homo sapiens
ccggacacggacagga

SEQ ID NO: 37607 - DNA, 18 bp, Homo sapiens
ccggacacggacaggatt

SEQ ID NO: 37608 - DNA, 19 bp, Homo sapiens
ccggacacggacaggattg

SEQ ID NO: 37609 - DNA, 20 bp, Homo sapiens
ccggacacggacaggattga

SEQ ID NO: 37610 - DNA, 21 bp, Homo sapiens
ccggacacggacaggattgac

SEQ ID NO: 37611 - DNA, 22 bp, Homo sapiens
ccggacacggacaggattgaca

SEQ ID NO: 37612 - DNA, 23 bp, Homo sapiens
ccggacacggacaggattgacag

SEQ ID NO: 37613 - DNA, 24 bp, Homo sapiens
ccggacacggacaggattgacaga

SEQ ID NO: 37614 - DNA, 25 bp, Homo sapiens
ccggacacggacaggattgacagat

SEQ ID NO: 37615 - DNA, 26 bp, Homo sapiens
ccggacacggacaggattgacagatt

SEQ ID NO: 37616 - DNA, 27 bp, Homo sapiens
ccggacacggacaggattgacagattg

SEQ ID NO: 37617 - DNA, 28 bp, Homo sapiens
ccggacacggacaggattgacagattga

SEQ ID NO: 37618 - DNA, 29 bp, Homo sapiens
ccggacacggacaggattgacagattgat

SEQ ID NO: 37619 - DNA, 18 bp, Homo sapiens
cggacacggacaggattg

SEQ ID NO: 37620 - DNA, 19 bp, Homo sapiens
cggacacggacaggattga

SEQ ID NO: 37621 - DNA, 20 bp, Homo sapiens
cggacacggacaggattgac

SEQ ID NO: 37622 - DNA, 22 bp, Homo sapiens
cggacacggacaggattgacag

SEQ ID NO: 37623 - DNA, 23 bp, Homo sapiens
cggacacggacaggattgacaga

SEQ ID NO: 37624 - DNA, 25 bp, Homo sapiens
cggacacggacaggattgacagatt

SEQ ID NO: 37625 - DNA, 27 bp, Homo sapiens
cggacacggacaggattgacagattga

SEQ ID NO: 37626 - DNA, 30 bp, Homo sapiens
cggacacggacaggattgacagattgatag

SEQ ID NO: 37627 - DNA, 21 bp, Homo sapiens
ggacacggacaggattgacag

SEQ ID NO: 37628 - DNA, 22 bp, Homo sapiens
ggacacggacaggattgacaga

SEQ ID NO: 37629 - DNA, 23 bp, Homo sapiens
ggacacggacaggattgacagat

SEQ ID NO: 37630 - DNA, 29 bp, Homo sapiens
ggacacggacaggattgacagattgatag

SEQ ID NO: 37631 - DNA, 20 bp, Homo sapiens
gacacggacaggattgacag

SEQ ID NO: 37632 - DNA, 21 bp, Homo sapiens
gacacggacaggattgacaga

SEQ ID NO: 37633 - DNA, 22 bp, Homo sapiens
gacacggacaggattgacagat

SEQ ID NO: 37634 - DNA, 23 bp, Homo sapiens
gacacggacaggattgacagatt

SEQ ID NO: 37635 - DNA, 26 bp, Homo sapiens
gacacggacaggattgacagattgat

SEQ ID NO: 37636 - DNA, 28 bp, Homo sapiens
gacacggacaggattgacagattgatag

SEQ ID NO: 37637 - DNA, 30 bp, Homo sapiens; identical to SEQ ID NO: 2921

SEQ ID NO: 37638 - DNA, 18 bp, Homo sapiens
acacggacaggattgaca

SEQ ID NO: 37639 - DNA, 19 bp, Homo sapiens
acacggacaggattgacag

SEQ ID NO: 37640 - DNA, 20 bp, Homo sapiens
acacggacaggattgacaga

SEQ ID NO: 37641 - DNA, 21 bp, Homo sapiens
acacggacaggattgacagat

SEQ ID NO: 37642 - DNA, 22 bp, Homo sapiens
acacggacaggattgacagatt

SEQ ID NO: 37643 - DNA, 23 bp, Homo sapiens
acacggacaggattgacagattg

SEQ ID NO: 37644 - DNA, 24 bp, Homo sapiens
acacggacaggattgacagattga

SEQ ID NO: 37645 - DNA, 25 bp, Homo sapiens
acacggacaggattgacagattgat

SEQ ID NO: 37646 - DNA, 27 bp, Homo sapiens
acacggacaggattgacagattgatag

SEQ ID NO: 37647 - DNA, 30 bp, Homo sapiens; identical to SEQ ID NO: 15296

SEQ ID NO: 37648 - DNA, 17 bp, Homo sapiens
cacggacaggattgaca

SEQ ID NO: 37649 - DNA, 18 bp, Homo sapiens
cacggacaggattgacag

SEQ ID NO: 37650 - DNA, 19 bp, Homo sapiens
cacggacaggattgacaga

SEQ ID NO: 37651 - DNA, 20 bp, Homo sapiens
cacggacaggattgacagat

SEQ ID NO: 37652 - DNA, 21 bp, Homo sapiens
cacggacaggattgacagatt

SEQ ID NO: 37653 - DNA, 22 bp, Homo sapiens
cacggacaggattgacagattg

SEQ ID NO: 37654 - DNA, 23 bp, Homo sapiens
cacggacaggattgacagattga

SEQ ID NO: 37655 - DNA, 24 bp, Homo sapiens
cacggacaggattgacagattgat

SEQ ID NO: 37656 - DNA, 26 bp, Homo sapiens
cacggacaggattgacagattgatag

SEQ ID NO: 37657 - DNA, 30 bp, Homo sapiens; identical to SEQ ID NO: 15312

SEQ ID NO: 37658 - DNA, 17 bp, Homo sapiens
acggacaggattgacag

SEQ ID NO: 37659 - DNA, 18 bp, Homo sapiens
acggacaggattgacaga

SEQ ID NO: 37660 - DNA, 19 bp, Homo sapiens
acggacaggattgacagat

SEQ ID NO: 37661 - DNA, 20 bp, Homo sapiens
acggacaggattgacagatt

SEQ ID NO: 37662 - DNA, 21 bp, Homo sapiens
acggacaggattgacagattg

SEQ ID NO: 37663 - DNA, 23 bp, Homo sapiens
acggacaggattgacagattgat

SEQ ID NO: 37664 - DNA, 25 bp, Homo sapiens
acggacaggattgacagattgatag

SEQ ID NO: 37665 - DNA, 16 bp, Homo sapiens
cggacaggattgacag

SEQ ID NO: 37666 - DNA, 17 bp, Homo sapiens
cggacaggattgacaga

SEQ ID NO: 37667 - DNA, 18 bp, Homo sapiens
cggacaggattgacagat

SEQ ID NO: 37668 - DNA, 19 bp, Homo sapiens
cggacaggattgacagatt

SEQ ID NO: 37669 - DNA, 20 bp, Homo sapiens
cggacaggattgacagattg

SEQ ID NO: 37670 - DNA, 21 bp, Homo sapiens
cggacaggattgacagattga

SEQ ID NO: 37671 - DNA, 22 bp, Homo sapiens
cggacaggattgacagattgat

SEQ ID NO: 37672 - DNA, 23 bp, Homo sapiens
cggacaggattgacagattgata

SEQ ID NO: 37673 - DNA, 24 bp, Homo sapiens
cggacaggattgacagattgatag

SEQ ID NO: 37674 - DNA, 26 bp, Homo sapiens
cggacaggattgacagattgatagct

SEQ ID NO: 37675 - DNA, 29 bp, Homo sapiens
cggacaggattgacagattgatagctctt

SEQ ID NO: 37676 - DNA, 30 bp, Homo sapiens; identical to SEQ ID NO: 2956

SEQ ID NO: 37677 - DNA, 17 bp, Homo sapiens
ggacaggattgacagat

SEQ ID NO: 37678 - DNA, 18 bp, Homo sapiens
ggacaggattgacagatt

SEQ ID NO: 37679 - DNA, 29 bp, Homo sapiens
ggacaggattgacagattgatagctcttt

SEQ ID NO: 37680 - DNA, 17 bp, Homo sapiens
gacaggattgacagatt

SEQ ID NO: 37681 - DNA, 18 bp, Homo sapiens
gacaggattgacagattg

SEQ ID NO: 37682 - DNA, 19 bp, Homo sapiens
gacaggattgacagattga

SEQ ID NO: 37683 - DNA, 20 bp, Homo sapiens
gacaggattgacagattgat

SEQ ID NO: 37684 - DNA, 22 bp, Homo sapiens
gacaggattgacagattgatag

SEQ ID NO: 37685 - DNA, 23 bp, Homo sapiens
gacaggattgacagattgatagc

SEQ ID NO: 37686 - DNA, 25 bp, Homo sapiens
gacaggattgacagattgatagctc

SEQ ID NO: 37687 - DNA, 27 bp, Homo sapiens
gacaggattgacagattgatagctctt

SEQ ID NO: 37688 - DNA, 16 bp, Homo sapiens
acaggattgacagatt

SEQ ID NO: 37689 - DNA, 17 bp, Homo sapiens
acaggattgacagattg

SEQ ID NO: 37690 - DNA, 18 bp, Homo sapiens
acaggattgacagattga

SEQ ID NO: 37691 - DNA, 19 bp, Homo sapiens
acaggattgacagattgat

SEQ ID NO: 37692 - DNA, 20 bp, Homo sapiens
acaggattgacagattgata

SEQ ID NO: 37693 - DNA, 21 bp, Homo sapiens
acaggattgacagattgatag

SEQ ID NO: 37694 - DNA, 22 bp, Homo sapiens
acaggattgacagattgatagc

SEQ ID NO: 37695 - DNA, 23 bp, Homo sapiens
acaggattgacagattgatagct

SEQ ID NO: 37696 - DNA, 24 bp, Homo sapiens
acaggattgacagattgatagctc

SEQ ID NO: 37697 - DNA, 25 bp, Homo sapiens
acaggattgacagattgatagctct

SEQ ID NO: 37698 - DNA, 26 bp, Homo sapiens
acaggattgacagattgatagctctt

SEQ ID NO: 37699 - DNA, 27 bp, Homo sapiens
acaggattgacagattgatagctcttt

SEQ ID NO: 37700 - DNA, 28 bp, Homo sapiens
acaggattgacagattgatagctctttc

SEQ ID NO: 37701 - DNA, 29 bp, Homo sapiens
acaggattgacagattgatagctctttct

SEQ ID NO: 37702 - DNA, 30 bp, Homo sapiens
acaggattgacagattgatagctctttctc

SEQ ID NO: 37703 - DNA, 16 bp, Homo sapiens
caggattgacagattg

SEQ ID NO: 37704 - DNA, 17 bp, Homo sapiens
caggattgacagattga

SEQ ID NO: 37705 - DNA, 18 bp, Homo sapiens
caggattgacagattgat

SEQ ID NO: 37706 - DNA, 19 bp, Homo sapiens
caggattgacagattgata

SEQ ID NO: 37707 - DNA, 20 bp, Homo sapiens
caggattgacagattgatag

SEQ ID NO: 37708 - DNA, 21 bp, Homo sapiens
caggattgacagattgatagc

SEQ ID NO: 37709 - DNA, 22 bp, Homo sapiens
caggattgacagattgatagct

SEQ ID NO: 37710 - DNA, 23 bp, Homo sapiens
caggattgacagattgatagctc

SEQ ID NO: 37711 - DNA, 24 bp, Homo sapiens
caggattgacagattgatagctct

SEQ ID NO: 37712 - DNA, 25 bp, Homo sapiens
caggattgacagattgatagctctt

SEQ ID NO: 37713 - DNA, 26 bp, Homo sapiens
caggattgacagattgatagctcttt

SEQ ID NO: 37714 - DNA, 27 bp, Homo sapiens
caggattgacagattgatagctctttc

SEQ ID NO: 37715 - DNA, 28 bp, Homo sapiens
caggattgacagattgatagctctttct

SEQ ID NO: 37716 - DNA, 29 bp, Homo sapiens
caggattgacagattgatagctctttctc

SEQ ID NO: 37717 - DNA, 30 bp, Homo sapiens
caggattgacagattgatagctctttctcg

SEQ ID NO: 37718 - DNA, 17 bp, Homo sapiens
aggattgacagattgat

SEQ ID NO: 37719 - DNA, 19 bp, Homo sapiens
aggattgacagattgatag

SEQ ID NO: 37720 - DNA, 20 bp, Homo sapiens
aggattgacagattgatagc

SEQ ID NO: 37721 - DNA, 21 bp, Homo sapiens
aggattgacagattgatagct

SEQ ID NO: 37722 - DNA, 22 bp, Homo sapiens
aggattgacagattgatagctc

SEQ ID NO: 37723 - DNA, 23 bp, Homo sapiens
aggattgacagattgatagctct

SEQ ID NO: 37724 - DNA, 24 bp, Homo sapiens
aggattgacagattgatagctctt

SEQ ID NO: 37725 - DNA, 25 bp, Homo sapiens
aggattgacagattgatagctcttt

SEQ ID NO: 37726 - DNA, 26 bp, Homo sapiens
aggattgacagattgatagctctttc

SEQ ID NO: 37727 - DNA, 16 bp, Homo sapiens
ggattgacagattgat

SEQ ID NO: 37728 - DNA, 17 bp, Homo sapiens
ggattgacagattgata

SEQ ID NO: 37729 - DNA, 18 bp, Homo sapiens
ggattgacagattgatag

SEQ ID NO: 37730 - DNA, 19 bp, Homo sapiens
ggattgacagattgatagc

SEQ ID NO: 37731 - DNA, 20 bp, Homo sapiens
ggattgacagattgatagct

SEQ ID NO: 37732 - DNA, 21 bp, Homo sapiens
ggattgacagattgatagctc

SEQ ID NO: 37733 - DNA, 22 bp, Homo sapiens
ggattgacagattgatagctct

SEQ ID NO: 37734 - DNA, 23 bp, Homo sapiens
ggattgacagattgatagctctt

SEQ ID NO: 37735 - DNA, 24 bp, Homo sapiens
ggattgacagattgatagctcttt

SEQ ID NO: 37736 - DNA, 17 bp, Homo sapiens
gattgacagattgatag

SEQ ID NO: 37737 - DNA, 21 bp, Homo sapiens
gattgacagattgatagctct

SEQ ID NO: 37738 - DNA, 22 bp, Homo sapiens
gattgacagattgatagctctt

SEQ ID NO: 37739 - DNA, 23 bp, Homo sapiens
gattgacagattgatagctcttt

SEQ ID NO: 37740 - DNA, 16 bp, Homo sapiens
attgacagattgatag

SEQ ID NO: 37741 - DNA, 19 bp, Homo sapiens
attgacagattgatagctc

SEQ ID NO: 37742 - DNA, 20 bp, Homo sapiens
attgacagattgatagctct

SEQ ID NO: 37743 - DNA, 21 bp, Homo sapiens
attgacagattgatagctctt

SEQ ID NO: 37744 - DNA, 22 bp, Homo sapiens
attgacagattgatagctcttt

SEQ ID NO: 37745 - DNA, 19 bp, Homo sapiens
ttgacagattgatagctct

SEQ ID NO: 37746 - DNA, 20 bp, Homo sapiens
ttgacagattgatagctctt

SEQ ID NO: 37747 - DNA, 21 bp, Homo sapiens
ttgacagattgatagctcttt

SEQ ID NO: 37748 - DNA, 17 bp, Homo sapiens
gacagattgatagctct

SEQ ID NO: 37749 - DNA, 18 bp, Homo sapiens
acagattgatagctcttt

SEQ ID NO: 37750 - DNA, 25 bp, Homo sapiens
gattgatagctctttctcgattccg

SEQ ID NO: 37751 - DNA, 23 bp, Homo sapiens
tgatagctctttctcgattccgt

SEQ ID NO: 37752 - DNA, 21 bp, Homo sapiens
gatagctctttctcgattccg

SEQ ID NO: 37753 - DNA, 23 bp, Homo sapiens
gatagctctttctcgattccgtg

SEQ ID NO: 37754 - DNA, 20 bp, Homo sapiens
agctctttctcgattccgtg

SEQ ID NO: 37755 - DNA, 21 bp, Homo sapiens
agctctttctcgattccgtgg

SEQ ID NO: 37756 - DNA, 22 bp, Homo sapiens
agctctttctcgattccgtggg

SEQ ID NO: 37757 - DNA, 20 bp, Homo sapiens
gctctttctcgattccgtgg

SEQ ID NO: 37758 - DNA, 21 bp, Homo sapiens
gctctttctcgattccgtggg

SEQ ID NO: 37759 - DNA, 22 bp, Homo sapiens
gctctttctcgattccgtgggt

SEQ ID NO: 37760 - DNA, 16 bp, Homo sapiens
ctctttctcgattccg

SEQ ID NO: 37761 - DNA, 17 bp, Homo sapiens
ctctttctcgattccgt

SEQ ID NO: 37762 - DNA, 18 bp, Homo sapiens
ctctttctcgattccgtg

SEQ ID NO: 37763 - DNA, 19 bp, Homo sapiens
ctctttctcgattccgtgg

SEQ ID NO: 37764 - DNA, 20 bp, Homo sapiens
ctctttctcgattccgtggg

SEQ ID NO: 37765 - DNA, 21 bp, Homo sapiens
ctctttctcgattccgtgggt

SEQ ID NO: 37766 - DNA, 22 bp, Homo sapiens
ctctttctcgattccgtgggtg

SEQ ID NO: 37767 - DNA, 23 bp, Homo sapiens
ctctttctcgattccgtgggtgg

SEQ ID NO: 37768 - DNA, 17 bp, Homo sapiens
ctttctcgattccgtgg

SEQ ID NO: 37769 - DNA, 18 bp, Homo sapiens
ctttctcgattccgtggg

SEQ ID NO: 37770 - DNA, 21 bp, Homo sapiens
tctcgattccgtgggtggtgg

SEQ ID NO: 37771 - DNA, 19 bp, Homo sapiens
ctcgattccgtgggtggtg

SEQ ID NO: 37772 - DNA, 21 bp, Homo sapiens
ctcgattccgtgggtggtggt

SEQ ID NO: 37773 - DNA, 22 bp, Homo sapiens
ctcgattccgtgggtggtggtg

SEQ ID NO: 37774 - DNA, 23 bp, Homo sapiens
ctcgattccgtgggtggtggtgc

SEQ ID NO: 37775 - DNA, 19 bp, Homo sapiens
cgattccgtgggtggtggt

SEQ ID NO: 37776 - DNA, 20 bp, Homo sapiens
cgattccgtgggtggtggtg

SEQ ID NO: 37777 - DNA, 21 bp, Homo sapiens
cgattccgtgggtggtggtgc

SEQ ID NO: 37778 - DNA, 18 bp, Homo sapiens
gattccgtgggtggtggt

SEQ ID NO: 37779 - DNA, 19 bp, Homo sapiens
gattccgtgggtggtggtg

SEQ ID NO: 37780 - DNA, 20 bp, Homo sapiens
gattccgtgggtggtggtgc

SEQ ID NO: 37781 - DNA, 24 bp, Homo sapiens
gattccgtgggtggtggtgcatgg

SEQ ID NO: 37782 - DNA, 17 bp, Homo sapiens
gcaccaccacccacgga

SEQ ID NO: 37783 - DNA, 18 bp, Homo sapiens
tgcaccaccacccacgga

SEQ ID NO: 37784 - DNA, 20 bp, Homo sapiens
cgtgggtggtggtgcatggc

SEQ ID NO: 37785 - DNA, 17 bp, Homo sapiens
gtgggtggtggtgcatg

SEQ ID NO: 37786 - DNA, 18 bp, Homo sapiens
gtgggtggtggtgcatgg

SEQ ID NO: 37787 - DNA, 19 bp, Homo sapiens
gtgggtggtggtgcatggc

SEQ ID NO: 37788 - DNA, 20 bp, Homo sapiens
gtgggtggtggtgcatggcc

SEQ ID NO: 37789 - DNA, 21 bp, Homo sapiens
gtgggtggtggtgcatggccg

SEQ ID NO: 37790 - DNA, 23 bp, Homo sapiens
gtgggtggtggtgcatggccgtt

SEQ ID NO: 37791 - DNA, 24 bp, Homo sapiens
gtgggtggtggtgcatggccgttc

SEQ ID NO: 37792 - DNA, 18 bp, Homo sapiens
tgggtggtggtgcatggc

SEQ ID NO: 37793 - DNA, 30 bp, Homo sapiens
gggtggtggtgcatggccgttcttagttgg

SEQ ID NO: 37794 - DNA, 28 bp, Homo sapiens
gtggtggtgcatggccgttcttagttgg

SEQ ID NO: 37795 - DNA, 27 bp, Homo sapiens
tggtggtgcatggccgttcttagttgg

SEQ ID NO: 37796 - DNA, 20 bp, Homo sapiens
ggtggtgcatggccgttctt

SEQ ID NO: 37797 - DNA, 23 bp, Homo sapiens
ggtggtgcatggccgttcttagt

SEQ ID NO: 37798 - DNA, 26 bp, Homo sapiens
ggtggtgcatggccgttcttagttgg

SEQ ID NO: 37799 - DNA, 21 bp, Homo sapiens
gtggtgcatggccgttcttag

SEQ ID NO: 37800 - DNA, 22 bp, Homo sapiens
gtggtgcatggccgttcttagt

SEQ ID NO: 37801 - DNA, 25 bp, Homo sapiens
gtggtgcatggccgttcttagttgg

SEQ ID NO: 37802 - DNA, 27 bp, Homo sapiens
gtggtgcatggccgttcttagttggtg

SEQ ID NO: 37803 - DNA, 28 bp, Homo sapiens
gtggtgcatggccgttcttagttggtgg

SEQ ID NO: 37804 - DNA, 20 bp, Homo sapiens
tggtgcatggccgttcttag

SEQ ID NO: 37805 - DNA, 21 bp, Homo sapiens
tggtgcatggccgttcttagt

SEQ ID NO: 37806 - DNA, 23 bp, Homo sapiens
tggtgcatggccgttcttagttg

SEQ ID NO: 37807 - DNA, 24 bp, Homo sapiens
tggtgcatggccgttcttagttgg

SEQ ID NO: 37808 - DNA, 25 bp, Homo sapiens
tggtgcatggccgttcttagttggt

SEQ ID NO: 37809 - DNA, 26 bp, Homo sapiens
tggtgcatggccgttcttagttggtg

SEQ ID NO: 37810 - DNA, 27 bp, Homo sapiens
tggtgcatggccgttcttagttggtgg

SEQ ID NO: 37811 - DNA, 28 bp, Homo sapiens
tggtgcatggccgttcttagttggtgga

SEQ ID NO: 37812 - DNA, 29 bp, Homo sapiens
tggtgcatggccgttcttagttggtggag

SEQ ID NO: 37813 - DNA, 23 bp, Homo sapiens
ggtgcatggccgttcttagttgg

SEQ ID NO: 37814 - DNA, 18 bp, Homo sapiens
gtgcatggccgttcttag

SEQ ID NO: 37815 - DNA, 19 bp, Homo sapiens
gtgcatggccgttcttagt

SEQ ID NO: 37816 - DNA, 21 bp, Homo sapiens
gtgcatggccgttcttagttg

SEQ ID NO: 37817 - DNA, 22 bp, Homo sapiens
gtgcatggccgttcttagttgg

SEQ ID NO: 37818 - DNA, 23 bp, Homo sapiens
gtgcatggccgttcttagttggt

SEQ ID NO: 37819 - DNA, 24 bp, Homo sapiens
gtgcatggccgttcttagttggtg

SEQ ID NO: 37820 - DNA, 25 bp, Homo sapiens
gtgcatggccgttcttagttggtgg

SEQ ID NO: 37821 - DNA, 26 bp, Homo sapiens
gtgcatggccgttcttagttggtgga

SEQ ID NO: 37822 - DNA, 27 bp, Homo sapiens
gtgcatggccgttcttagttggtggag

SEQ ID NO: 37823 - DNA, 20 bp, Homo sapiens
tgcatggccgttcttagttg

SEQ ID NO: 37824 - DNA, 21 bp, Homo sapiens
tgcatggccgttcttagttgg

SEQ ID NO: 37825 - DNA, 22 bp, Homo sapiens
tgcatggccgttcttagttggt

SEQ ID NO: 37826 - DNA, 23 bp, Homo sapiens
tgcatggccgttcttagttggtg

SEQ ID NO: 37827 - DNA, 24 bp, Homo sapiens
tgcatggccgttcttagttggtgg

SEQ ID NO: 37828 - DNA, 25 bp, Homo sapiens
tgcatggccgttcttagttggtgga

SEQ ID NO: 37829 - DNA, 26 bp, Homo sapiens
tgcatggccgttcttagttggtggag

SEQ ID NO: 37830 - DNA, 19 bp, Homo sapiens
gcatggccgttcttagttg

SEQ ID NO: 37831 - DNA, 20 bp, Homo sapiens
gcatggccgttcttagttgg

SEQ ID NO: 37832 - DNA, 21 bp, Homo sapiens
gcatggccgttcttagttggt

SEQ ID NO: 37833 - DNA, 22 bp, Homo sapiens
gcatggccgttcttagttggtg

SEQ ID NO: 37834 - DNA, 23 bp, Homo sapiens
gcatggccgttcttagttggtgg

SEQ ID NO: 37835 - DNA, 24 bp, Homo sapiens
gcatggccgttcttagttggtgga

SEQ ID NO: 37836 - DNA, 25 bp, Homo sapiens
gcatggccgttcttagttggtggag

SEQ ID NO: 37837 - DNA, 26 bp, Homo sapiens
gcatggccgttcttagttggtggagc

SEQ ID NO: 37838 - DNA, 16 bp, Homo sapiens
catggccgttcttagt

SEQ ID NO: 37839 - DNA, 18 bp, Homo sapiens
catggccgttcttagttg

SEQ ID NO: 37840 - DNA, 19 bp, Homo sapiens
catggccgttcttagttgg

SEQ ID NO: 37841 - DNA, 20 bp, Homo sapiens
catggccgttcttagttggt

SEQ ID NO: 37842 - DNA, 21 bp, Homo sapiens
catggccgttcttagttggtg

SEQ ID NO: 37843 - DNA, 22 bp, Homo sapiens
catggccgttcttagttggtgg

SEQ ID NO: 37844 - DNA, 23 bp, Homo sapiens
catggccgttcttagttggtgga

SEQ ID NO: 37845 - DNA, 24 bp, Homo sapiens
catggccgttcttagttggtggag

SEQ ID NO: 37846 - DNA, 18 bp, Homo sapiens
atggccgttcttagttgg

SEQ ID NO: 37847 - DNA, 24 bp, Homo sapiens
atggccgttcttagttggtggagc

SEQ ID NO: 37848 - DNA, 17 bp, Homo sapiens
tggccgttcttagttgg

SEQ ID NO: 37849 - DNA, 19 bp, Homo sapiens
tggccgttcttagttggtg

SEQ ID NO: 37850 - DNA, 20 bp, Homo sapiens
tggccgttcttagttggtgg

SEQ ID NO: 37851 - DNA, 21 bp, Homo sapiens
tggccgttcttagttggtgga

SEQ ID NO: 37852 - DNA, 22 bp, Homo sapiens
tggccgttcttagttggtggag

SEQ ID NO: 37853 - DNA, 25 bp, Homo sapiens
tggccgttcttagttggtggagcga

SEQ ID NO: 37854 - DNA, 19 bp, Homo sapiens
ggccgttcttagttggtgg

SEQ ID NO: 37855 - DNA, 20 bp, Homo sapiens
ggccgttcttagttggtgga

SEQ ID NO: 37856 - DNA, 21 bp, Homo sapiens
ggccgttcttagttggtggag

SEQ ID NO: 37857 - DNA, 17 bp, Homo sapiens
gccgttcttagttggtg

SEQ ID NO: 37858 - DNA, 18 bp, Homo sapiens
gccgttcttagttggtgg

SEQ ID NO: 37859 - DNA, 20 bp, Homo sapiens
gccgttcttagttggtggag

SEQ ID NO: 37860 - DNA, 22 bp, Homo sapiens
gccgttcttagttggtggagcg

SEQ ID NO: 37861 - DNA, 16 bp, Homo sapiens
ccgttcttagttggtg

SEQ ID NO: 37862 - DNA, 17 bp, Homo sapiens
ccgttcttagttggtgg

SEQ ID NO: 37863 - DNA, 19 bp, Homo sapiens
ccgttcttagttggtggag

SEQ ID NO: 37864 - DNA, 21 bp, Homo sapiens
ccgttcttagttggtggagcg

SEQ ID NO: 37865 - DNA, 19 bp, Homo sapiens
cgttcttagttggtggagc

SEQ ID NO: 37866 - DNA, 17 bp, Homo sapiens
gttcttagttggtggag

SEQ ID NO: 37867 - DNA, 16 bp, Homo sapiens
ttcttagttggtggag

SEQ ID NO: 37868 - DNA, 17 bp, Homo sapiens
ttagttggtggagcgat

SEQ ID NO: 37869 - DNA, 21 bp, Homo sapiens
ttagttggtggagcgatttgt

SEQ ID NO: 37870 - DNA, 22 bp, Homo sapiens
ttagttggtggagcgatttgtc

SEQ ID NO: 37871 - DNA, 21 bp, Homo sapiens
tagttggtggagcgatttgtc

SEQ ID NO: 37872 - DNA, 20 bp, Homo sapiens
agttggtggagcgatttgtc

SEQ ID NO: 37873 - DNA, 21 bp, Homo sapiens
agttggtggagcgatttgtct

SEQ ID NO: 37874 - DNA, 23 bp, Homo sapiens
agttggtggagcgatttgtctgg

SEQ ID NO: 37875 - DNA, 19 bp, Homo sapiens
gttggtggagcgatttgtc

SEQ ID NO: 37876 - DNA, 22 bp, Homo sapiens
gttggtggagcgatttgtctgg

SEQ ID NO: 37877 - DNA, 24 bp, Homo sapiens
gttggtggagcgatttgtctggtt

SEQ ID NO: 37878 - DNA, 25 bp, Homo sapiens
gttggtggagcgatttgtctggtta

SEQ ID NO: 37879 - DNA, 20 bp, Homo sapiens
ttggtggagcgatttgtctg

SEQ ID NO: 37880 - DNA, 21 bp, Homo sapiens
ttggtggagcgatttgtctgg

SEQ ID NO: 37881 - DNA, 22 bp, Homo sapiens
ttggtggagcgatttgtctggt

SEQ ID NO: 37882 - DNA, 16 bp, Homo sapiens
tggtggagcgatttgt

SEQ ID NO: 37883 - DNA, 17 bp, Homo sapiens
tggtggagcgatttgtc

SEQ ID NO: 37884 - DNA, 18 bp, Homo sapiens
tggtggagcgatttgtct

SEQ ID NO: 37885 - DNA, 19 bp, Homo sapiens
tggtggagcgatttgtctg

SEQ ID NO: 37886 - DNA, 20 bp, Homo sapiens
tggtggagcgatttgtctgg

SEQ ID NO: 37887 - DNA, 22 bp, Homo sapiens
tggtggagcgatttgtctggtt

SEQ ID NO: 37888 - DNA, 23 bp, Homo sapiens
tggtggagcgatttgtctggtta

SEQ ID NO: 37889 - DNA, 18 bp, Homo sapiens
gtggagcgatttgtctgg

SEQ ID NO: 37890 - DNA, 20 bp, Homo sapiens
gtggagcgatttgtctggtt

SEQ ID NO: 37891 - DNA, 17 bp, Homo sapiens
tggagcgatttgtctgg

SEQ ID NO: 37892 - DNA, 19 bp, Homo sapiens
tggagcgatttgtctggtt

SEQ ID NO: 37893 - DNA, 16 bp, Homo sapiens
ggagcgatttgtctgg

SEQ ID NO: 37894 - DNA, 18 bp, Homo sapiens
ggagcgatttgtctggtt

SEQ ID NO: 37895 - DNA, 22 bp, Homo sapiens
ggagcgatttgtctggttaatt

SEQ ID NO: 37896 - DNA, 17 bp, Homo sapiens
gagcgatttgtctggtt

SEQ ID NO: 37897 - DNA, 21 bp, Homo sapiens
gagcgatttgtctggttaatt

SEQ ID NO: 37898 - DNA, 16 bp, Homo sapiens
agcgatttgtctggtt

SEQ ID NO: 37899 - DNA, 20 bp, Homo sapiens
agcgatttgtctggttaatt

SEQ ID NO: 37900 - DNA, 16 bp, Homo sapiens
gcgatttgtctggtta

SEQ ID NO: 37901 - DNA, 17 bp, Homo sapiens
gcgatttgtctggttaa

SEQ ID NO: 37902 - DNA, 18 bp, Homo sapiens
gcgatttgtctggttaat

SEQ ID NO: 37903 - DNA, 19 bp, Homo sapiens
gcgatttgtctggttaatt

SEQ ID NO: 37904 - DNA, 20 bp, Homo sapiens
gcgatttgtctggttaattc

SEQ ID NO: 37905 - DNA, 23 bp, Homo sapiens
gcgatttgtctggttaattccga

SEQ ID NO: 37906 - DNA, 16 bp, Homo sapiens
cgatttgtctggttaa

SEQ ID NO: 37907 - DNA, 17 bp, Homo sapiens
cgatttgtctggttaat

SEQ ID NO: 37908 - DNA, 18 bp, Homo sapiens
cgatttgtctggttaatt

SEQ ID NO: 37909 - DNA, 21 bp, Homo sapiens
cgatttgtctggttaattccg

SEQ ID NO: 37910 - DNA, 23 bp, Homo sapiens
cgatttgtctggttaattccgat

SEQ ID NO: 37911 - DNA, 22 bp, Homo sapiens
gatttgtctggttaattccgat

SEQ ID NO: 37912 - DNA, 23 bp, Homo sapiens
gatttgtctggttaattccgata

SEQ ID NO: 37913 - DNA, 29 bp, Homo sapiens
gatttgtctggttaattccgataacgaac

SEQ ID NO: 37914 - DNA, 30 bp, Homo sapiens
gatttgtctggttaattccgataacgaacg

SEQ ID NO: 37915 - DNA, 23 bp, Homo sapiens
ctggttaattccgataacgaacg

SEQ ID NO: 37916 - DNA, 30 bp, Homo sapiens
ctggttaattccgataacgaacgagactct

SEQ ID NO: 37917 - DNA, 30 bp, Homo sapiens
tggttaattccgataacgaacgagactctg

SEQ ID NO: 37918 - DNA, 30 bp, Homo sapiens; identical to SEQ ID NO: 15521

SEQ ID NO: 37919 - DNA, 28 bp, Homo sapiens
gttaattccgataacgaacgagactctg

SEQ ID NO: 37920 - DNA, 29 bp, Homo sapiens
gttaattccgataacgaacgagactctgg

SEQ ID NO: 37921 - DNA, 30 bp, Homo sapiens; identical to SEQ ID NO: 2991

SEQ ID NO: 37922 - DNA, 27 bp, Homo sapiens
ttaattccgataacgaacgagactctg

SEQ ID NO: 37923 - DNA, 28 bp, Homo sapiens
ttaattccgataacgaacgagactctgg

SEQ ID NO: 37924 - DNA, 29 bp, Homo sapiens
ttaattccgataacgaacgagactctggc

SEQ ID NO: 37925 - DNA, 26 bp, Homo sapiens
taattccgataacgaacgagactctg

SEQ ID NO: 37926 - DNA, 27 bp, Homo sapiens
taattccgataacgaacgagactctgg

SEQ ID NO: 37927 - DNA, 28 bp, Homo sapiens
taattccgataacgaacgagactctggc

SEQ ID NO: 37928 - DNA, 29 bp, Homo sapiens
taattccgataacgaacgagactctggca

SEQ ID NO: 37929 - DNA, 19 bp, Homo sapiens
aattccgataacgaacgag

SEQ ID NO: 37930 - DNA, 20 bp, Homo sapiens
aattccgataacgaacgaga

SEQ ID NO: 37931 - DNA, 24 bp, Homo sapiens
aattccgataacgaacgagactct

SEQ ID NO: 37932 - DNA, 25 bp, Homo sapiens
aattccgataacgaacgagactctg

SEQ ID NO: 37933 - DNA, 26 bp, Homo sapiens
aattccgataacgaacgagactctgg

SEQ ID NO: 37934 - DNA, 27 bp, Homo sapiens
aattccgataacgaacgagactctggc

SEQ ID NO: 37935 - DNA, 28 bp, Homo sapiens
aattccgataacgaacgagactctggca

SEQ ID NO: 37936 - DNA, 29 bp, Homo sapiens
aattccgataacgaacgagactctggcat

SEQ ID NO: 37937 - DNA, 30 bp, Homo sapiens; identical to SEQ ID NO: 3008

SEQ ID NO: 37938 - DNA, 24 bp, Homo sapiens
attccgataacgaacgagactctg

SEQ ID NO: 37939 - DNA, 25 bp, Homo sapiens
attccgataacgaacgagactctgg

SEQ ID NO: 37940 - DNA, 26 bp, Homo sapiens
attccgataacgaacgagactctggc

SEQ ID NO: 37941 - DNA, 27 bp, Homo sapiens
attccgataacgaacgagactctggca

SEQ ID NO: 37942 - DNA, 28 bp, Homo sapiens
attccgataacgaacgagactctggcat

SEQ ID NO: 37943 - DNA, 29 bp, Homo sapiens
attccgataacgaacgagactctggcatg

SEQ ID NO: 37944 - DNA, 30 bp, Homo sapiens; identical to SEQ ID NO: 3016

SEQ ID NO: 37945 - DNA, 23 bp, Homo sapiens
ttccgataacgaacgagactctg

SEQ ID NO: 37946 - DNA, 24 bp, Homo sapiens
ttccgataacgaacgagactctgg

SEQ ID NO: 37947 - DNA, 25 bp, Homo sapiens
ttccgataacgaacgagactctggc

SEQ ID NO: 37948 - DNA, 26 bp, Homo sapiens
ttccgataacgaacgagactctggca

SEQ ID NO: 37949 - DNA, 27 bp, Homo sapiens
ttccgataacgaacgagactctggcat

SEQ ID NO: 37950 - DNA, 28 bp, Homo sapiens
ttccgataacgaacgagactctggcatg

SEQ ID NO: 37951 - DNA, 29 bp, Homo sapiens
ttccgataacgaacgagactctggcatgc

SEQ ID NO: 37952 - DNA, 30 bp, Homo sapiens; identical to SEQ ID NO: 3024

SEQ ID NO: 37953 - DNA, 21 bp, Homo sapiens
tccgataacgaacgagactct

SEQ ID NO: 37954 - DNA, 22 bp, Homo sapiens
tccgataacgaacgagactctg

SEQ ID NO: 37955 - DNA, 23 bp, Homo sapiens
tccgataacgaacgagactctgg

SEQ ID NO: 37956 - DNA, 24 bp, Homo sapiens
tccgataacgaacgagactctggc

SEQ ID NO: 37957 - DNA, 25 bp, Homo sapiens
tccgataacgaacgagactctggca

SEQ ID NO: 37958 - DNA, 26 bp, Homo sapiens
tccgataacgaacgagactctggcat

SEQ ID NO: 37959 - DNA, 27 bp, Homo sapiens
tccgataacgaacgagactctggcatg

SEQ ID NO: 37960 - DNA, 28 bp, Homo sapiens
tccgataacgaacgagactctggcatgc

SEQ ID NO: 37961 - DNA, 29 bp, Homo sapiens
tccgataacgaacgagactctggcatgct

SEQ ID NO: 37962 - DNA, 18 bp, Homo sapiens
ccgataacgaacgagact

SEQ ID NO: 37963 - DNA, 20 bp, Homo sapiens
ccgataacgaacgagactct

SEQ ID NO: 37964 - DNA, 21 bp, Homo sapiens
ccgataacgaacgagactctg

SEQ ID NO: 37965 - DNA, 22 bp, Homo sapiens
ccgataacgaacgagactctgg

SEQ ID NO: 37966 - DNA, 23 bp, Homo sapiens
ccgataacgaacgagactctggc

SEQ ID NO: 37967 - DNA, 24 bp, Homo sapiens
ccgataacgaacgagactctggca

SEQ ID NO: 37968 - DNA, 25 bp, Homo sapiens
ccgataacgaacgagactctggcat

SEQ ID NO: 37969 - DNA, 26 bp, Homo sapiens
ccgataacgaacgagactctggcatg

SEQ ID NO: 37970 - DNA, 27 bp, Homo sapiens
ccgataacgaacgagactctggcatgc

SEQ ID NO: 37971 - DNA, 28 bp, Homo sapiens
ccgataacgaacgagactctggcatgct

SEQ ID NO: 37972 - DNA, 29 bp, Homo sapiens
ccgataacgaacgagactctggcatgcta

SEQ ID NO: 37973 - DNA, 30 bp, Homo sapiens; identical to SEQ ID NO: 15633

SEQ ID NO: 37974 - DNA, 20 bp, Homo sapiens
cgataacgaacgagactctg

SEQ ID NO: 37975 - DNA, 21 bp, Homo sapiens
cgataacgaacgagactctgg

SEQ ID NO: 37976 - DNA, 22 bp, Homo sapiens
cgataacgaacgagactctggc

SEQ ID NO: 37977 - DNA, 23 bp, Homo sapiens
cgataacgaacgagactctggca

SEQ ID NO: 37978 - DNA, 24 bp, Homo sapiens
cgataacgaacgagactctggcat

SEQ ID NO: 37979 - DNA, 25 bp, Homo sapiens
cgataacgaacgagactctggcatg

SEQ ID NO: 37980 - DNA, 26 bp, Homo sapiens
cgataacgaacgagactctggcatgc

SEQ ID NO: 37981 - DNA, 27 bp, Homo sapiens
cgataacgaacgagactctggcatgct

SEQ ID NO: 37982 - DNA, 30 bp, Homo sapiens; identical to SEQ ID NO: 3054

SEQ ID NO: 37983 - DNA, 19 bp, Homo sapiens
gataacgaacgagactctg

SEQ ID NO: 37984 - DNA, 20 bp, Homo sapiens
gataacgaacgagactctgg

SEQ ID NO: 37985 - DNA, 21 bp, Homo sapiens
gataacgaacgagactctggc

SEQ ID NO: 37986 - DNA, 22 bp, Homo sapiens
gataacgaacgagactctggca

SEQ ID NO: 37987 - DNA, 23 bp, Homo sapiens
gataacgaacgagactctggcat

SEQ ID NO: 37988 - DNA, 24 bp, Homo sapiens
gataacgaacgagactctggcatg

SEQ ID NO: 37989 - DNA, 25 bp, Homo sapiens
gataacgaacgagactctggcatgc

SEQ ID NO: 37990 - DNA, 26 bp, Homo sapiens
gataacgaacgagactctggcatgct

SEQ ID NO: 37991 - DNA, 29 bp, Homo sapiens
gataacgaacgagactctggcatgctaac

SEQ ID NO: 37992 - DNA, 30 bp, Homo sapiens; identical to SEQ ID NO: 3068

SEQ ID NO: 37993 - DNA, 18 bp, Homo sapiens
ataacgaacgagactctg

SEQ ID NO: 37994 - DNA, 19 bp, Homo sapiens
ataacgaacgagactctgg

SEQ ID NO: 37995 - DNA, 20 bp, Homo sapiens
ataacgaacgagactctggc

SEQ ID NO: 37996 - DNA, 21 bp, Homo sapiens
ataacgaacgagactctggca

SEQ ID NO: 37997 - DNA, 22 bp, Homo sapiens
ataacgaacgagactctggcat

SEQ ID NO: 37998 - DNA, 23 bp, Homo sapiens
ataacgaacgagactctggcatg

SEQ ID NO: 37999 - DNA, 24 bp, Homo sapiens
ataacgaacgagactctggcatgc

SEQ ID NO: 38000 - DNA, 25 bp, Homo sapiens
ataacgaacgagactctggcatgct

SEQ ID NO: 38001 - DNA, 29 bp, Homo sapiens
ataacgaacgagactctggcatgctaact

SEQ ID NO: 38002 - DNA, 18 bp, Homo sapiens
taacgaacgagactctgg

SEQ ID NO: 38003 - DNA, 19 bp, Homo sapiens
taacgaacgagactctggc

SEQ ID NO: 38004 - DNA, 20 bp, Homo sapiens
taacgaacgagactctggca

SEQ ID NO: 38005 - DNA, 21 bp, Homo sapiens
taacgaacgagactctggcat

SEQ ID NO: 38006 - DNA, 22 bp, Homo sapiens
taacgaacgagactctggcatg

SEQ ID NO: 38007 - DNA, 23 bp, Homo sapiens
taacgaacgagactctggcatgc

SEQ ID NO: 38008 - DNA, 24 bp, Homo sapiens
taacgaacgagactctggcatgct

SEQ ID NO: 38009 - DNA, 25 bp, Homo sapiens
taacgaacgagactctggcatgcta

SEQ ID NO: 38010 - DNA, 16 bp, Homo sapiens
aacgaacgagactctg

SEQ ID NO: 38011 - DNA, 17 bp, Homo sapiens
aacgaacgagactctgg

SEQ ID NO: 38012 - DNA, 18 bp, Homo sapiens
aacgaacgagactctggc

SEQ ID NO: 38013 - DNA, 19 bp, Homo sapiens
aacgaacgagactctggca

SEQ ID NO: 38014 - DNA, 20 bp, Homo sapiens
aacgaacgagactctggcat

SEQ ID NO: 38015 - DNA, 21 bp, Homo sapiens
aacgaacgagactctggcatg

SEQ ID NO: 38016 - DNA, 22 bp, Homo sapiens
aacgaacgagactctggcatgc

SEQ ID NO: 38017 - DNA, 23 bp, Homo sapiens
aacgaacgagactctggcatgct

SEQ ID NO: 38018 - DNA, 24 bp, Homo sapiens
aacgaacgagactctggcatgcta

SEQ ID NO: 38019 - DNA, 26 bp, Homo sapiens
aacgaacgagactctggcatgctaac

SEQ ID NO: 38020 - DNA, 27 bp, Homo sapiens
aacgaacgagactctggcatgctaact

SEQ ID NO: 38021 - DNA, 30 bp, Homo sapiens; identical to SEQ ID NO: 3111

SEQ ID NO: 38022 - DNA, 16 bp, Homo sapiens
acgaacgagactctgg

SEQ ID NO: 38023 - DNA, 17 bp, Homo sapiens
acgaacgagactctggc

SEQ ID NO: 38024 - DNA, 18 bp, Homo sapiens
acgaacgagactctggca

SEQ ID NO: 38025 - DNA, 19 bp, Homo sapiens
acgaacgagactctggcat

SEQ ID NO: 38026 - DNA, 20 bp, Homo sapiens
acgaacgagactctggcatg

SEQ ID NO: 38027 - DNA, 21 bp, Homo sapiens
acgaacgagactctggcatgc

SEQ ID NO: 38028 - DNA, 22 bp, Homo sapiens
acgaacgagactctggcatgct

SEQ ID NO: 38029 - DNA, 23 bp, Homo sapiens
acgaacgagactctggcatgcta

SEQ ID NO: 38030 - DNA, 24 bp, Homo sapiens
acgaacgagactctggcatgctaa

SEQ ID NO: 38031 - DNA, 25 bp, Homo sapiens
acgaacgagactctggcatgctaac

SEQ ID NO: 38032 - DNA, 26 bp, Homo sapiens
acgaacgagactctggcatgctaact

SEQ ID NO: 38033 - DNA, 27 bp, Homo sapiens
acgaacgagactctggcatgctaacta

SEQ ID NO: 38034 - DNA, 29 bp, Homo sapiens
acgaacgagactctggcatgctaactagt

SEQ ID NO: 38035 - DNA, 30 bp, Homo sapiens; identical to SEQ ID NO: 3128

SEQ ID NO: 38036 - DNA, 16 bp, Homo sapiens
cgaacgagactctggc

SEQ ID NO: 38037 - DNA, 17 bp, Homo sapiens
cgaacgagactctggca

SEQ ID NO: 38038 - DNA, 18 bp, Homo sapiens
cgaacgagactctggcat

SEQ ID NO: 38039 - DNA, 19 bp, Homo sapiens
cgaacgagactctggcatg

SEQ ID NO: 38040 - DNA, 20 bp, Homo sapiens
cgaacgagactctggcatgc

SEQ ID NO: 38041 - DNA, 21 bp, Homo sapiens
cgaacgagactctggcatgct

SEQ ID NO: 38042 - DNA, 22 bp, Homo sapiens
cgaacgagactctggcatgcta

SEQ ID NO: 38043 - DNA, 23 bp, Homo sapiens
cgaacgagactctggcatgctaa

SEQ ID NO: 38044 - DNA, 24 bp, Homo sapiens
cgaacgagactctggcatgctaac

SEQ ID NO: 38045 - DNA, 25 bp, Homo sapiens
cgaacgagactctggcatgctaact

SEQ ID NO: 38046 - DNA, 26 bp, Homo sapiens
cgaacgagactctggcatgctaacta

SEQ ID NO: 38047 - DNA, 29 bp, Homo sapiens
cgaacgagactctggcatgctaactagtt

SEQ ID NO: 38048 - DNA, 30 bp, Homo sapiens; identical to SEQ ID NO: 3146

SEQ ID NO: 38049 - DNA, 16 bp, Homo sapiens
gaacgagactctggca

SEQ ID NO: 38050 - DNA, 17 bp, Homo sapiens
gaacgagactctggcat

SEQ ID NO: 38051 - DNA, 18 bp, Homo sapiens
gaacgagactctggcatg

SEQ ID NO: 38052 - DNA, 19 bp, Homo sapiens
gaacgagactctggcatgc

SEQ ID NO: 38053 - DNA, 20 bp, Homo sapiens
gaacgagactctggcatgct

SEQ ID NO: 38054 - DNA, 21 bp, Homo sapiens
gaacgagactctggcatgcta

SEQ ID NO: 38055 - DNA, 22 bp, Homo sapiens
gaacgagactctggcatgctaa

SEQ ID NO: 38056 - DNA, 23 bp, Homo sapiens
gaacgagactctggcatgctaac

SEQ ID NO: 38057 - DNA, 24 bp, Homo sapiens
gaacgagactctggcatgctaact

SEQ ID NO: 38058 - DNA, 25 bp, Homo sapiens
gaacgagactctggcatgctaacta

SEQ ID NO: 38059 - DNA, 30 bp, Homo sapiens; identical to SEQ ID NO: 3163

SEQ ID NO: 38060 - DNA, 16 bp, Homo sapiens
aacgagactctggcat

SEQ ID NO: 38061 - DNA, 17 bp, Homo sapiens
aacgagactctggcatg

SEQ ID NO: 38062 - DNA, 18 bp, Homo sapiens
aacgagactctggcatgc

SEQ ID NO: 38063 - DNA, 19 bp, Homo sapiens
aacgagactctggcatgct

SEQ ID NO: 38064 - DNA, 20 bp, Homo sapiens
aacgagactctggcatgcta

SEQ ID NO: 38065 - DNA, 21 bp, Homo sapiens
aacgagactctggcatgctaa

SEQ ID NO: 38066 - DNA, 22 bp, Homo sapiens
aacgagactctggcatgctaac

SEQ ID NO: 38067 - DNA, 23 bp, Homo sapiens
aacgagactctggcatgctaact

SEQ ID NO: 38068 - DNA, 24 bp, Homo sapiens
aacgagactctggcatgctaacta

SEQ ID NO: 38069 - DNA, 29 bp, Homo sapiens
aacgagactctggcatgctaactagttac

SEQ ID NO: 38070 - DNA, 30 bp, Homo sapiens; identical to SEQ ID NO: 3180

SEQ ID NO: 38071 - DNA, 16 bp, Homo sapiens
acgagactctggcatg

SEQ ID NO: 38072 - DNA, 17 bp, Homo sapiens
acgagactctggcatgc

SEQ ID NO: 38073 - DNA, 18 bp, Homo sapiens
acgagactctggcatgct

SEQ ID NO: 38074 - DNA, 19 bp, Homo sapiens
acgagactctggcatgcta

SEQ ID NO: 38075 - DNA, 20 bp, Homo sapiens
acgagactctggcatgctaa

SEQ ID NO: 38076 - DNA, 21 bp, Homo sapiens
acgagactctggcatgctaac

SEQ ID NO: 38077 - DNA, 22 bp, Homo sapiens
acgagactctggcatgctaact

SEQ ID NO: 38078 - DNA, 23 bp, Homo sapiens
acgagactctggcatgctaacta

SEQ ID NO: 38079 - DNA, 30 bp, Homo sapiens
acgagactctggcatgctaactagttacgc

SEQ ID NO: 38080 - DNA, 16 bp, Homo sapiens
cgagactctggcatgc

SEQ ID NO: 38081 - DNA, 20 bp, Homo sapiens
cgagactctggcatgctaac

SEQ ID NO: 38082 - DNA, 21 bp, Homo sapiens
cgagactctggcatgctaact

SEQ ID NO: 38083 - DNA, 16 bp, Homo sapiens
gagactctggcatgct

SEQ ID NO: 38084 - DNA, 18 bp, Homo sapiens
gagactctggcatgctaa

SEQ ID NO: 38085 - DNA, 19 bp, Homo sapiens
gagactctggcatgctaac

SEQ ID NO: 38086 - DNA, 20 bp, Homo sapiens
gagactctggcatgctaact

SEQ ID NO: 38087 - DNA, 21 bp, Homo sapiens
gagactctggcatgctaacta

SEQ ID NO: 38088 - DNA, 22 bp, Homo sapiens
gagactctggcatgctaactag

SEQ ID NO: 38089 - DNA, 23 bp, Homo sapiens
gagactctggcatgctaactagt

SEQ ID NO: 38090 - DNA, 24 bp, Homo sapiens
gagactctggcatgctaactagtt

SEQ ID NO: 38091 - DNA, 25 bp, Homo sapiens
gagactctggcatgctaactagtta

SEQ ID NO: 38092 - DNA, 27 bp, Homo sapiens
gagactctggcatgctaactagttacg

SEQ ID NO: 38093 - DNA, 28 bp, Homo sapiens
gagactctggcatgctaactagttacgc

SEQ ID NO: 38094 - DNA, 29 bp, Homo sapiens
gagactctggcatgctaactagttacgcg

SEQ ID NO: 38095 - DNA, 30 bp, Homo sapiens
gagactctggcatgctaactagttacgcga

SEQ ID NO: 38096 - DNA, 18 bp, Homo sapiens
agactctggcatgctaac

SEQ ID NO: 38097 - DNA, 21 bp, Homo sapiens
agactctggcatgctaactag

SEQ ID NO: 38098 - DNA, 30 bp, Homo sapiens; identical to SEQ ID NO: 15942

SEQ ID NO: 38099 - DNA, 17 bp, Homo sapiens
gactctggcatgctaac

SEQ ID NO: 38100 - DNA, 18 bp, Homo sapiens
gactctggcatgctaact

SEQ ID NO: 38101 - DNA, 19 bp, Homo sapiens
gactctggcatgctaacta

SEQ ID NO: 38102 - DNA, 21 bp, Homo sapiens
gactctggcatgctaactagt

SEQ ID NO: 38103 - DNA, 22 bp, Homo sapiens
gactctggcatgctaactagtt

SEQ ID NO: 38104 - DNA, 23 bp, Homo sapiens
gactctggcatgctaactagtta

SEQ ID NO: 38105 - DNA, 25 bp, Homo sapiens
gactctggcatgctaactagttacg

SEQ ID NO: 38106 - DNA, 26 bp, Homo sapiens
gactctggcatgctaactagttacgc

SEQ ID NO: 38107 - DNA, 27 bp, Homo sapiens
gactctggcatgctaactagttacgcg

SEQ ID NO: 38108 - DNA, 30 bp, Homo sapiens
gactctggcatgctaactagttacgcgacc

SEQ ID NO: 38109 - DNA, 17 bp, Homo sapiens
actctggcatgctaact

SEQ ID NO: 38110 - DNA, 18 bp, Homo sapiens
actctggcatgctaacta

SEQ ID NO: 38111 - DNA, 19 bp, Homo sapiens
actctggcatgctaactag

SEQ ID NO: 38112 - DNA, 20 bp, Homo sapiens
actctggcatgctaactagt

SEQ ID NO: 38113 - DNA, 21 bp, Homo sapiens
actctggcatgctaactagtt

SEQ ID NO: 38114 - DNA, 22 bp, Homo sapiens
actctggcatgctaactagtta

SEQ ID NO: 38115 - DNA, 24 bp, Homo sapiens
actctggcatgctaactagttacg

SEQ ID NO: 38116 - DNA, 25 bp, Homo sapiens
actctggcatgctaactagttacgc

SEQ ID NO: 38117 - DNA, 26 bp, Homo sapiens
actctggcatgctaactagttacgcg

SEQ ID NO: 38118 - DNA, 27 bp, Homo sapiens
actctggcatgctaactagttacgcga

SEQ ID NO: 38119 - DNA, 28 bp, Homo sapiens
actctggcatgctaactagttacgcgac

SEQ ID NO: 38120 - DNA, 30 bp, Homo sapiens
actctggcatgctaactagttacgcgaccc

SEQ ID NO: 38121 - DNA, 16 bp, Homo sapiens
ctctggcatgctaact

SEQ ID NO: 38122 - DNA, 17 bp, Homo sapiens
ctctggcatgctaacta

SEQ ID NO: 38123 - DNA, 18 bp, Homo sapiens
ctctggcatgctaactag

SEQ ID NO: 38124 - DNA, 19 bp, Homo sapiens
ctctggcatgctaactagt

SEQ ID NO: 38125 - DNA, 20 bp, Homo sapiens
ctctggcatgctaactagtt

SEQ ID NO: 38126 - DNA, 21 bp, Homo sapiens
ctctggcatgctaactagtta

SEQ ID NO: 38127 - DNA, 22 bp, Homo sapiens
ctctggcatgctaactagttac

SEQ ID NO: 38128 - DNA, 23 bp, Homo sapiens
ctctggcatgctaactagttacg

SEQ ID NO: 38129 - DNA, 24 bp, Homo sapiens
ctctggcatgctaactagttacgc

SEQ ID NO: 38130 - DNA, 25 bp, Homo sapiens
ctctggcatgctaactagttacgcg

SEQ ID NO: 38131 - DNA, 26 bp, Homo sapiens
ctctggcatgctaactagttacgcga

SEQ ID NO: 38132 - DNA, 27 bp, Homo sapiens
ctctggcatgctaactagttacgcgac

SEQ ID NO: 38133 - DNA, 28 bp, Homo sapiens
ctctggcatgctaactagttacgcgacc

SEQ ID NO: 38134 - DNA, 29 bp, Homo sapiens
ctctggcatgctaactagttacgcgaccc

SEQ ID NO: 38135 - DNA, 30 bp, Homo sapiens; identical to SEQ ID NO: 29119

SEQ ID NO: 38136 - DNA, 22 bp, Homo sapiens
ctggcatgctaactagttacgc

SEQ ID NO: 38137 - DNA, 23 bp, Homo sapiens
ctggcatgctaactagttacgcg

SEQ ID NO: 38138 - DNA, 28 bp, Homo sapiens
ctggcatgctaactagttacgcgacccc

SEQ ID NO: 38139 - DNA, 26 bp, Homo sapiens
ggcatgctaactagttacgcgacccc

SEQ ID NO: 38140 - DNA, 18 bp, Homo sapiens
gcatgctaactagttacg

SEQ ID NO: 38141 - DNA, 20 bp, Homo sapiens
gcatgctaactagttacgcg

SEQ ID NO: 38142 - DNA, 25 bp, Homo sapiens
gcatgctaactagttacgcgacccc

SEQ ID NO: 38143 - DNA, 17 bp, Homo sapiens
catgctaactagttacg

SEQ ID NO: 38144 - DNA, 19 bp, Homo sapiens
catgctaactagttacgcg

SEQ ID NO: 38145 - DNA, 24 bp, Homo sapiens
catgctaactagttacgcgacccc

SEQ ID NO: 38146 - DNA, 25 bp, Homo sapiens
catgctaactagttacgcgaccccc

SEQ ID NO: 38147 - DNA, 23 bp, Homo sapiens
atgctaactagttacgcgacccc

SEQ ID NO: 38148 - DNA, 24 bp, Homo sapiens
atgctaactagttacgcgaccccc

SEQ ID NO: 38149 - DNA, 21 bp, Homo sapiens
tgctaactagttacgcgaccc

SEQ ID NO: 38150 - DNA, 22 bp, Homo sapiens
tgctaactagttacgcgacccc

SEQ ID NO: 38151 - DNA, 23 bp, Homo sapiens
tgctaactagttacgcgaccccc

SEQ ID NO: 38152 - DNA, 30 bp, Homo sapiens
tgctaactagttacgcgacccccgagcggt

SEQ ID NO: 38153 - DNA, 21 bp, Homo sapiens
gctaactagttacgcgacccc

SEQ ID NO: 38154 - DNA, 22 bp, Homo sapiens
gctaactagttacgcgaccccc

SEQ ID NO: 38155 - DNA, 20 bp, Homo sapiens
ctaactagttacgcgacccc

SEQ ID NO: 38156 - DNA, 21 bp, Homo sapiens
ctaactagttacgcgaccccc

SEQ ID NO: 38157 - DNA, 20 bp, Homo sapiens
aactagttacgcgacccccg

SEQ ID NO: 38158 - DNA, 21 bp, Homo sapiens
aactagttacgcgacccccga

SEQ ID NO: 38159 - DNA, 22 bp, Homo sapiens
aactagttacgcgacccccgag

SEQ ID NO: 38160 - DNA, 19 bp, Homo sapiens
actagttacgcgacccccg

SEQ ID NO: 38161 - DNA, 21 bp, Homo sapiens
actagttacgcgacccccgag

SEQ ID NO: 38162 - DNA, 17 bp, Homo sapiens
ctagttacgcgaccccc

SEQ ID NO: 38163 - DNA, 19 bp, Homo sapiens
ctagttacgcgacccccga

SEQ ID NO: 38164 - DNA, 20 bp, Homo sapiens
ctagttacgcgacccccgag

SEQ ID NO: 38165 - DNA, 16 bp, Homo sapiens
tagttacgcgaccccc

SEQ ID NO: 38166 - DNA, 17 bp, Homo sapiens
tagttacgcgacccccg

SEQ ID NO: 38167 - DNA, 22 bp, Homo sapiens
tagttacgcgacccccgagcgg

SEQ ID NO: 38168 - DNA, 23 bp, Homo sapiens
tagttacgcgacccccgagcggt

SEQ ID NO: 38169 - DNA, 18 bp, Homo sapiens
agttacgcgacccccgag

SEQ ID NO: 38170 - DNA, 21 bp, Homo sapiens
agttacgcgacccccgagcgg

SEQ ID NO: 38171 - DNA, 22 bp, Homo sapiens
agttacgcgacccccgagcggt

SEQ ID NO: 38172 - DNA, 19 bp, Homo sapiens
ttacgcgacccccgagcgg

SEQ ID NO: 38173 - DNA, 20 bp, Homo sapiens
ttacgcgacccccgagcggt

SEQ ID NO: 38174 - DNA, 23 bp, Homo sapiens
ttacgcgacccccgagcggtcgg

SEQ ID NO: 38175 - DNA, 19 bp, Homo sapiens
tacgcgacccccgagcggt

SEQ ID NO: 38176 - DNA, 22 bp, Homo sapiens
gacccccgagcggtcggcgtcc

SEQ ID NO: 38177 - DNA, 16 bp, Homo sapiens
acccccgagcggtcgg

SEQ ID NO: 38178 - DNA, 22 bp, Homo sapiens
acccccgagcggtcggcgtccc

SEQ ID NO: 38179 - DNA, 23 bp, Homo sapiens
acccccgagcggtcggcgtcccc

SEQ ID NO: 38180 - DNA, 24 bp, Homo sapiens
acccccgagcggtcggcgtccccc

SEQ ID NO: 38181 - DNA, 27 bp, Homo sapiens
acccccgagcggtcggcgtcccccaac

SEQ ID NO: 38182 - DNA, 16 bp, Homo sapiens
cgagcggtcggcgtcc

SEQ ID NO: 38183 - DNA, 17 bp, Homo sapiens
cgagcggtcggcgtccc

SEQ ID NO: 38184 - DNA, 18 bp, Homo sapiens
cgagcggtcggcgtcccc

SEQ ID NO: 38185 - DNA, 16 bp, Homo sapiens
gagcggtcggcgtccc

SEQ ID NO: 38186 - DNA, 17 bp, Homo sapiens
gagcggtcggcgtcccc

SEQ ID NO: 38187 - DNA, 18 bp, Homo sapiens
gagcggtcggcgtccccc

SEQ ID NO: 38188 - DNA, 22 bp, Homo sapiens
gagcggtcggcgtcccccaact

SEQ ID NO: 38189 - DNA, 16 bp, Homo sapiens
agcggtcggcgtcccc

SEQ ID NO: 38190 - DNA, 17 bp, Homo sapiens
agcggtcggcgtccccc

SEQ ID NO: 38191 - DNA, 18 bp, Homo sapiens
agcggtcggcgtccccca

SEQ ID NO: 38192 - DNA, 20 bp, Homo sapiens
agcggtcggcgtcccccaac

SEQ ID NO: 38193 - DNA, 21 bp, Homo sapiens
agcggtcggcgtcccccaact

SEQ ID NO: 38194 - DNA, 24 bp, Homo sapiens
agcggtcggcgtcccccaacttct

SEQ ID NO: 38195 - DNA, 27 bp, Homo sapiens
gcggtcggcgtcccccaacttcttaga

SEQ ID NO: 38196 - DNA, 26 bp, Homo sapiens
cggtcggcgtcccccaacttcttaga

SEQ ID NO: 38197 - DNA, 17 bp, Homo sapiens
ggtcggcgtcccccaac

SEQ ID NO: 38198 - DNA, 18 bp, Homo sapiens
ggtcggcgtcccccaact

SEQ ID NO: 38199 - DNA, 20 bp, Homo sapiens
ggtcggcgtcccccaacttc

SEQ ID NO: 38200 - DNA, 21 bp, Homo sapiens
ggtcggcgtcccccaacttct

SEQ ID NO: 38201 - DNA, 22 bp, Homo sapiens
ggtcggcgtcccccaacttctt

SEQ ID NO: 38202 - DNA, 24 bp, Homo sapiens
ggtcggcgtcccccaacttcttag

SEQ ID NO: 38203 - DNA, 25 bp, Homo sapiens
ggtcggcgtcccccaacttcttaga

SEQ ID NO: 38204 - DNA, 29 bp, Homo sapiens
ggtcggcgtcccccaacttcttagaggga

SEQ ID NO: 38205 - DNA, 30 bp, Homo sapiens
ggtcggcgtcccccaacttcttagagggac

SEQ ID NO: 38206 - DNA, 24 bp, Homo sapiens
gtcggcgtcccccaacttcttaga

SEQ ID NO: 38207 - DNA, 23 bp, Homo sapiens
tcggcgtcccccaacttcttaga

SEQ ID NO: 38208 - DNA, 22 bp, Homo sapiens
cggcgtcccccaacttcttaga

SEQ ID NO: 38209 - DNA, 23 bp, Homo sapiens
cggcgtcccccaacttcttagag

SEQ ID NO: 38210 - DNA, 20 bp, Homo sapiens
gcgtcccccaacttcttaga

SEQ ID NO: 38211 - DNA, 21 bp, Homo sapiens
gcgtcccccaacttcttagag

SEQ ID NO: 38212 - DNA, 19 bp, Homo sapiens
cgtcccccaacttcttaga

SEQ ID NO: 38213 - DNA, 20 bp, Homo sapiens
cgtcccccaacttcttagag

SEQ ID NO: 38214 - DNA, 21 bp, Homo sapiens
cgtcccccaacttcttagagg

SEQ ID NO: 38215 - DNA, 17 bp, Homo sapiens
cccccaacttcttagag

SEQ ID NO: 38216 - DNA, 18 bp, Homo sapiens
cccccaacttcttagagg

SEQ ID NO: 38217 - DNA, 17 bp, Homo sapiens
ccaacttcttagaggga

SEQ ID NO: 38218 - DNA, 18 bp, Homo sapiens
ccaacttcttagagggac

SEQ ID NO: 38219 - DNA, 19 bp, Homo sapiens
ccaacttcttagagggaca

SEQ ID NO: 38220 - DNA, 21 bp, Homo sapiens
ccaacttcttagagggacaag

SEQ ID NO: 38221 - DNA, 22 bp, Homo sapiens
ccaacttcttagagggacaagt

SEQ ID NO: 38222 - DNA, 20 bp, Homo sapiens
acttcttagagggacaagtg

SEQ ID NO: 38223 - DNA, 21 bp, Homo sapiens
acttcttagagggacaagtgg

SEQ ID NO: 38224 - DNA, 19 bp, Homo sapiens
ttcttagagggacaagtgg

SEQ ID NO: 38225 - DNA, 18 bp, Homo sapiens
tcttagagggacaagtgg

SEQ ID NO: 38226 - DNA, 19 bp, Homo sapiens
tagagggacaagtggcgtt

SEQ ID NO: 38227 - DNA, 22 bp, Homo sapiens
gggacaagtggcgttcagccac

SEQ ID NO: 38228 - DNA, 23 bp, Homo sapiens
gggacaagtggcgttcagccacc

SEQ ID NO: 38229 - DNA, 28 bp, Homo sapiens
gggacaagtggcgttcagccacccgaga

SEQ ID NO: 38230 - DNA, 22 bp, Homo sapiens
ggacaagtggcgttcagccacc

SEQ ID NO: 38231 - DNA, 20 bp, Homo sapiens
gacaagtggcgttcagccac

SEQ ID NO: 38232 - DNA, 21 bp, Homo sapiens
gacaagtggcgttcagccacc

SEQ ID NO: 38233 - DNA, 22 bp, Homo sapiens
cgttcagccacccgagattgag

SEQ ID NO: 38234 - DNA, 16 bp, Homo sapiens
gttcagccacccgaga

SEQ ID NO: 38235 - DNA, 21 bp, Homo sapiens
gttcagccacccgagattgag

SEQ ID NO: 38236 - DNA, 22 bp, Homo sapiens
gttcagccacccgagattgagc

SEQ ID NO: 38237 - DNA, 23 bp, Homo sapiens
gttcagccacccgagattgagca

SEQ ID NO: 38238 - DNA, 30 bp, Homo sapiens
tcagccacccgagattgagcaataacaggt

SEQ ID NO: 38239 - DNA, 18 bp, Homo sapiens
cagccacccgagattgag

SEQ ID NO: 38240 - DNA, 20 bp, Homo sapiens
cagccacccgagattgagca

SEQ ID NO: 38241 - DNA, 21 bp, Homo sapiens
cagccacccgagattgagcaa

SEQ ID NO: 38242 - DNA, 22 bp, Homo sapiens
cagccacccgagattgagcaat

SEQ ID NO: 38243 - DNA, 18 bp, Homo sapiens
agccacccgagattgagc

SEQ ID NO: 38244 - DNA, 19 bp, Homo sapiens
agccacccgagattgagca

SEQ ID NO: 38245 - DNA, 20 bp, Homo sapiens
agccacccgagattgagcaa

SEQ ID NO: 38246 - DNA, 21 bp, Homo sapiens
agccacccgagattgagcaat

SEQ ID NO: 38247 - DNA, 19 bp, Homo sapiens
gccacccgagattgagcaa

SEQ ID NO: 38248 - DNA, 20 bp, Homo sapiens
gccacccgagattgagcaat

SEQ ID NO: 38249 - DNA, 21 bp, Homo sapiens
gccacccgagattgagcaata

SEQ ID NO: 38250 - DNA, 22 bp, Homo sapiens
gccacccgagattgagcaataa

SEQ ID NO: 38251 - DNA, 24 bp, Homo sapiens
gccacccgagattgagcaataaca

SEQ ID NO: 38252 - DNA, 26 bp, Homo sapiens
gccacccgagattgagcaataacagg

SEQ ID NO: 38253 - DNA, 19 bp, Homo sapiens
ccacccgagattgagcaat

SEQ ID NO: 38254 - DNA, 21 bp, Homo sapiens
cgagattgagcaataacaggt

SEQ ID NO: 38255 - DNA, 24 bp, Homo sapiens
gagattgagcaataacaggtctgt

SEQ ID NO: 38256 - DNA, 26 bp, Homo sapiens
gagattgagcaataacaggtctgtga

SEQ ID NO: 38257 - DNA, 23 bp, Homo sapiens
agattgagcaataacaggtctgt

SEQ ID NO: 38258 - DNA, 24 bp, Homo sapiens
agattgagcaataacaggtctgtg

SEQ ID NO: 38259 - DNA, 25 bp, Homo sapiens
agattgagcaataacaggtctgtga

SEQ ID NO: 38260 - DNA, 22 bp, Homo sapiens
gattgagcaataacaggtctgt

SEQ ID NO: 38261 - DNA, 23 bp, Homo sapiens
gattgagcaataacaggtctgtg

SEQ ID NO: 38262 - DNA, 24 bp, Homo sapiens
gattgagcaataacaggtctgtga

SEQ ID NO: 38263 - DNA, 20 bp, Homo sapiens
attgagcaataacaggtctg

SEQ ID NO: 38264 - DNA, 21 bp, Homo sapiens
attgagcaataacaggtctgt

SEQ ID NO: 38265 - DNA, 22 bp, Homo sapiens
attgagcaataacaggtctgtg

SEQ ID NO: 38266 - DNA, 23 bp, Homo sapiens
attgagcaataacaggtctgtga

SEQ ID NO: 38267 - DNA, 20 bp, Homo sapiens
ttgagcaataacaggtctgt

SEQ ID NO: 38268 - DNA, 21 bp, Homo sapiens
ttgagcaataacaggtctgtg

SEQ ID NO: 38269 - DNA, 22 bp, Homo sapiens
ttgagcaataacaggtctgtga

SEQ ID NO: 38270 - DNA, 19 bp, Homo sapiens
tgagcaataacaggtctgt

SEQ ID NO: 38271 - DNA, 20 bp, Homo sapiens
tgagcaataacaggtctgtg

SEQ ID NO: 38272 - DNA, 21 bp, Homo sapiens
tgagcaataacaggtctgtga

SEQ ID NO: 38273 - DNA, 22 bp, Homo sapiens
tgagcaataacaggtctgtgat

SEQ ID NO: 38274 - DNA, 18 bp, Homo sapiens
gagcaataacaggtctgt

SEQ ID NO: 38275 - DNA, 19 bp, Homo sapiens
gagcaataacaggtctgtg

SEQ ID NO: 38276 - DNA, 20 bp, Homo sapiens
gagcaataacaggtctgtga

SEQ ID NO: 38277 - DNA, 21 bp, Homo sapiens
gagcaataacaggtctgtgat

SEQ ID NO: 38278 - DNA, 22 bp, Homo sapiens
gagcaataacaggtctgtgatg

SEQ ID NO: 38279 - DNA, 23 bp, Homo sapiens
gagcaataacaggtctgtgatgc

SEQ ID NO: 38280 - DNA, 17 bp, Homo sapiens
agcaataacaggtctgt

SEQ ID NO: 38281 - DNA, 18 bp, Homo sapiens
agcaataacaggtctgtg

SEQ ID NO: 38282 - DNA, 19 bp, Homo sapiens
agcaataacaggtctgtga

SEQ ID NO: 38283 - DNA, 20 bp, Homo sapiens
agcaataacaggtctgtgat

SEQ ID NO: 38284 - DNA, 22 bp, Homo sapiens
agcaataacaggtctgtgatgc

SEQ ID NO: 38285 - DNA, 16 bp, Homo sapiens
gcaataacaggtctgt

SEQ ID NO: 38286 - DNA, 17 bp, Homo sapiens
gcaataacaggtctgtg

SEQ ID NO: 38287 - DNA, 18 bp, Homo sapiens
gcaataacaggtctgtga

SEQ ID NO: 38288 - DNA, 19 bp, Homo sapiens
gcaataacaggtctgtgat

SEQ ID NO: 38289 - DNA, 16 bp, Homo sapiens
caataacaggtctgtg

SEQ ID NO: 38290 - DNA, 17 bp, Homo sapiens
caataacaggtctgtga

SEQ ID NO: 38291 - DNA, 18 bp, Homo sapiens
caataacaggtctgtgat

SEQ ID NO: 38292 - DNA, 19 bp, Homo sapiens
caataacaggtctgtgatg

SEQ ID NO: 38293 - DNA, 20 bp, Homo sapiens
caataacaggtctgtgatgc

SEQ ID NO: 38294 - DNA, 21 bp, Homo sapiens
caataacaggtctgtgatgcc

SEQ ID NO: 38295 - DNA, 16 bp, Homo sapiens
aataacaggtctgtga

SEQ ID NO: 38296 - DNA, 19 bp, Homo sapiens
aataacaggtctgtgatgc

SEQ ID NO: 38297 - DNA, 20 bp, Homo sapiens
aataacaggtctgtgatgcc

SEQ ID NO: 38298 - DNA, 23 bp, Homo sapiens
aataacaggtctgtgatgccctt

SEQ ID NO: 38299 - DNA, 25 bp, Homo sapiens
aataacaggtctgtgatgcccttag

SEQ ID NO: 38300 - DNA, 19 bp, Homo sapiens
ataacaggtctgtgatgcc

SEQ ID NO: 38301 - DNA, 24 bp, Homo sapiens
ataacaggtctgtgatgcccttag

SEQ ID NO: 38302 - DNA, 25 bp, Homo sapiens
ataacaggtctgtgatgcccttaga

SEQ ID NO: 38303 - DNA, 24 bp, Homo sapiens
taacaggtctgtgatgcccttaga

SEQ ID NO: 38304 - DNA, 22 bp, Homo sapiens
aacaggtctgtgatgcccttag

SEQ ID NO: 38305 - DNA, 23 bp, Homo sapiens
aacaggtctgtgatgcccttaga

SEQ ID NO: 38306 - DNA, 22 bp, Homo sapiens
acaggtctgtgatgcccttaga

SEQ ID NO: 38307 - DNA, 21 bp, Homo sapiens
caggtctgtgatgcccttaga

SEQ ID NO: 38308 - DNA, 17 bp, Homo sapiens
aggtctgtgatgccctt

SEQ ID NO: 38309 - DNA, 25 bp, Homo sapiens
ggtctgtgatgcccttagatgtccg

SEQ ID NO: 38310 - DNA, 26 bp, Homo sapiens
ggtctgtgatgcccttagatgtccgg

SEQ ID NO: 38311 - DNA, 16 bp, Homo sapiens
tctgtgatgcccttag

SEQ ID NO: 38312 - DNA, 19 bp, Homo sapiens
tctgtgatgcccttagatg

SEQ ID NO: 38313 - DNA, 20 bp, Homo sapiens
tctgtgatgcccttagatgt

SEQ ID NO: 38314 - DNA, 24 bp, Homo sapiens
tctgtgatgcccttagatgtccgg

SEQ ID NO: 38315 - DNA, 16 bp, Homo sapiens
ctgtgatgcccttaga

SEQ ID NO: 38316 - DNA, 17 bp, Homo sapiens
ctgtgatgcccttagat

SEQ ID NO: 38317 - DNA, 18 bp, Homo sapiens
ctgtgatgcccttagatg

SEQ ID NO: 38318 - DNA, 19 bp, Homo sapiens
ctgtgatgcccttagatgt

SEQ ID NO: 38319 - DNA, 20 bp, Homo sapiens
ctgtgatgcccttagatgtc

SEQ ID NO: 38320 - DNA, 22 bp, Homo sapiens
ctgtgatgcccttagatgtccg

SEQ ID NO: 38321 - DNA, 23 bp, Homo sapiens
ctgtgatgcccttagatgtccgg

SEQ ID NO: 38322 - DNA, 24 bp, Homo sapiens
ctgtgatgcccttagatgtccggg

SEQ ID NO: 38323 - DNA, 22 bp, Homo sapiens
tgtgatgcccttagatgtccgg

SEQ ID NO: 38324 - DNA, 21 bp, Homo sapiens
gtgatgcccttagatgtccgg

SEQ ID NO: 38325 - DNA, 22 bp, Homo sapiens
gtgatgcccttagatgtccggg

SEQ ID NO: 38326 - DNA, 19 bp, Homo sapiens
tgatgcccttagatgtccg

SEQ ID NO: 38327 - DNA, 20 bp, Homo sapiens
tgatgcccttagatgtccgg

SEQ ID NO: 38328 - DNA, 21 bp, Homo sapiens
tgatgcccttagatgtccggg

SEQ ID NO: 38329 - DNA, 18 bp, Homo sapiens
gatgcccttagatgtccg

SEQ ID NO: 38330 - DNA, 19 bp, Homo sapiens
gatgcccttagatgtccgg

SEQ ID NO: 38331 - DNA, 20 bp, Homo sapiens
gatgcccttagatgtccggg

SEQ ID NO: 38332 - DNA, 21 bp, Homo sapiens
gatgcccttagatgtccgggg

SEQ ID NO: 38333 - DNA, 17 bp, Homo sapiens
atgcccttagatgtccg

SEQ ID NO: 38334 - DNA, 18 bp, Homo sapiens
atgcccttagatgtccgg

SEQ ID NO: 38335 - DNA, 19 bp, Homo sapiens
atgcccttagatgtccggg

SEQ ID NO: 38336 - DNA, 20 bp, Homo sapiens
atgcccttagatgtccgggg

SEQ ID NO: 38337 - DNA, 17 bp, Homo sapiens
tgcccttagatgtccgg

SEQ ID NO: 38338 - DNA, 18 bp, Homo sapiens
tgcccttagatgtccggg

SEQ ID NO: 38339 - DNA, 16 bp, Homo sapiens
gcccttagatgtccgg

SEQ ID NO: 38340 - DNA, 20 bp, Homo sapiens
cccttagatgtccggggctg

SEQ ID NO: 38341 - DNA, 22 bp, Homo sapiens
cccttagatgtccggggctgca

SEQ ID NO: 38342 - DNA, 24 bp, Homo sapiens
cccttagatgtccggggctgcacg

SEQ ID NO: 38343 - DNA, 20 bp, Homo sapiens
ccttagatgtccggggctgc

SEQ ID NO: 38344 - DNA, 21 bp, Homo sapiens
ccttagatgtccggggctgca

SEQ ID NO: 38345 - DNA, 22 bp, Homo sapiens
ccttagatgtccggggctgcac

SEQ ID NO: 38346 - DNA, 23 bp, Homo sapiens
ccttagatgtccggggctgcacg

SEQ ID NO: 38347 - DNA, 25 bp, Homo sapiens
ccttagatgtccggggctgcacgcg

SEQ ID NO: 38348 - DNA, 18 bp, Homo sapiens
cttagatgtccggggctg

SEQ ID NO: 38349 - DNA, 19 bp, Homo sapiens
cttagatgtccggggctgc

SEQ ID NO: 38350 - DNA, 20 bp, Homo sapiens
cttagatgtccggggctgca

SEQ ID NO: 38351 - DNA, 21 bp, Homo sapiens
cttagatgtccggggctgcac

SEQ ID NO: 38352 - DNA, 22 bp, Homo sapiens
cttagatgtccggggctgcacg

SEQ ID NO: 38353 - DNA, 23 bp, Homo sapiens
cttagatgtccggggctgcacgc

SEQ ID NO: 38354 - DNA, 24 bp, Homo sapiens
cttagatgtccggggctgcacgcg

SEQ ID NO: 38355 - DNA, 25 bp, Homo sapiens
cttagatgtccggggctgcacgcgc

SEQ ID NO: 38356 - DNA, 26 bp, Homo sapiens
cttagatgtccggggctgcacgcgcg

SEQ ID NO: 38357 - DNA, 27 bp, Homo sapiens
cttagatgtccggggctgcacgcgcgc

SEQ ID NO: 38358 - DNA, 28 bp, Homo sapiens
cttagatgtccggggctgcacgcgcgct

SEQ ID NO: 38359 - DNA, 17 bp, Homo sapiens
ttagatgtccggggctg

SEQ ID NO: 38360 - DNA, 18 bp, Homo sapiens
ttagatgtccggggctgc

SEQ ID NO: 38361 - DNA, 19 bp, Homo sapiens
ttagatgtccggggctgca

SEQ ID NO: 38362 - DNA, 20 bp, Homo sapiens
ttagatgtccggggctgcac

SEQ ID NO: 38363 - DNA, 21 bp, Homo sapiens
ttagatgtccggggctgcacg

SEQ ID NO: 38364 - DNA, 22 bp, Homo sapiens
ttagatgtccggggctgcacgc

SEQ ID NO: 38365 - DNA, 23 bp, Homo sapiens
ttagatgtccggggctgcacgcg

SEQ ID NO: 38366 - DNA, 24 bp, Homo sapiens
ttagatgtccggggctgcacgcgc

SEQ ID NO: 38367 - DNA, 25 bp, Homo sapiens
ttagatgtccggggctgcacgcgcg

SEQ ID NO: 38368 - DNA, 26 bp, Homo sapiens
ttagatgtccggggctgcacgcgcgc

SEQ ID NO: 38369 - DNA, 27 bp, Homo sapiens
ttagatgtccggggctgcacgcgcgct

SEQ ID NO: 38370 - DNA, 16 bp, Homo sapiens
tagatgtccggggctg

SEQ ID NO: 38371 - DNA, 18 bp, Homo sapiens
tagatgtccggggctgca

SEQ ID NO: 38372 - DNA, 19 bp, Homo sapiens
tagatgtccggggctgcac

SEQ ID NO: 38373 - DNA, 20 bp, Homo sapiens
tagatgtccggggctgcacg

SEQ ID NO: 38374 - DNA, 21 bp, Homo sapiens
tagatgtccggggctgcacgc

SEQ ID NO: 38375 - DNA, 22 bp, Homo sapiens
tagatgtccggggctgcacgcg

SEQ ID NO: 38376 - DNA, 23 bp, Homo sapiens
tagatgtccggggctgcacgcgc

SEQ ID NO: 38377 - DNA, 24 bp, Homo sapiens
tagatgtccggggctgcacgcgcg

SEQ ID NO: 38378 - DNA, 25 bp, Homo sapiens
tagatgtccggggctgcacgcgcgc

SEQ ID NO: 38379 - DNA, 26 bp, Homo sapiens
tagatgtccggggctgcacgcgcgct

SEQ ID NO: 38380 - DNA, 17 bp, Homo sapiens
agatgtccggggctgca

SEQ ID NO: 38381 - DNA, 19 bp, Homo sapiens
agatgtccggggctgcacg

SEQ ID NO: 38382 - DNA, 20 bp, Homo sapiens
agatgtccggggctgcacgc

SEQ ID NO: 38383 - DNA, 21 bp, Homo sapiens
agatgtccggggctgcacgcg

SEQ ID NO: 38384 - DNA, 22 bp, Homo sapiens
agatgtccggggctgcacgcgc

SEQ ID NO: 38385 - DNA, 23 bp, Homo sapiens
agatgtccggggctgcacgcgcg

SEQ ID NO: 38386 - DNA, 24 bp, Homo sapiens
agatgtccggggctgcacgcgcgc

SEQ ID NO: 38387 - DNA, 25 bp, Homo sapiens
agatgtccggggctgcacgcgcgct

SEQ ID NO: 38388 - DNA, 16 bp, Homo sapiens
gatgtccggggctgca

SEQ ID NO: 38389 - DNA, 18 bp, Homo sapiens
gatgtccggggctgcacg

SEQ ID NO: 38390 - DNA, 19 bp, Homo sapiens
gatgtccggggctgcacgc

SEQ ID NO: 38391 - DNA, 20 bp, Homo sapiens
gatgtccggggctgcacgcg

SEQ ID NO: 38392 - DNA, 21 bp, Homo sapiens
gatgtccggggctgcacgcgc

SEQ ID NO: 38393 - DNA, 22 bp, Homo sapiens
gatgtccggggctgcacgcgcg

SEQ ID NO: 38394 - DNA, 23 bp, Homo sapiens
gatgtccggggctgcacgcgcgc

SEQ ID NO: 38395 - DNA, 24 bp, Homo sapiens
gatgtccggggctgcacgcgcgct

SEQ ID NO: 38396 - DNA, 17 bp, Homo sapiens
atgtccggggctgcacg

SEQ ID NO: 38397 - DNA, 18 bp, Homo sapiens
atgtccggggctgcacgc

SEQ ID NO: 38398 - DNA, 19 bp, Homo sapiens
atgtccggggctgcacgcg

SEQ ID NO: 38399 - DNA, 20 bp, Homo sapiens
atgtccggggctgcacgcgc

SEQ ID NO: 38400 - DNA, 21 bp, Homo sapiens
atgtccggggctgcacgcgcg

SEQ ID NO: 38401 - DNA, 22 bp, Homo sapiens
atgtccggggctgcacgcgcgc

SEQ ID NO: 38402 - DNA, 23 bp, Homo sapiens
atgtccggggctgcacgcgcgct

SEQ ID NO: 38403 - DNA, 16 bp, Homo sapiens
tgtccggggctgcacg

SEQ ID NO: 38404 - DNA, 20 bp, Homo sapiens
tgtccggggctgcacgcgcg

SEQ ID NO: 38405 - DNA, 21 bp, Homo sapiens
tgtccggggctgcacgcgcgc

SEQ ID NO: 38406 - DNA, 19 bp, Homo sapiens
gtccggggctgcacgcgcg

SEQ ID NO: 38407 - DNA, 20 bp, Homo sapiens
gtccggggctgcacgcgcgc

SEQ ID NO: 38408 - DNA, 21 bp, Homo sapiens
gtccggggctgcacgcgcgct

SEQ ID NO: 38409 - DNA, 18 bp, Homo sapiens
tccggggctgcacgcgcg

SEQ ID NO: 38410 - DNA, 19 bp, Homo sapiens
tccggggctgcacgcgcgc

SEQ ID NO: 38411 - DNA, 20 bp, Homo sapiens
tccggggctgcacgcgcgct

SEQ ID NO: 38412 - DNA, 17 bp, Homo sapiens
ccggggctgcacgcgcg

SEQ ID NO: 38413 - DNA, 18 bp, Homo sapiens
ccggggctgcacgcgcgc

SEQ ID NO: 38414 - DNA, 19 bp, Homo sapiens
ccggggctgcacgcgcgct

SEQ ID NO: 38415 - DNA, 20 bp, Homo sapiens
ccggggctgcacgcgcgcta

SEQ ID NO: 38416 - DNA, 21 bp, Homo sapiens
ccggggctgcacgcgcgctac

SEQ ID NO: 38417 - DNA, 22 bp, Homo sapiens
ccggggctgcacgcgcgctaca

SEQ ID NO: 38418 - DNA, 23 bp, Homo sapiens
ccggggctgcacgcgcgctacac

SEQ ID NO: 38419 - DNA, 24 bp, Homo sapiens
ccggggctgcacgcgcgctacact

SEQ ID NO: 38420 - DNA, 17 bp, Homo sapiens
cggggctgcacgcgcgc

SEQ ID NO: 38421 - DNA, 27 bp, Homo sapiens
gggctgcacgcgcgctacactgactgg

SEQ ID NO: 38422 - DNA, 26 bp, Homo sapiens
ggctgcacgcgcgctacactgactgg

SEQ ID NO: 38423 - DNA, 20 bp, Homo sapiens
gctgcacgcgcgctacactg

SEQ ID NO: 38424 - DNA, 24 bp, Homo sapiens
gctgcacgcgcgctacactgactg

SEQ ID NO: 38425 - DNA, 25 bp, Homo sapiens
gctgcacgcgcgctacactgactgg

SEQ ID NO: 38426 - DNA, 19 bp, Homo sapiens
ctgcacgcgcgctacactg

SEQ ID NO: 38427 - DNA, 20 bp, Homo sapiens
ctgcacgcgcgctacactga

SEQ ID NO: 38428 - DNA, 22 bp, Homo sapiens
ctgcacgcgcgctacactgact

SEQ ID NO: 38429 - DNA, 23 bp, Homo sapiens
ctgcacgcgcgctacactgactg

SEQ ID NO: 38430 - DNA, 24 bp, Homo sapiens
ctgcacgcgcgctacactgactgg

SEQ ID NO: 38431 - DNA, 26 bp, Homo sapiens
ctgcacgcgcgctacactgactggct

SEQ ID NO: 38432 - DNA, 23 bp, Homo sapiens
tgcacgcgcgctacactgactgg

SEQ ID NO: 38433 - DNA, 21 bp, Homo sapiens
gcacgcgcgctacactgactg

SEQ ID NO: 38434 - DNA, 22 bp, Homo sapiens
gcacgcgcgctacactgactgg

SEQ ID NO: 38435 - DNA, 20 bp, Homo sapiens
cacgcgcgctacactgactg

SEQ ID NO: 38436 - DNA, 21 bp, Homo sapiens
cacgcgcgctacactgactgg

SEQ ID NO: 38437 - DNA, 19 bp, Homo sapiens
cgcgcgctacactgactgg

SEQ ID NO: 38438 - DNA, 16 bp, Homo sapiens
cgcgctacactgactg

SEQ ID NO: 38439 - DNA, 17 bp, Homo sapiens
cgcgctacactgactgg

SEQ ID NO: 38440 - DNA, 16 bp, Homo sapiens
gcgctacactgactgg

SEQ ID NO: 38441 - DNA, 20 bp, Homo sapiens
cgctacactgactggctcag

SEQ ID NO: 38442 - DNA, 21 bp, Homo sapiens
ctacactgactggctcagcgt

SEQ ID NO: 38443 - DNA, 22 bp, Homo sapiens
ctacactgactggctcagcgtg

SEQ ID NO: 38444 - DNA, 20 bp, Homo sapiens
acactgactggctcagcgtg

SEQ ID NO: 38445 - DNA, 17 bp, Homo sapiens
gactggctcagcgtgtg

SEQ ID NO: 38446 - DNA, 19 bp, Homo sapiens
gactggctcagcgtgtgcc

SEQ ID NO: 38447 - DNA, 20 bp, Homo sapiens
gactggctcagcgtgtgcct

SEQ ID NO: 38448 - DNA, 28 bp, Homo sapiens
ggctcagcgtgtgcctaccctacgccgg

SEQ ID NO: 38449 - DNA, 20 bp, Homo sapiens
gctcagcgtgtgcctaccct

SEQ ID NO: 38450 - DNA, 27 bp, Homo sapiens
gctcagcgtgtgcctaccctacgccgg

SEQ ID NO: 38451 - DNA, 19 bp, Homo sapiens
ctcagcgtgtgcctaccct

SEQ ID NO: 38452 - DNA, 21 bp, Homo sapiens
cgtgtgcctaccctacgccgg

SEQ ID NO: 38453 - DNA, 22 bp, Homo sapiens
cgtgtgcctaccctacgccggc

SEQ ID NO: 38454 - DNA, 19 bp, Homo sapiens
tgtgcctaccctacgccgg

SEQ ID NO: 38455 - DNA, 18 bp, Homo sapiens
gtgcctaccctacgccgg

SEQ ID NO: 38456 - DNA, 21 bp, Homo sapiens
gtgcctaccctacgccggcag

SEQ ID NO: 38457 - DNA, 17 bp, Homo sapiens
tgcctaccctacgccgg

SEQ ID NO: 38458 - DNA, 21 bp, Homo sapiens
tgcctaccctacgccggcagg

SEQ ID NO: 38459 - DNA, 18 bp, Homo sapiens
cctaccctacgccggcag

SEQ ID NO: 38460 - DNA, 19 bp, Homo sapiens
cctaccctacgccggcagg

SEQ ID NO: 38461 - DNA, 20 bp, Homo sapiens
ccctacgccggcaggcgcgg

SEQ ID NO: 38462 - DNA, 21 bp, Homo sapiens
ccctacgccggcaggcgcggg

SEQ ID NO: 38463 - DNA, 20 bp, Homo sapiens
cgcgggtaacccgttgaacc

SEQ ID NO: 38464 - DNA, 22 bp, Homo sapiens
cgcgggtaacccgttgaacccc

SEQ ID NO: 38465 - DNA, 28 bp, Homo sapiens
cgcgggtaacccgttgaaccccattcgt

SEQ ID NO: 38466 - DNA, 29 bp, Homo sapiens
cgcgggtaacccgttgaaccccattcgtg

SEQ ID NO: 38467 - DNA, 19 bp, Homo sapiens
gcgggtaacccgttgaacc

SEQ ID NO: 38468 - DNA, 21 bp, Homo sapiens
gcgggtaacccgttgaacccc

SEQ ID NO: 38469 - DNA, 18 bp, Homo sapiens
cgggtaacccgttgaacc

SEQ ID NO: 38470 - DNA, 19 bp, Homo sapiens
cgggtaacccgttgaaccc

SEQ ID NO: 38471 - DNA, 20 bp, Homo sapiens
cgggtaacccgttgaacccc

SEQ ID NO: 38472 - DNA, 30 bp, Homo sapiens; identical to SEQ ID NO: 16552

SEQ ID NO: 38473 - DNA, 18 bp, Homo sapiens
cccgttgaaccccattcg

SEQ ID NO: 38474 - DNA, 19 bp, Homo sapiens
cccgttgaaccccattcgt

SEQ ID NO: 38475 - DNA, 20 bp, Homo sapiens
cccgttgaaccccattcgtg

SEQ ID NO: 38476 - DNA, 22 bp, Homo sapiens
cccgttgaaccccattcgtgat

SEQ ID NO: 38477 - DNA, 23 bp, Homo sapiens
cccgttgaaccccattcgtgatg

SEQ ID NO: 38478 - DNA, 24 bp, Homo sapiens
cccgttgaaccccattcgtgatgg

SEQ ID NO: 38479 - DNA, 25 bp, Homo sapiens
cccgttgaaccccattcgtgatggg

SEQ ID NO: 38480 - DNA, 22 bp, Homo sapiens
cgttgaaccccattcgtgatgg

SEQ ID NO: 38481 - DNA, 20 bp, Homo sapiens
ccattcgtgatggggatcgg

SEQ ID NO: 38482 - DNA, 22 bp, Homo sapiens
ccattcgtgatggggatcgggg

SEQ ID NO: 38483 - DNA, 27 bp, Homo sapiens
ccattcgtgatggggatcggggattgc

SEQ ID NO: 38484 - DNA, 19 bp, Homo sapiens
cattcgtgatggggatcgg

SEQ ID NO: 38485 - DNA, 20 bp, Homo sapiens
cattcgtgatggggatcggg

SEQ ID NO: 38486 - DNA, 21 bp, Homo sapiens
cattcgtgatggggatcgggg

SEQ ID NO: 38487 - DNA, 22 bp, Homo sapiens
cattcgtgatggggatcgggga

SEQ ID NO: 38488 - DNA, 26 bp, Homo sapiens
cattcgtgatggggatcggggattgc

SEQ ID NO: 38489 - DNA, 27 bp, Homo sapiens
cattcgtgatggggatcggggattgca

SEQ ID NO: 38490 - DNA, 18 bp, Homo sapiens
attcgtgatggggatcgg

SEQ ID NO: 38491 - DNA, 19 bp, Homo sapiens
attcgtgatggggatcggg

SEQ ID NO: 38492 - DNA, 20 bp, Homo sapiens
attcgtgatggggatcgggg

SEQ ID NO: 38493 - DNA, 21 bp, Homo sapiens
attcgtgatggggatcgggga

SEQ ID NO: 38494 - DNA, 24 bp, Homo sapiens
attcgtgatggggatcggggattg

SEQ ID NO: 38495 - DNA, 25 bp, Homo sapiens
attcgtgatggggatcggggattgc

SEQ ID NO: 38496 - DNA, 26 bp, Homo sapiens
attcgtgatggggatcggggattgca

SEQ ID NO: 38497 - DNA, 19 bp, Homo sapiens
ttcgtgatggggatcgggg

SEQ ID NO: 38498 - DNA, 20 bp, Homo sapiens
ttcgtgatggggatcgggga

SEQ ID NO: 38499 - DNA, 23 bp, Homo sapiens
ttcgtgatggggatcggggattg

SEQ ID NO: 38500 - DNA, 24 bp, Homo sapiens
ttcgtgatggggatcggggattgc

SEQ ID NO: 38501 - DNA, 25 bp, Homo sapiens
ttcgtgatggggatcggggattgca

SEQ ID NO: 38502 - DNA, 23 bp, Homo sapiens
tcgtgatggggatcggggattgc

SEQ ID NO: 38503 - DNA, 24 bp, Homo sapiens
tcgtgatggggatcggggattgca

SEQ ID NO: 38504 - DNA, 25 bp, Homo sapiens
tcgtgatggggatcggggattgcaa

SEQ ID NO: 38505 - DNA, 21 bp, Homo sapiens
cgtgatggggatcggggattg

SEQ ID NO: 38506 - DNA, 22 bp, Homo sapiens
cgtgatggggatcggggattgc

SEQ ID NO: 38507 - DNA, 23 bp, Homo sapiens
cgtgatggggatcggggattgca

SEQ ID NO: 38508 - DNA, 24 bp, Homo sapiens
cgtgatggggatcggggattgcaa

SEQ ID NO: 38509 - DNA, 25 bp, Homo sapiens
cgtgatggggatcggggattgcaat

SEQ ID NO: 38510 - DNA, 20 bp, Homo sapiens
gtgatggggatcggggattg

SEQ ID NO: 38511 - DNA, 21 bp, Homo sapiens
gtgatggggatcggggattgc

SEQ ID NO: 38512 - DNA, 22 bp, Homo sapiens
gtgatggggatcggggattgca

SEQ ID NO: 38513 - DNA, 23 bp, Homo sapiens
gtgatggggatcggggattgcaa

SEQ ID NO: 38514 - DNA, 24 bp, Homo sapiens
gtgatggggatcggggattgcaat

SEQ ID NO: 38515 - DNA, 25 bp, Homo sapiens
gtgatggggatcggggattgcaatt

SEQ ID NO: 38516 - DNA, 19 bp, Homo sapiens
tgatggggatcggggattg

SEQ ID NO: 38517 - DNA, 20 bp, Homo sapiens
tgatggggatcggggattgc

SEQ ID NO: 38518 - DNA, 21 bp, Homo sapiens
tgatggggatcggggattgca

SEQ ID NO: 38519 - DNA, 22 bp, Homo sapiens
tgatggggatcggggattgcaa

SEQ ID NO: 38520 - DNA, 23 bp, Homo sapiens
tgatggggatcggggattgcaat

SEQ ID NO: 38521 - DNA, 24 bp, Homo sapiens
tgatggggatcggggattgcaatt

SEQ ID NO: 38522 - DNA, 25 bp, Homo sapiens
tgatggggatcggggattgcaatta

SEQ ID NO: 38523 - DNA, 17 bp, Homo sapiens
gatggggatcggggatt

SEQ ID NO: 38524 - DNA, 18 bp, Homo sapiens
gatggggatcggggattg

SEQ ID NO: 38525 - DNA, 19 bp, Homo sapiens
gatggggatcggggattgc

SEQ ID NO: 38526 - DNA, 20 bp, Homo sapiens
gatggggatcggggattgca

SEQ ID NO: 38527 - DNA, 21 bp, Homo sapiens
gatggggatcggggattgcaa

SEQ ID NO: 38528 - DNA, 22 bp, Homo sapiens
gatggggatcggggattgcaat

SEQ ID NO: 38529 - DNA, 23 bp, Homo sapiens
gatggggatcggggattgcaatt

SEQ ID NO: 38530 - DNA, 24 bp, Homo sapiens
gatggggatcggggattgcaatta

SEQ ID NO: 38531 - DNA, 25 bp, Homo sapiens
gatggggatcggggattgcaattat

SEQ ID NO: 38532 - DNA, 16 bp, Homo sapiens
atggggatcggggatt

SEQ ID NO: 38533 - DNA, 17 bp, Homo sapiens
atggggatcggggattg

SEQ ID NO: 38534 - DNA, 18 bp, Homo sapiens
atggggatcggggattgc

SEQ ID NO: 38535 - DNA, 19 bp, Homo sapiens
atggggatcggggattgca

SEQ ID NO: 38536 - DNA, 20 bp, Homo sapiens
atggggatcggggattgcaa

SEQ ID NO: 38537 - DNA, 21 bp, Homo sapiens
atggggatcggggattgcaat

SEQ ID NO: 38538 - DNA, 22 bp, Homo sapiens
atggggatcggggattgcaatt

SEQ ID NO: 38539 - DNA, 23 bp, Homo sapiens
atggggatcggggattgcaatta

SEQ ID NO: 38540 - DNA, 24 bp, Homo sapiens
atggggatcggggattgcaattat

SEQ ID NO: 38541 - DNA, 25 bp, Homo sapiens
atggggatcggggattgcaattatt

SEQ ID NO: 38542 - DNA, 26 bp, Homo sapiens
atggggatcggggattgcaattattc

SEQ ID NO: 38543 - DNA, 16 bp, Homo sapiens
tggggatcggggattg

SEQ ID NO: 38544 - DNA, 17 bp, Homo sapiens
tggggatcggggattgc

SEQ ID NO: 38545 - DNA, 18 bp, Homo sapiens
tggggatcggggattgca

SEQ ID NO: 38546 - DNA, 19 bp, Homo sapiens
tggggatcggggattgcaa

SEQ ID NO: 38547 - DNA, 20 bp, Homo sapiens
tggggatcggggattgcaat

SEQ ID NO: 38548 - DNA, 21 bp, Homo sapiens
tggggatcggggattgcaatt

SEQ ID NO: 38549 - DNA, 22 bp, Homo sapiens
tggggatcggggattgcaatta

SEQ ID NO: 38550 - DNA, 23 bp, Homo sapiens
tggggatcggggattgcaattat

SEQ ID NO: 38551 - DNA, 16 bp, Homo sapiens
ggggatcggggattgc

SEQ ID NO: 38552 - DNA, 17 bp, Homo sapiens
ggggatcggggattgca

SEQ ID NO: 38553 - DNA, 18 bp, Homo sapiens
ggggatcggggattgcaa

SEQ ID NO: 38554 - DNA, 19 bp, Homo sapiens
ggggatcggggattgcaat

SEQ ID NO: 38555 - DNA, 20 bp, Homo sapiens
ggggatcggggattgcaatt

SEQ ID NO: 38556 - DNA, 21 bp, Homo sapiens
ggggatcggggattgcaatta

SEQ ID NO: 38557 - DNA, 22 bp, Homo sapiens
ggggatcggggattgcaattat

SEQ ID NO: 38558 - DNA, 23 bp, Homo sapiens
ggggatcggggattgcaattatt

SEQ ID NO: 38559 - DNA, 16 bp, Homo sapiens
gggatcggggattgca

SEQ ID NO: 38560 - DNA, 17 bp, Homo sapiens
gggatcggggattgcaa

SEQ ID NO: 38561 - DNA, 18 bp, Homo sapiens
gggatcggggattgcaat

SEQ ID NO: 38562 - DNA, 19 bp, Homo sapiens
gggatcggggattgcaatt

SEQ ID NO: 38563 - DNA, 20 bp, Homo sapiens
gggatcggggattgcaatta

SEQ ID NO: 38564 - DNA, 21 bp, Homo sapiens
gggatcggggattgcaattat

SEQ ID NO: 38565 - DNA, 23 bp, Homo sapiens
gggatcggggattgcaattattc

SEQ ID NO: 38566 - DNA, 17 bp, Homo sapiens
ggatcggggattgcaat

SEQ ID NO: 38567 - DNA, 18 bp, Homo sapiens
ggatcggggattgcaatt

SEQ ID NO: 38568 - DNA, 19 bp, Homo sapiens
ggatcggggattgcaatta

SEQ ID NO: 38569 - DNA, 20 bp, Homo sapiens
ggatcggggattgcaattat

SEQ ID NO: 38570 - DNA, 22 bp, Homo sapiens
ggatcggggattgcaattattc

SEQ ID NO: 38571 - DNA, 16 bp, Homo sapiens
gatcggggattgcaat

SEQ ID NO: 38572 - DNA, 17 bp, Homo sapiens
gatcggggattgcaatt

SEQ ID NO: 38573 - DNA, 18 bp, Homo sapiens
gatcggggattgcaatta

SEQ ID NO: 38574 - DNA, 19 bp, Homo sapiens
gatcggggattgcaattat

SEQ ID NO: 38575 - DNA, 20 bp, Homo sapiens
gatcggggattgcaattatt

SEQ ID NO: 38576 - DNA, 21 bp, Homo sapiens
gatcggggattgcaattattc

SEQ ID NO: 38577 - DNA, 20 bp, Homo sapiens
gattgcaattattccccatg

SEQ ID NO: 38578 - DNA, 19 bp, Homo sapiens
attgcaattattccccatg

SEQ ID NO: 38579 - DNA, 18 bp, Homo sapiens
ttgcaattattccccatg

SEQ ID NO: 38580 - DNA, 17 bp, Homo sapiens
tgcaattattccccatg

SEQ ID NO: 38581 - DNA, 23 bp, Homo sapiens
gcaattattccccatgaacgagg

SEQ ID NO: 38582 - DNA, 22 bp, Homo sapiens
caattattccccatgaacgagg

SEQ ID NO: 38583 - DNA, 20 bp, Homo sapiens
attattccccatgaacgagg

SEQ ID NO: 38584 - DNA, 19 bp, Homo sapiens
ttattccccatgaacgagg

SEQ ID NO: 38585 - DNA, 18 bp, Homo sapiens
tattccccatgaacgagg

SEQ ID NO: 38586 - DNA, 17 bp, Homo sapiens
attccccatgaacgagg

SEQ ID NO: 38587 - DNA, 26 bp, Homo sapiens
attccccatgaacgaggaattcccag

SEQ ID NO: 38588 - DNA, 27 bp, Homo sapiens
attccccatgaacgaggaattcccagt

SEQ ID NO: 38589 - DNA, 30 bp, Homo sapiens
attccccatgaacgaggaattcccagtaag

SEQ ID NO: 38590 - DNA, 16 bp, Homo sapiens
ttccccatgaacgagg

SEQ ID NO: 38591 - DNA, 25 bp, Homo sapiens
ttccccatgaacgaggaattcccag

SEQ ID NO: 38592 - DNA, 26 bp, Homo sapiens
ttccccatgaacgaggaattcccagt

SEQ ID NO: 38593 - DNA, 27 bp, Homo sapiens
ttccccatgaacgaggaattcccagta

SEQ ID NO: 38594 - DNA, 30 bp, Homo sapiens
ttccccatgaacgaggaattcccagtaagt

SEQ ID NO: 38595 - DNA, 24 bp, Homo sapiens
tccccatgaacgaggaattcccag

SEQ ID NO: 38596 - DNA, 25 bp, Homo sapiens
tccccatgaacgaggaattcccagt

SEQ ID NO: 38597 - DNA, 30 bp, Homo sapiens
tccccatgaacgaggaattcccagtaagtg

SEQ ID NO: 38598 - DNA, 23 bp, Homo sapiens
ccccatgaacgaggaattcccag

SEQ ID NO: 38599 - DNA, 18 bp, Homo sapiens
cccatgaacgaggaattc

SEQ ID NO: 38600 - DNA, 19 bp, Homo sapiens
cccatgaacgaggaattcc

SEQ ID NO: 38601 - DNA, 20 bp, Homo sapiens
cccatgaacgaggaattccc

SEQ ID NO: 38602 - DNA, 22 bp, Homo sapiens
cccatgaacgaggaattcccag

SEQ ID NO: 38603 - DNA, 23 bp, Homo sapiens
cccatgaacgaggaattcccagt

SEQ ID NO: 38604 - DNA, 18 bp, Homo sapiens
ccatgaacgaggaattcc

SEQ ID NO: 38605 - DNA, 19 bp, Homo sapiens
ccatgaacgaggaattccc

SEQ ID NO: 38606 - DNA, 21 bp, Homo sapiens
ccatgaacgaggaattcccag

SEQ ID NO: 38607 - DNA, 22 bp, Homo sapiens
ccatgaacgaggaattcccagt

SEQ ID NO: 38608 - DNA, 17 bp, Homo sapiens
atgaacgaggaattccc

SEQ ID NO: 38609 - DNA, 19 bp, Homo sapiens
atgaacgaggaattcccag

SEQ ID NO: 38610 - DNA, 20 bp, Homo sapiens
atgaacgaggaattcccagt

SEQ ID NO: 38611 - DNA, 18 bp, Homo sapiens
tgaacgaggaattcccag

SEQ ID NO: 38612 - DNA, 16 bp, Homo sapiens
aacgaggaattcccag

SEQ ID NO: 38613 - DNA, 17 bp, Homo sapiens
aacgaggaattcccagt

SEQ ID NO: 38614 - DNA, 18 bp, Homo sapiens
cgaggaattcccagtaag

SEQ ID NO: 38615 - DNA, 19 bp, Homo sapiens
cgaggaattcccagtaagt

SEQ ID NO: 38616 - DNA, 20 bp, Homo sapiens
cgaggaattcccagtaagtg

SEQ ID NO: 38617 - DNA, 22 bp, Homo sapiens
cgaggaattcccagtaagtgcg

SEQ ID NO: 38618 - DNA, 23 bp, Homo sapiens
cgaggaattcccagtaagtgcgg

SEQ ID NO: 38619 - DNA, 21 bp, Homo sapiens
gaggaattcccagtaagtgcg

SEQ ID NO: 38620 - DNA, 20 bp, Homo sapiens
aggaattcccagtaagtgcg

SEQ ID NO: 38621 - DNA, 21 bp, Homo sapiens
aggaattcccagtaagtgcgg

SEQ ID NO: 38622 - DNA, 20 bp, Homo sapiens
ggaattcccagtaagtgcgg

SEQ ID NO: 38623 - DNA, 18 bp, Homo sapiens
gaattcccagtaagtgcg

SEQ ID NO: 38624 - DNA, 19 bp, Homo sapiens
gaattcccagtaagtgcgg

SEQ ID NO: 38625 - DNA, 22 bp, Homo sapiens
gaattcccagtaagtgcgggtc

SEQ ID NO: 38626 - DNA, 17 bp, Homo sapiens
aattcccagtaagtgcg

SEQ ID NO: 38627 - DNA, 18 bp, Homo sapiens
aattcccagtaagtgcgg

SEQ ID NO: 38628 - DNA, 19 bp, Homo sapiens
aattcccagtaagtgcggg

SEQ ID NO: 38629 - DNA, 20 bp, Homo sapiens
aattcccagtaagtgcgggt

SEQ ID NO: 38630 - DNA, 21 bp, Homo sapiens
aattcccagtaagtgcgggtc

SEQ ID NO: 38631 - DNA, 23 bp, Homo sapiens
aattcccagtaagtgcgggtcat

SEQ ID NO: 38632 - DNA, 26 bp, Homo sapiens
aattcccagtaagtgcgggtcataag

SEQ ID NO: 38633 - DNA, 16 bp, Homo sapiens
attcccagtaagtgcg

SEQ ID NO: 38634 - DNA, 17 bp, Homo sapiens
attcccagtaagtgcgg

SEQ ID NO: 38635 - DNA, 18 bp, Homo sapiens
attcccagtaagtgcggg

SEQ ID NO: 38636 - DNA, 19 bp, Homo sapiens
attcccagtaagtgcgggt

SEQ ID NO: 38637 - DNA, 20 bp, Homo sapiens
attcccagtaagtgcgggtc

SEQ ID NO: 38638 - DNA, 25 bp, Homo sapiens
attcccagtaagtgcgggtcataag

SEQ ID NO: 38639 - DNA, 16 bp, Homo sapiens
ttcccagtaagtgcgg

SEQ ID NO: 38640 - DNA, 17 bp, Homo sapiens
ttcccagtaagtgcggg

SEQ ID NO: 38641 - DNA, 19 bp, Homo sapiens
ttcccagtaagtgcgggtc

SEQ ID NO: 38642 - DNA, 24 bp, Homo sapiens
ttcccagtaagtgcgggtcataag

SEQ ID NO: 38643 - DNA, 25 bp, Homo sapiens
ttcccagtaagtgcgggtcataagc

SEQ ID NO: 38644 - DNA, 16 bp, Homo sapiens
tcccagtaagtgcggg

SEQ ID NO: 38645 - DNA, 20 bp, Homo sapiens
tcccagtaagtgcgggtcat

SEQ ID NO: 38646 - DNA, 23 bp, Homo sapiens
tcccagtaagtgcgggtcataag

SEQ ID NO: 38647 - DNA, 25 bp, Homo sapiens
tgcgggtcataagcttgcgttgatt

SEQ ID NO: 38648 - DNA, 28 bp, Homo sapiens
tgcgggtcataagcttgcgttgattaag

SEQ ID NO: 38649 - DNA, 29 bp, Homo sapiens
tgcgggtcataagcttgcgttgattaagt

SEQ ID NO: 38650 - DNA, 24 bp, Homo sapiens
gcgggtcataagcttgcgttgatt

SEQ ID NO: 38651 - DNA, 27 bp, Homo sapiens
gcgggtcataagcttgcgttgattaag

SEQ ID NO: 38652 - DNA, 17 bp, Homo sapiens
cgggtcataagcttgcg

SEQ ID NO: 38653 - DNA, 19 bp, Homo sapiens
cgggtcataagcttgcgtt

SEQ ID NO: 38654 - DNA, 23 bp, Homo sapiens
cgggtcataagcttgcgttgatt

SEQ ID NO: 38655 - DNA, 26 bp, Homo sapiens
cgggtcataagcttgcgttgattaag

SEQ ID NO: 38656 - DNA, 27 bp, Homo sapiens
cgggtcataagcttgcgttgattaagt

SEQ ID NO: 38657 - DNA, 21 bp, Homo sapiens
gggtcataagcttgcgttgat

SEQ ID NO: 38658 - DNA, 22 bp, Homo sapiens
gggtcataagcttgcgttgatt

SEQ ID NO: 38659 - DNA, 17 bp, Homo sapiens
ggtcataagcttgcgtt

SEQ ID NO: 38660 - DNA, 20 bp, Homo sapiens
ggtcataagcttgcgttgat

SEQ ID NO: 38661 - DNA, 21 bp, Homo sapiens
ggtcataagcttgcgttgatt

SEQ ID NO: 38662 - DNA, 24 bp, Homo sapiens
ggtcataagcttgcgttgattaag

SEQ ID NO: 38663 - DNA, 17 bp, Homo sapiens
gtcataagcttgcgttg

SEQ ID NO: 38664 - DNA, 20 bp, Homo sapiens
gtcataagcttgcgttgatt

SEQ ID NO: 38665 - DNA, 22 bp, Homo sapiens
tcataagcttgcgttgattaag

SEQ ID NO: 38666 - DNA, 18 bp, Homo sapiens
cataagcttgcgttgatt

SEQ ID NO: 38667 - DNA, 21 bp, Homo sapiens
cataagcttgcgttgattaag

SEQ ID NO: 38668 - DNA, 22 bp, Homo sapiens
cataagcttgcgttgattaagt

SEQ ID NO: 38669 - DNA, 18 bp, Homo sapiens
aagcttgcgttgattaag

SEQ ID NO: 38670 - DNA, 22 bp, Homo sapiens
gcttgcgttgattaagtccctg

SEQ ID NO: 38671 - DNA, 21 bp, Homo sapiens
cttgcgttgattaagtccctg

SEQ ID NO: 38672 - DNA, 18 bp, Homo sapiens
gcgttgattaagtccctg

SEQ ID NO: 38673 - DNA, 23 bp, Homo sapiens
gcgttgattaagtccctgccctt

SEQ ID NO: 38674 - DNA, 22 bp, Homo sapiens
cgttgattaagtccctgccctt

SEQ ID NO: 38675 - DNA, 24 bp, Homo sapiens
cgttgattaagtccctgccctttg

SEQ ID NO: 38676 - DNA, 28 bp, Homo sapiens
cgttgattaagtccctgccctttgtaca

SEQ ID NO: 38677 - DNA, 19 bp, Homo sapiens
gttgattaagtccctgccc

SEQ ID NO: 38678 - DNA, 20 bp, Homo sapiens
gttgattaagtccctgccct

SEQ ID NO: 38679 - DNA, 21 bp, Homo sapiens
gttgattaagtccctgccctt

SEQ ID NO: 38680 - DNA, 20 bp, Homo sapiens
ttgattaagtccctgccctt

SEQ ID NO: 38681 - DNA, 22 bp, Homo sapiens
ttgattaagtccctgccctttg

SEQ ID NO: 38682 - DNA, 26 bp, Homo sapiens
ttgattaagtccctgccctttgtaca

SEQ ID NO: 38683 - DNA, 19 bp, Homo sapiens
tgattaagtccctgccctt

SEQ ID NO: 38684 - DNA, 21 bp, Homo sapiens
tgattaagtccctgccctttg

SEQ ID NO: 38685 - DNA, 22 bp, Homo sapiens
tgattaagtccctgccctttgt

SEQ ID NO: 38686 - DNA, 17 bp, Homo sapiens
gattaagtccctgccct

SEQ ID NO: 38687 - DNA, 18 bp, Homo sapiens
gattaagtccctgccctt

SEQ ID NO: 38688 - DNA, 20 bp, Homo sapiens
gattaagtccctgccctttg

SEQ ID NO: 38689 - DNA, 21 bp, Homo sapiens
gattaagtccctgccctttgt

SEQ ID NO: 38690 - DNA, 22 bp, Homo sapiens
gattaagtccctgccctttgta

SEQ ID NO: 38691 - DNA, 17 bp, Homo sapiens
attaagtccctgccctt

SEQ ID NO: 38692 - DNA, 19 bp, Homo sapiens
attaagtccctgccctttg

SEQ ID NO: 38693 - DNA, 20 bp, Homo sapiens
attaagtccctgccctttgt

SEQ ID NO: 38694 - DNA, 24 bp, Homo sapiens
ttaagtccctgccctttgtacaca

SEQ ID NO: 38695 - DNA, 17 bp, Homo sapiens
aagtccctgccctttgt

SEQ ID NO: 38696 - DNA, 22 bp, Homo sapiens
cctgccctttgtacacaccgcc

SEQ ID NO: 38697 - DNA, 20 bp, Homo sapiens
ctgccctttgtacacaccgc

SEQ ID NO: 38698 - DNA, 21 bp, Homo sapiens
ctgccctttgtacacaccgcc

SEQ ID NO: 38699 - DNA, 22 bp, Homo sapiens
ctgccctttgtacacaccgccc

SEQ ID NO: 38700 - DNA, 23 bp, Homo sapiens
ctgccctttgtacacaccgcccg

SEQ ID NO: 38701 - DNA, 20 bp, Homo sapiens
ccctttgtacacaccgcccg

SEQ ID NO: 38702 - DNA, 21 bp, Homo sapiens
ccctttgtacacaccgcccgt

SEQ ID NO: 38703 - DNA, 16 bp, Homo sapiens
ctttgtacacaccgcc

SEQ ID NO: 38704 - DNA, 17 bp, Homo sapiens
ctttgtacacaccgccc

SEQ ID NO: 38705 - DNA, 20 bp, Homo sapiens
ctttgtacacaccgcccgtc

SEQ ID NO: 38706 - DNA, 21 bp, Homo sapiens
ctttgtacacaccgcccgtcg

SEQ ID NO: 38707 - DNA, 22 bp, Homo sapiens
ctttgtacacaccgcccgtcgc

SEQ ID NO: 38708 - DNA, 23 bp, Homo sapiens
ctttgtacacaccgcccgtcgct

SEQ ID NO: 38709 - DNA, 20 bp, Homo sapiens
tttgtacacaccgcccgtcg

SEQ ID NO: 38710 - DNA, 21 bp, Homo sapiens
ttgtacacaccgcccgtcgct

SEQ ID NO: 38711 - DNA, 18 bp, Homo sapiens
tgtacacaccgcccgtcg

SEQ ID NO: 38712 - DNA, 19 bp, Homo sapiens
tgtacacaccgcccgtcgc

SEQ ID NO: 38713 - DNA, 20 bp, Homo sapiens
tgtacacaccgcccgtcgct

SEQ ID NO: 38714 - DNA, 21 bp, Homo sapiens
tgtacacaccgcccgtcgcta

SEQ ID NO: 38715 - DNA, 22 bp, Homo sapiens
tgtacacaccgcccgtcgctac

SEQ ID NO: 38716 - DNA, 23 bp, Homo sapiens
tgtacacaccgcccgtcgctact

SEQ ID NO: 38717 - DNA, 24 bp, Homo sapiens
tgtacacaccgcccgtcgctacta

SEQ ID NO: 38718 - DNA, 16 bp, Homo sapiens
tacacaccgcccgtcg

SEQ ID NO: 38719 - DNA, 18 bp, Homo sapiens
tacacaccgcccgtcgct

SEQ ID NO: 38720 - DNA, 17 bp, Homo sapiens
acacaccgcccgtcgct

SEQ ID NO: 38721 - DNA, 20 bp, Homo sapiens
acacaccgcccgtcgctact

SEQ ID NO: 38722 - DNA, 25 bp, Homo sapiens
acacaccgcccgtcgctactaccga

SEQ ID NO: 38723 - DNA, 19 bp, Homo sapiens
cacaccgcccgtcgctact

SEQ ID NO: 38724 - DNA, 20 bp, Homo sapiens
cacaccgcccgtcgctacta

SEQ ID NO: 38725 - DNA, 22 bp, Homo sapiens
cacaccgcccgtcgctactacc

SEQ ID NO: 38726 - DNA, 23 bp, Homo sapiens
cacaccgcccgtcgctactaccg

SEQ ID NO: 38727 - DNA, 24 bp, Homo sapiens
cacaccgcccgtcgctactaccga

SEQ ID NO: 38728 - DNA, 21 bp, Homo sapiens
acaccgcccgtcgctactacc

SEQ ID NO: 38729 - DNA, 23 bp, Homo sapiens
acaccgcccgtcgctactaccga

SEQ ID NO: 38730 - DNA, 17 bp, Homo sapiens
caccgcccgtcgctact

SEQ ID NO: 38731 - DNA, 20 bp, Homo sapiens
caccgcccgtcgctactacc

SEQ ID NO: 38732 - DNA, 21 bp, Homo sapiens
caccgcccgtcgctactaccg

SEQ ID NO: 38733 - DNA, 22 bp, Homo sapiens
caccgcccgtcgctactaccga

SEQ ID NO: 38734 - DNA, 16 bp, Homo sapiens
accgcccgtcgctact

SEQ ID NO: 38735 - DNA, 19 bp, Homo sapiens
accgcccgtcgctactacc

SEQ ID NO: 38736 - DNA, 21 bp, Homo sapiens
accgcccgtcgctactaccga

SEQ ID NO: 38737 - DNA, 18 bp, Homo sapiens
ccgcccgtcgctactacc

SEQ ID NO: 38738 - DNA, 19 bp, Homo sapiens
ccgcccgtcgctactaccg

SEQ ID NO: 38739 - DNA, 20 bp, Homo sapiens
ccgcccgtcgctactaccga

SEQ ID NO: 38740 - DNA, 22 bp, Homo sapiens
ccgcccgtcgctactaccgatt

SEQ ID NO: 38741 - DNA, 21 bp, Homo sapiens
cccgtcgctactaccgattgg

SEQ ID NO: 38742 - DNA, 16 bp, Homo sapiens
gtcgctactaccgatt

SEQ ID NO: 38743 - DNA, 22 bp, Homo sapiens
gtcgctactaccgattggatgg

SEQ ID NO: 38744 - DNA, 23 bp, Homo sapiens
gtcgctactaccgattggatggt

SEQ ID NO: 38745 - DNA, 16 bp, Homo sapiens
tcgctactaccgattg

SEQ ID NO: 38746 - DNA, 20 bp, Homo sapiens
tcgctactaccgattggatg

SEQ ID NO: 38747 - DNA, 21 bp, Homo sapiens
tcgctactaccgattggatgg

SEQ ID NO: 38748 - DNA, 20 bp, Homo sapiens
cgctactaccgattggatgg

SEQ ID NO: 38749 - DNA, 18 bp, Homo sapiens
ctactaccgattggatgg

SEQ ID NO: 38750 - DNA, 23 bp, Homo sapiens
ctactaccgattggatggtttag

SEQ ID NO: 38751 - DNA, 17 bp, Homo sapiens
tactaccgattggatgg

SEQ ID NO: 38752 - DNA, 16 bp, Homo sapiens
actaccgattggatgg

SEQ ID NO: 38753 - DNA, 21 bp, Homo sapiens
actaccgattggatggtttag

SEQ ID NO: 38754 - DNA, 22 bp, Homo sapiens
actaccgattggatggtttagt

SEQ ID NO: 38755 - DNA, 20 bp, Homo sapiens
ctaccgattggatggtttag

SEQ ID NO: 38756 - DNA, 22 bp, Homo sapiens
ctaccgattggatggtttagtg

SEQ ID NO: 38757 - DNA, 23 bp, Homo sapiens
ctaccgattggatggtttagtga

SEQ ID NO: 38758 - DNA, 24 bp, Homo sapiens
ctaccgattggatggtttagtgag

SEQ ID NO: 38759 - DNA, 18 bp, Homo sapiens
accgattggatggtttag

SEQ ID NO: 38760 - DNA, 19 bp, Homo sapiens
accgattggatggtttagt

SEQ ID NO: 38761 - DNA, 20 bp, Homo sapiens
accgattggatggtttagtg

SEQ ID NO: 38762 - DNA, 22 bp, Homo sapiens
accgattggatggtttagtgag

SEQ ID NO: 38763 - DNA, 23 bp, Homo sapiens
accgattggatggtttagtgagg

SEQ ID NO: 38764 - DNA, 30 bp, Homo sapiens
accgattggatggtttagtgaggccctcgg

SEQ ID NO: 38765 - DNA, 17 bp, Homo sapiens
ccgattggatggtttag

SEQ ID NO: 38766 - DNA, 19 bp, Homo sapiens
ccgattggatggtttagtg

SEQ ID NO: 38767 - DNA, 20 bp, Homo sapiens
ccgattggatggtttagtga

SEQ ID NO: 38768 - DNA, 21 bp, Homo sapiens
ccgattggatggtttagtgag

SEQ ID NO: 38769 - DNA, 22 bp, Homo sapiens
ccgattggatggtttagtgagg

SEQ ID NO: 38770 - DNA, 21 bp, Homo sapiens
gattggatggtttagtgaggc

SEQ ID NO: 38771 - DNA, 22 bp, Homo sapiens
gattggatggtttagtgaggcc

SEQ ID NO: 38772 - DNA, 28 bp, Homo sapiens
gattggatggtttagtgaggccctcgga

SEQ ID NO: 38773 - DNA, 25 bp, Homo sapiens
tggatggtttagtgaggccctcgga

SEQ ID NO: 38774 - DNA, 21 bp, Homo sapiens
ggatggtttagtgaggccctc

SEQ ID NO: 38775 - DNA, 22 bp, Homo sapiens
ggatggtttagtgaggccctcg

SEQ ID NO: 38776 - DNA, 23 bp, Homo sapiens
ggatggtttagtgaggccctcgg

SEQ ID NO: 38777 - DNA, 24 bp, Homo sapiens
ggatggtttagtgaggccctcgga

SEQ ID NO: 38778 - DNA, 25 bp, Homo sapiens
ggatggtttagtgaggccctcggat

SEQ ID NO: 38779 - DNA, 28 bp, Homo sapiens
ggatggtttagtgaggccctcggatcgg

SEQ ID NO: 38780 - DNA, 29 bp, Homo sapiens
ggatggtttagtgaggccctcggatcggc

SEQ ID NO: 38781 - DNA, 30 bp, Homo sapiens; identical to SEQ ID NO: 16896

SEQ ID NO: 38782 - DNA, 20 bp, Homo sapiens
gatggtttagtgaggccctc

SEQ ID NO: 38783 - DNA, 21 bp, Homo sapiens
gatggtttagtgaggccctcg

SEQ ID NO: 38784 - DNA, 22 bp, Homo sapiens
gatggtttagtgaggccctcgg

SEQ ID NO: 38785 - DNA, 23 bp, Homo sapiens
gatggtttagtgaggccctcgga

SEQ ID NO: 38786 - DNA, 24 bp, Homo sapiens
gatggtttagtgaggccctcggat

SEQ ID NO: 38787 - DNA, 27 bp, Homo sapiens
gatggtttagtgaggccctcggatcgg

SEQ ID NO: 38788 - DNA, 29 bp, Homo sapiens
gatggtttagtgaggccctcggatcggcc

SEQ ID NO: 38789 - DNA, 30 bp, Homo sapiens
gatggtttagtgaggccctcggatcggccc

SEQ ID NO: 38790 - DNA, 21 bp, Homo sapiens
atggtttagtgaggccctcgg

SEQ ID NO: 38791 - DNA, 22 bp, Homo sapiens
atggtttagtgaggccctcgga

SEQ ID NO: 38792 - DNA, 23 bp, Homo sapiens
atggtttagtgaggccctcggat

SEQ ID NO: 38793 - DNA, 21 bp, Homo sapiens
tggtttagtgaggccctcgga

SEQ ID NO: 38794 - DNA, 19 bp, Homo sapiens
ggtttagtgaggccctcgg

SEQ ID NO: 38795 - DNA, 20 bp, Homo sapiens
ggtttagtgaggccctcgga

SEQ ID NO: 38796 - DNA, 21 bp, Homo sapiens
ggtttagtgaggccctcggat

SEQ ID NO: 38797 - DNA, 24 bp, Homo sapiens
ggtttagtgaggccctcggatcgg

SEQ ID NO: 38798 - DNA, 25 bp, Homo sapiens
ggtttagtgaggccctcggatcggc

SEQ ID NO: 38799 - DNA, 26 bp, Homo sapiens
ggtttagtgaggccctcggatcggcc

SEQ ID NO: 38800 - DNA, 18 bp, Homo sapiens
gtttagtgaggccctcgg

SEQ ID NO: 38801 - DNA, 19 bp, Homo sapiens
gtttagtgaggccctcgga

SEQ ID NO: 38802 - DNA, 20 bp, Homo sapiens
gtttagtgaggccctcggat

SEQ ID NO: 38803 - DNA, 22 bp, Homo sapiens
gtttagtgaggccctcggatcg

SEQ ID NO: 38804 - DNA, 23 bp, Homo sapiens
gtttagtgaggccctcggatcgg

SEQ ID NO: 38805 - DNA, 30 bp, Homo sapiens
gtttagtgaggccctcggatcggccccgcc

SEQ ID NO: 38806 - DNA, 17 bp, Homo sapiens
tttagtgaggccctcgg

SEQ ID NO: 38807 - DNA, 18 bp, Homo sapiens
tttagtgaggccctcgga

SEQ ID NO: 38808 - DNA, 19 bp, Homo sapiens
tttagtgaggccctcggat

SEQ ID NO: 38809 - DNA, 21 bp, Homo sapiens
tttagtgaggccctcggatcg

SEQ ID NO: 38810 - DNA, 22 bp, Homo sapiens
tttagtgaggccctcggatcgg

SEQ ID NO: 38811 - DNA, 19 bp, Homo sapiens
ttagtgaggccctcggatc

SEQ ID NO: 38812 - DNA, 21 bp, Homo sapiens
ttagtgaggccctcggatcgg

SEQ ID NO: 38813 - DNA, 19 bp, Homo sapiens
tagtgaggccctcggatcg

SEQ ID NO: 38814 - DNA, 20 bp, Homo sapiens
tagtgaggccctcggatcgg

SEQ ID NO: 38815 - DNA, 19 bp, Homo sapiens
agtgaggccctcggatcgg

SEQ ID NO: 38816 - DNA, 30 bp, Homo sapiens
agtgaggccctcggatcggccccgccgggg

SEQ ID NO: 38817 - DNA, 18 bp, Homo sapiens
gtgaggccctcggatcgg

SEQ ID NO: 38818 - DNA, 19 bp, Homo sapiens
gtgaggccctcggatcggc

SEQ ID NO: 38819 - DNA, 20 bp, Homo sapiens
gtgaggccctcggatcggcc

SEQ ID NO: 38820 - DNA, 21 bp, Homo sapiens
gtgaggccctcggatcggccc

SEQ ID NO: 38821 - DNA, 25 bp, Homo sapiens
gtgaggccctcggatcggccccgcc

SEQ ID NO: 38822 - DNA, 27 bp, Homo sapiens
gtgaggccctcggatcggccccgccgg

SEQ ID NO: 38823 - DNA, 28 bp, Homo sapiens
gtgaggccctcggatcggccccgccggg

SEQ ID NO: 38824 - DNA, 29 bp, Homo sapiens
gtgaggccctcggatcggccccgccgggg

SEQ ID NO: 38825 - DNA, 30 bp, Homo sapiens
gtgaggccctcggatcggccccgccggggt

SEQ ID NO: 38826 - DNA, 18 bp, Homo sapiens
tgaggccctcggatcggc

SEQ ID NO: 38827 - DNA, 25 bp, Homo sapiens
gaggccctcggatcggccccgccgg

SEQ ID NO: 38828 - DNA, 30 bp, Homo sapiens
gaggccctcggatcggccccgccggggtcg

SEQ ID NO: 38829 - DNA, 22 bp, Homo sapiens
gccctcggatcggccccgccgg

SEQ ID NO: 38830 - DNA, 21 bp, Homo sapiens
ccctcggatcggccccgccgg

SEQ ID NO: 38831 - DNA, 20 bp, Homo sapiens
cctcggatcggccccgccgg

SEQ ID NO: 38832 - DNA, 21 bp, Homo sapiens
cctcggatcggccccgccggg

SEQ ID NO: 38833 - DNA, 17 bp, Homo sapiens
ctcggatcggccccgcc

SEQ ID NO: 38834 - DNA, 18 bp, Homo sapiens
ctcggatcggccccgccg

SEQ ID NO: 38835 - DNA, 19 bp, Homo sapiens
ctcggatcggccccgccgg

SEQ ID NO: 38836 - DNA, 20 bp, Homo sapiens
ctcggatcggccccgccggg

SEQ ID NO: 38837 - DNA, 21 bp, Homo sapiens
ctcggatcggccccgccgggg

SEQ ID NO: 38838 - DNA, 22 bp, Homo sapiens
ctcggatcggccccgccggggt

SEQ ID NO: 38839 - DNA, 23 bp, Homo sapiens
ctcggatcggccccgccggggtc

SEQ ID NO: 38840 - DNA, 24 bp, Homo sapiens
ctcggatcggccccgccggggtcg

SEQ ID NO: 38841 - DNA, 25 bp, Homo sapiens
ctcggatcggccccgccggggtcgg

SEQ ID NO: 38842 - DNA, 26 bp, Homo sapiens
ctcggatcggccccgccggggtcggc

SEQ ID NO: 38843 - DNA, 27 bp, Homo sapiens
ctcggatcggccccgccggggtcggcc

SEQ ID NO: 38844 - DNA, 25 bp, Homo sapiens
tcggatcggccccgccggggtcggc

SEQ ID NO: 38845 - DNA, 17 bp, Homo sapiens
cggatcggccccgccgg

SEQ ID NO: 38846 - DNA, 19 bp, Homo sapiens
cggatcggccccgccgggg

SEQ ID NO: 38847 - DNA, 24 bp, Homo sapiens
cggatcggccccgccggggtcggc

SEQ ID NO: 38848 - DNA, 22 bp, Homo sapiens
ggatcggccccgccggggtcgg

SEQ ID NO: 38849 - DNA, 23 bp, Homo sapiens
ggatcggccccgccggggtcggc

SEQ ID NO: 38850 - DNA, 24 bp, Homo sapiens
ggatcggccccgccggggtcggcc

SEQ ID NO: 38851 - DNA, 21 bp, Homo sapiens
gatcggccccgccggggtcgg

SEQ ID NO: 38852 - DNA, 22 bp, Homo sapiens
gatcggccccgccggggtcggc

SEQ ID NO: 38853 - DNA, 23 bp, Homo sapiens
gatcggccccgccggggtcggcc

SEQ ID NO: 38854 - DNA, 16 bp, Homo sapiens
cggccccgccggggtc

SEQ ID NO: 38855 - DNA, 19 bp, Homo sapiens
cggccccgccggggtcggc

SEQ ID NO: 38856 - DNA, 18 bp, Homo sapiens
ggccccgccggggtcggc

SEQ ID NO: 38857 - DNA, 19 bp, Homo sapiens
ggccccgccggggtcggcc

SEQ ID NO: 38858 - DNA, 20 bp, Homo sapiens
ggccccgccggggtcggccc

SEQ ID NO: 38859 - DNA, 19 bp, Homo sapiens
gccccgccggggtcggccc

SEQ ID NO: 38860 - DNA, 18 bp, Homo sapiens
ccccgccggggtcggccc

SEQ ID NO: 38861 - DNA, 22 bp, Homo sapiens
ggtcggcccacggccctggcgg

SEQ ID NO: 38862 - DNA, 29 bp, Homo sapiens
ggtcggcccacggccctggcggagcgctg

SEQ ID NO: 38863 - DNA, 18 bp, Homo sapiens
ggcccacggccctggcgg

SEQ ID NO: 38864 - DNA, 19 bp, Homo sapiens
ggcccacggccctggcgga

SEQ ID NO: 38865 - DNA, 20 bp, Homo sapiens
ggcccacggccctggcggag

SEQ ID NO: 38866 - DNA, 21 bp, Homo sapiens
ggcccacggccctggcggagc

SEQ ID NO: 38867 - DNA, 22 bp, Homo sapiens
ggcccacggccctggcggagcg

SEQ ID NO: 38868 - DNA, 23 bp, Homo sapiens
ggcccacggccctggcggagcgc

SEQ ID NO: 38869 - DNA, 30 bp, Homo sapiens
ggcccacggccctggcggagcgctgagaag

SEQ ID NO: 38870 - DNA, 20 bp, Homo sapiens
gcccacggccctggcggagc

SEQ ID NO: 38871 - DNA, 21 bp, Homo sapiens
gcccacggccctggcggagcg

SEQ ID NO: 38872 - DNA, 22 bp, Homo sapiens
gcccacggccctggcggagcgc

SEQ ID NO: 38873 - DNA, 29 bp, Homo sapiens
gcccacggccctggcggagcgctgagaag

SEQ ID NO: 38874 - DNA, 20 bp, Homo sapiens
cccacggccctggcggagcg

SEQ ID NO: 38875 - DNA, 21 bp, Homo sapiens
cccacggccctggcggagcgc

SEQ ID NO: 38876 - DNA, 18 bp, Homo sapiens
ccacggccctggcggagc

SEQ ID NO: 38877 - DNA, 19 bp, Homo sapiens
ccacggccctggcggagcg

SEQ ID NO: 38878 - DNA, 20 bp, Homo sapiens
ccacggccctggcggagcgc

SEQ ID NO: 38879 - DNA, 17 bp, Homo sapiens
cacggccctggcggagc

SEQ ID NO: 38880 - DNA, 18 bp, Homo sapiens
cacggccctggcggagcg

SEQ ID NO: 38881 - DNA, 19 bp, Homo sapiens
cacggccctggcggagcgc

SEQ ID NO: 38882 - DNA, 22 bp, Homo sapiens
cacggccctggcggagcgctga

SEQ ID NO: 38883 - DNA, 24 bp, Homo sapiens
cacggccctggcggagcgctgaga

SEQ ID NO: 38884 - DNA, 30 bp, Homo sapiens
cacggccctggcggagcgctgagaagacgg

SEQ ID NO: 38885 - DNA, 16 bp, Homo sapiens
acggccctggcggagc

SEQ ID NO: 38886 - DNA, 17 bp, Homo sapiens
acggccctggcggagcg

SEQ ID NO: 38887 - DNA, 18 bp, Homo sapiens
acggccctggcggagcgc

SEQ ID NO: 38888 - DNA, 19 bp, Homo sapiens
acggccctggcggagcgct

SEQ ID NO: 38889 - DNA, 20 bp, Homo sapiens
acggccctggcggagcgctg

SEQ ID NO: 38890 - DNA, 21 bp, Homo sapiens
acggccctggcggagcgctga

SEQ ID NO: 38891 - DNA, 22 bp, Homo sapiens
acggccctggcggagcgctgag

SEQ ID NO: 38892 - DNA, 23 bp, Homo sapiens
acggccctggcggagcgctgaga

SEQ ID NO: 38893 - DNA, 24 bp, Homo sapiens
acggccctggcggagcgctgagaa

SEQ ID NO: 38894 - DNA, 25 bp, Homo sapiens
acggccctggcggagcgctgagaag

SEQ ID NO: 38895 - DNA, 26 bp, Homo sapiens
acggccctggcggagcgctgagaaga

SEQ ID NO: 38896 - DNA, 27 bp, Homo sapiens
acggccctggcggagcgctgagaagac

SEQ ID NO: 38897 - DNA, 28 bp, Homo sapiens
acggccctggcggagcgctgagaagacg

SEQ ID NO: 38898 - DNA, 29 bp, Homo sapiens
acggccctggcggagcgctgagaagacgg

SEQ ID NO: 38899 - DNA, 30 bp, Homo sapiens; identical to SEQ ID NO: 16971

SEQ ID NO: 38900 - DNA, 16 bp, Homo sapiens
cggccctggcggagcg

SEQ ID NO: 38901 - DNA, 17 bp, Homo sapiens
cggccctggcggagcgc

SEQ ID NO: 38902 - DNA, 18 bp, Homo sapiens
cggccctggcggagcgct

SEQ ID NO: 38903 - DNA, 20 bp, Homo sapiens
cggccctggcggagcgctga

SEQ ID NO: 38904 - DNA, 21 bp, Homo sapiens
cggccctggcggagcgctgag

SEQ ID NO: 38905 - DNA, 22 bp, Homo sapiens
cggccctggcggagcgctgaga

SEQ ID NO: 38906 - DNA, 23 bp, Homo sapiens
cggccctggcggagcgctgagaa

SEQ ID NO: 38907 - DNA, 24 bp, Homo sapiens
cggccctggcggagcgctgagaag

SEQ ID NO: 38908 - DNA, 25 bp, Homo sapiens
cggccctggcggagcgctgagaaga

SEQ ID NO: 38909 - DNA, 26 bp, Homo sapiens
cggccctggcggagcgctgagaagac

SEQ ID NO: 38910 - DNA, 27 bp, Homo sapiens
cggccctggcggagcgctgagaagacg

SEQ ID NO: 38911 - DNA, 30 bp, Homo sapiens; identical to SEQ ID NO: 16998

SEQ ID NO: 38912 - DNA, 16 bp, Homo sapiens
ggccctggcggagcgc

SEQ ID NO: 38913 - DNA, 17 bp, Homo sapiens
ggccctggcggagcgct

SEQ ID NO: 38914 - DNA, 20 bp, Homo sapiens
ggccctggcggagcgctgag

SEQ ID NO: 38915 - DNA, 21 bp, Homo sapiens
ggccctggcggagcgctgaga

SEQ ID NO: 38916 - DNA, 23 bp, Homo sapiens
ggccctggcggagcgctgagaag

SEQ ID NO: 38917 - DNA, 24 bp, Homo sapiens
ggccctggcggagcgctgagaaga

SEQ ID NO: 38918 - DNA, 25 bp, Homo sapiens
ggccctggcggagcgctgagaagac

SEQ ID NO: 38919 - DNA, 26 bp, Homo sapiens
ggccctggcggagcgctgagaagacg

SEQ ID NO: 38920 - DNA, 30 bp, Homo sapiens; identical to SEQ ID NO: 17011

SEQ ID NO: 38921 - DNA, 19 bp, Homo sapiens
gccctggcggagcgctgag

SEQ ID NO: 38922 - DNA, 20 bp, Homo sapiens
gccctggcggagcgctgaga

SEQ ID NO: 38923 - DNA, 25 bp, Homo sapiens
gccctggcggagcgctgagaagacg

SEQ ID NO: 38924 - DNA, 29 bp, Homo sapiens
gccctggcggagcgctgagaagacggtcg

SEQ ID NO: 38925 - DNA, 23 bp, Homo sapiens
cctggcggagcgctgagaagacg

SEQ ID NO: 38926 - DNA, 30 bp, Homo sapiens; identical to SEQ ID NO: 17026

SEQ ID NO: 38927 - DNA, 16 bp, Homo sapiens
ctggcggagcgctgag

SEQ ID NO: 38928 - DNA, 17 bp, Homo sapiens
ctggcggagcgctgaga

SEQ ID NO: 38929 - DNA, 19 bp, Homo sapiens
ctggcggagcgctgagaag

SEQ ID NO: 38930 - DNA, 20 bp, Homo sapiens
ctggcggagcgctgagaaga

SEQ ID NO: 38931 - DNA, 21 bp, Homo sapiens
ctggcggagcgctgagaagac

SEQ ID NO: 38932 - DNA, 22 bp, Homo sapiens
ctggcggagcgctgagaagacg

SEQ ID NO: 38933 - DNA, 23 bp, Homo sapiens
ctggcggagcgctgagaagacgg

SEQ ID NO: 38934 - DNA, 24 bp, Homo sapiens
ctggcggagcgctgagaagacggt

SEQ ID NO: 38935 - DNA, 25 bp, Homo sapiens
ctggcggagcgctgagaagacggtc

SEQ ID NO: 38936 - DNA, 26 bp, Homo sapiens
ctggcggagcgctgagaagacggtcg

SEQ ID NO: 38937 - DNA, 27 bp, Homo sapiens
ctggcggagcgctgagaagacggtcga

SEQ ID NO: 38938 - DNA, 28 bp, Homo sapiens
ctggcggagcgctgagaagacggtcgaa

SEQ ID NO: 38939 - DNA, 29 bp, Homo sapiens
ctggcggagcgctgagaagacggtcgaac

SEQ ID NO: 38940 - DNA, 30 bp, Homo sapiens; identical to SEQ ID NO: 29160

SEQ ID NO: 38941 - DNA, 21 bp, Homo sapiens
tggcggagcgctgagaagacg

SEQ ID NO: 38942 - DNA, 22 bp, Homo sapiens
tggcggagcgctgagaagacgg

SEQ ID NO: 38943 - DNA, 20 bp, Homo sapiens
ggcggagcgctgagaagacg

SEQ ID NO: 38944 - DNA, 30 bp, Homo sapiens
ggcggagcgctgagaagacggtcgaacttg

SEQ ID NO: 38945 - DNA, 19 bp, Homo sapiens
gcggagcgctgagaagacg

SEQ ID NO: 38946 - DNA, 22 bp, Homo sapiens
gcggagcgctgagaagacggtc

SEQ ID NO: 38947 - DNA, 16 bp, Homo sapiens
ggagcgctgagaagac

SEQ ID NO: 38948 - DNA, 17 bp, Homo sapiens
ggagcgctgagaagacg

SEQ ID NO: 38949 - DNA, 18 bp, Homo sapiens
ggagcgctgagaagacgg

SEQ ID NO: 38950 - DNA, 19 bp, Homo sapiens
ggagcgctgagaagacggt

SEQ ID NO: 38951 - DNA, 20 bp, Homo sapiens
ggagcgctgagaagacggtc

SEQ ID NO: 38952 - DNA, 21 bp, Homo sapiens
ggagcgctgagaagacggtcg

SEQ ID NO: 38953 - DNA, 22 bp, Homo sapiens
ggagcgctgagaagacggtcga

SEQ ID NO: 38954 - DNA, 23 bp, Homo sapiens
ggagcgctgagaagacggtcgaa

SEQ ID NO: 38955 - DNA, 24 bp, Homo sapiens
ggagcgctgagaagacggtcgaac

SEQ ID NO: 38956 - DNA, 25 bp, Homo sapiens
ggagcgctgagaagacggtcgaact

SEQ ID NO: 38957 - DNA, 29 bp, Homo sapiens
ggagcgctgagaagacggtcgaacttgac

SEQ ID NO: 38958 - DNA, 30 bp, Homo sapiens
ggagcgctgagaagacggtcgaacttgact

SEQ ID NO: 38959 - DNA, 19 bp, Homo sapiens
gagcgctgagaagacggtc

SEQ ID NO: 38960 - DNA, 21 bp, Homo sapiens
gagcgctgagaagacggtcga

SEQ ID NO: 38961 - DNA, 23 bp, Homo sapiens
gagcgctgagaagacggtcgaac

SEQ ID NO: 38962 - DNA, 28 bp, Homo sapiens
gagcgctgagaagacggtcgaacttgac

SEQ ID NO: 38963 - DNA, 29 bp, Homo sapiens
gagcgctgagaagacggtcgaacttgact

SEQ ID NO: 38964 - DNA, 18 bp, Homo sapiens
agcgctgagaagacggtc

SEQ ID NO: 38965 - DNA, 20 bp, Homo sapiens
agcgctgagaagacggtcga

SEQ ID NO: 38966 - DNA, 23 bp, Homo sapiens
agcgctgagaagacggtcgaact

SEQ ID NO: 38967 - DNA, 25 bp, Homo sapiens
agcgctgagaagacggtcgaacttg

SEQ ID NO: 38968 - DNA, 26 bp, Homo sapiens
agcgctgagaagacggtcgaacttga

SEQ ID NO: 38969 - DNA, 28 bp, Homo sapiens
agcgctgagaagacggtcgaacttgact

SEQ ID NO: 38970 - DNA, 21 bp, Homo sapiens
gcgctgagaagacggtcgaac

SEQ ID NO: 38971 - DNA, 22 bp, Homo sapiens
gcgctgagaagacggtcgaact

SEQ ID NO: 38972 - DNA, 24 bp, Homo sapiens
gcgctgagaagacggtcgaacttg

SEQ ID NO: 38973 - DNA, 25 bp, Homo sapiens
gcgctgagaagacggtcgaacttga

SEQ ID NO: 38974 - DNA, 26 bp, Homo sapiens
gcgctgagaagacggtcgaacttgac

SEQ ID NO: 38975 - DNA, 27 bp, Homo sapiens
gcgctgagaagacggtcgaacttgact

SEQ ID NO: 38976 - DNA, 21 bp, Homo sapiens
cgctgagaagacggtcgaact

SEQ ID NO: 38977 - DNA, 23 bp, Homo sapiens
cgctgagaagacggtcgaacttg

SEQ ID NO: 38978 - DNA, 26 bp, Homo sapiens
cgctgagaagacggtcgaacttgact

SEQ ID NO: 38979 - DNA, 19 bp, Homo sapiens
gctgagaagacggtcgaac

SEQ ID NO: 38980 - DNA, 20 bp, Homo sapiens
gctgagaagacggtcgaact

SEQ ID NO: 38981 - DNA, 21 bp, Homo sapiens
gctgagaagacggtcgaactt

SEQ ID NO: 38982 - DNA, 22 bp, Homo sapiens
gctgagaagacggtcgaacttg

SEQ ID NO: 38983 - DNA, 23 bp, Homo sapiens
gctgagaagacggtcgaacttga

SEQ ID NO: 38984 - DNA, 24 bp, Homo sapiens
gctgagaagacggtcgaacttgac

SEQ ID NO: 38985 - DNA, 25 bp, Homo sapiens
gctgagaagacggtcgaacttgact

SEQ ID NO: 38986 - DNA, 29 bp, Homo sapiens
gctgagaagacggtcgaacttgactatct

SEQ ID NO: 38987 - DNA, 30 bp, Homo sapiens
gctgagaagacggtcgaacttgactatcta

SEQ ID NO: 38988 - DNA, 16 bp, Homo sapiens
ctgagaagacggtcga

SEQ ID NO: 38989 - DNA, 17 bp, Homo sapiens
ctgagaagacggtcgaa

SEQ ID NO: 38990 - DNA, 18 bp, Homo sapiens
ctgagaagacggtcgaac

SEQ ID NO: 38991 - DNA, 19 bp, Homo sapiens
ctgagaagacggtcgaact

SEQ ID NO: 38992 - DNA, 20 bp, Homo sapiens
ctgagaagacggtcgaactt

SEQ ID NO: 38993 - DNA, 21 bp, Homo sapiens
ctgagaagacggtcgaacttg

SEQ ID NO: 38994 - DNA, 22 bp, Homo sapiens
ctgagaagacggtcgaacttga

SEQ ID NO: 38995 - DNA, 23 bp, Homo sapiens
ctgagaagacggtcgaacttgac

SEQ ID NO: 38996 - DNA, 18 bp, Homo sapiens
tgagaagacggtcgaact

SEQ ID NO: 38997 - DNA, 20 bp, Homo sapiens
tgagaagacggtcgaacttg

SEQ ID NO: 38998 - DNA, 21 bp, Homo sapiens
tgagaagacggtcgaacttga

SEQ ID NO: 38999 - DNA, 22 bp, Homo sapiens
tgagaagacggtcgaacttgac

SEQ ID NO: 39000 - DNA, 16 bp, Homo sapiens
gagaagacggtcgaac

SEQ ID NO: 39001 - DNA, 17 bp, Homo sapiens
gagaagacggtcgaact

SEQ ID NO: 39002 - DNA, 19 bp, Homo sapiens
gagaagacggtcgaacttg

SEQ ID NO: 39003 - DNA, 20 bp, Homo sapiens
gagaagacggtcgaacttga

SEQ ID NO: 39004 - DNA, 22 bp, Homo sapiens
gagaagacggtcgaacttgact

SEQ ID NO: 39005 - DNA, 30 bp, Homo sapiens
gagaagacggtcgaacttgactatctagag

SEQ ID NO: 39006 - DNA, 16 bp, Homo sapiens
aagacggtcgaacttg

SEQ ID NO: 39007 - DNA, 17 bp, Homo sapiens
aagacggtcgaacttga

SEQ ID NO: 39008 - DNA, 19 bp, Homo sapiens
aagacggtcgaacttgact

SEQ ID NO: 39009 - DNA, 16 bp, Homo sapiens
agacggtcgaacttga

SEQ ID NO: 39010 - DNA, 17 bp, Homo sapiens
agacggtcgaacttgac

SEQ ID NO: 39011 - DNA, 18 bp, Homo sapiens
agacggtcgaacttgact

SEQ ID NO: 39012 - DNA, 20 bp, Homo sapiens
agacggtcgaacttgactat

SEQ ID NO: 39013 - DNA, 21 bp, Homo sapiens
agacggtcgaacttgactatc

SEQ ID NO: 39014 - DNA, 22 bp, Homo sapiens
agacggtcgaacttgactatct

SEQ ID NO: 39015 - DNA, 17 bp, Homo sapiens
gacggtcgaacttgact

SEQ ID NO: 39016 - DNA, 21 bp, Homo sapiens
gacggtcgaacttgactatct

SEQ ID NO: 39017 - DNA, 23 bp, Homo sapiens
gacggtcgaacttgactatctag

SEQ ID NO: 39018 - DNA, 24 bp, Homo sapiens
gacggtcgaacttgactatctaga

SEQ ID NO: 39019 - DNA, 25 bp, Homo sapiens
gacggtcgaacttgactatctagag

SEQ ID NO: 39020 - DNA, 26 bp, Homo sapiens
gacggtcgaacttgactatctagagg

SEQ ID NO: 39021 - DNA, 27 bp, Homo sapiens
gacggtcgaacttgactatctagagga

SEQ ID NO: 39022 - DNA, 29 bp, Homo sapiens
gacggtcgaacttgactatctagaggaag

SEQ ID NO: 39023 - DNA, 30 bp, Homo sapiens; identical to SEQ ID NO: 17166

SEQ ID NO: 39024 - DNA, 16 bp, Homo sapiens
acggtcgaacttgact

SEQ ID NO: 39025 - DNA, 18 bp, Homo sapiens
acggtcgaacttgactat

SEQ ID NO: 39026 - DNA, 19 bp, Homo sapiens
acggtcgaacttgactatc

SEQ ID NO: 39027 - DNA, 20 bp, Homo sapiens
acggtcgaacttgactatct

SEQ ID NO: 39028 - DNA, 21 bp, Homo sapiens
acggtcgaacttgactatcta

SEQ ID NO: 39029 - DNA, 22 bp, Homo sapiens
acggtcgaacttgactatctag

SEQ ID NO: 39030 - DNA, 23 bp, Homo sapiens
acggtcgaacttgactatctaga

SEQ ID NO: 39031 - DNA, 24 bp, Homo sapiens
acggtcgaacttgactatctagag

SEQ ID NO: 39032 - DNA, 25 bp, Homo sapiens
acggtcgaacttgactatctagagg

SEQ ID NO: 39033 - DNA, 16 bp, Homo sapiens
cggtcgaacttgacta

SEQ ID NO: 39034 - DNA, 17 bp, Homo sapiens
cggtcgaacttgactat

SEQ ID NO: 39035 - DNA, 18 bp, Homo sapiens
cggtcgaacttgactatc

SEQ ID NO: 39036 - DNA, 19 bp, Homo sapiens
cggtcgaacttgactatct

SEQ ID NO: 39037 - DNA, 20 bp, Homo sapiens
cggtcgaacttgactatcta

SEQ ID NO: 39038 - DNA, 21 bp, Homo sapiens
cggtcgaacttgactatctag

SEQ ID NO: 39039 - DNA, 22 bp, Homo sapiens
cggtcgaacttgactatctaga

SEQ ID NO: 39040 - DNA, 23 bp, Homo sapiens
cggtcgaacttgactatctagag

SEQ ID NO: 39041 - DNA, 24 bp, Homo sapiens
cggtcgaacttgactatctagagg

SEQ ID NO: 39042 - DNA, 25 bp, Homo sapiens
cggtcgaacttgactatctagagga

SEQ ID NO: 39043 - DNA, 26 bp, Homo sapiens
cggtcgaacttgactatctagaggaa

SEQ ID NO: 39044 - DNA, 27 bp, Homo sapiens
cggtcgaacttgactatctagaggaag

SEQ ID NO: 39045 - DNA, 28 bp, Homo sapiens
cggtcgaacttgactatctagaggaagt

SEQ ID NO: 39046 - DNA, 29 bp, Homo sapiens
cggtcgaacttgactatctagaggaagta

SEQ ID NO: 39047 - DNA, 18 bp, Homo sapiens
ggtcgaacttgactatct

SEQ ID NO: 39048 - DNA, 20 bp, Homo sapiens
ggtcgaacttgactatctag

SEQ ID NO: 39049 - DNA, 21 bp, Homo sapiens
ggtcgaacttgactatctaga

SEQ ID NO: 39050 - DNA, 22 bp, Homo sapiens
ggtcgaacttgactatctagag

SEQ ID NO: 39051 - DNA, 23 bp, Homo sapiens
ggtcgaacttgactatctagagg

SEQ ID NO: 39052 - DNA, 24 bp, Homo sapiens
ggtcgaacttgactatctagagga

SEQ ID NO: 39053 - DNA, 26 bp, Homo sapiens
ggtcgaacttgactatctagaggaag

SEQ ID NO: 39054 - DNA, 27 bp, Homo sapiens
ggtcgaacttgactatctagaggaagt

SEQ ID NO: 39055 - DNA, 28 bp, Homo sapiens
ggtcgaacttgactatctagaggaagta

SEQ ID NO: 39056 - DNA, 29 bp, Homo sapiens
ggtcgaacttgactatctagaggaagtaa

SEQ ID NO: 39057 - DNA, 16 bp, Homo sapiens
gtcgaacttgactatc

SEQ ID NO: 39058 - DNA, 17 bp, Homo sapiens
gtcgaacttgactatct

SEQ ID NO: 39059 - DNA, 18 bp, Homo sapiens
gtcgaacttgactatcta

SEQ ID NO: 39060 - DNA, 19 bp, Homo sapiens
gtcgaacttgactatctag

SEQ ID NO: 39061 - DNA, 20 bp, Homo sapiens
gtcgaacttgactatctaga

SEQ ID NO: 39062 - DNA, 21 bp, Homo sapiens
gtcgaacttgactatctagag

SEQ ID NO: 39063 - DNA, 22 bp, Homo sapiens
gtcgaacttgactatctagagg

SEQ ID NO: 39064 - DNA, 23 bp, Homo sapiens
gtcgaacttgactatctagagga

SEQ ID NO: 39065 - DNA, 24 bp, Homo sapiens
gtcgaacttgactatctagaggaa

SEQ ID NO: 39066 - DNA, 25 bp, Homo sapiens
gtcgaacttgactatctagaggaag

SEQ ID NO: 39067 - DNA, 26 bp, Homo sapiens
gtcgaacttgactatctagaggaagt

SEQ ID NO: 39068 - DNA, 27 bp, Homo sapiens
gtcgaacttgactatctagaggaagta

SEQ ID NO: 39069 - DNA, 28 bp, Homo sapiens
gtcgaacttgactatctagaggaagtaa

SEQ ID NO: 39070 - DNA, 29 bp, Homo sapiens
gtcgaacttgactatctagaggaagtaaa

SEQ ID NO: 39071 - DNA, 30 bp, Homo sapiens
gtcgaacttgactatctagaggaagtaaaa

SEQ ID NO: 39072 - DNA, 16 bp, Homo sapiens
tcgaacttgactatct

SEQ ID NO: 39073 - DNA, 17 bp, Homo sapiens
tcgaacttgactatcta

SEQ ID NO: 39074 - DNA, 18 bp, Homo sapiens
tcgaacttgactatctag

SEQ ID NO: 39075 - DNA, 19 bp, Homo sapiens
tcgaacttgactatctaga

SEQ ID NO: 39076 - DNA, 20 bp, Homo sapiens
tcgaacttgactatctagag

SEQ ID NO: 39077 - DNA, 21 bp, Homo sapiens
tcgaacttgactatctagagg

SEQ ID NO: 39078 - DNA, 22 bp, Homo sapiens
tcgaacttgactatctagagga

SEQ ID NO: 39079 - DNA, 23 bp, Homo sapiens
tcgaacttgactatctagaggaa

SEQ ID NO: 39080 - DNA, 24 bp, Homo sapiens
tcgaacttgactatctagaggaag

SEQ ID NO: 39081 - DNA, 25 bp, Homo sapiens
tcgaacttgactatctagaggaagt

SEQ ID NO: 39082 - DNA, 26 bp, Homo sapiens
tcgaacttgactatctagaggaagta

SEQ ID NO: 39083 - DNA, 28 bp, Homo sapiens
tcgaacttgactatctagaggaagtaaa

SEQ ID NO: 39084 - DNA, 30 bp, Homo sapiens
tcgaacttgactatctagaggaagtaaaag

SEQ ID NO: 39085 - DNA, 17 bp, Homo sapiens
cgaacttgactatctag

SEQ ID NO: 39086 - DNA, 18 bp, Homo sapiens
cgaacttgactatctaga

SEQ ID NO: 39087 - DNA, 19 bp, Homo sapiens
cgaacttgactatctagag

SEQ ID NO: 39088 - DNA, 20 bp, Homo sapiens
cgaacttgactatctagagg

SEQ ID NO: 39089 - DNA, 21 bp, Homo sapiens
cgaacttgactatctagagga

SEQ ID NO: 39090 - DNA, 22 bp, Homo sapiens
cgaacttgactatctagaggaa

SEQ ID NO: 39091 - DNA, 23 bp, Homo sapiens
cgaacttgactatctagaggaag

SEQ ID NO: 39092 - DNA, 24 bp, Homo sapiens
cgaacttgactatctagaggaagt

SEQ ID NO: 39093 - DNA, 25 bp, Homo sapiens
cgaacttgactatctagaggaagta

SEQ ID NO: 39094 - DNA, 26 bp, Homo sapiens
cgaacttgactatctagaggaagtaa

SEQ ID NO: 39095 - DNA, 27 bp, Homo sapiens
cgaacttgactatctagaggaagtaaa

SEQ ID NO: 39096 - DNA, 29 bp, Homo sapiens
cgaacttgactatctagaggaagtaaaag

SEQ ID NO: 39097 - DNA, 16 bp, Homo sapiens
gaacttgactatctag

SEQ ID NO: 39098 - DNA, 18 bp, Homo sapiens
gaacttgactatctagag

SEQ ID NO: 39099 - DNA, 19 bp, Homo sapiens
gaacttgactatctagagg

SEQ ID NO: 39100 - DNA, 20 bp, Homo sapiens
gaacttgactatctagagga

SEQ ID NO: 39101 - DNA, 21 bp, Homo sapiens
gaacttgactatctagaggaa

SEQ ID NO: 39102 - DNA, 22 bp, Homo sapiens
gaacttgactatctagaggaag

SEQ ID NO: 39103 - DNA, 23 bp, Homo sapiens
gaacttgactatctagaggaagt

SEQ ID NO: 39104 - DNA, 24 bp, Homo sapiens
gaacttgactatctagaggaagta

SEQ ID NO: 39105 - DNA, 25 bp, Homo sapiens
gaacttgactatctagaggaagtaa

SEQ ID NO: 39106 - DNA, 30 bp, Homo sapiens
gaacttgactatctagaggaagtaaaagtc

SEQ ID NO: 39107 - DNA, 16 bp, Homo sapiens
aacttgactatctaga

SEQ ID NO: 39108 - DNA, 17 bp, Homo sapiens
aacttgactatctagag

SEQ ID NO: 39109 - DNA, 18 bp, Homo sapiens
aacttgactatctagagg

SEQ ID NO: 39110 - DNA, 19 bp, Homo sapiens
aacttgactatctagagga

SEQ ID NO: 39111 - DNA, 20 bp, Homo sapiens
aacttgactatctagaggaa

SEQ ID NO: 39112 - DNA, 21 bp, Homo sapiens
aacttgactatctagaggaag

SEQ ID NO: 39113 - DNA, 22 bp, Homo sapiens
aacttgactatctagaggaagt

SEQ ID NO: 39114 - DNA, 23 bp, Homo sapiens
aacttgactatctagaggaagta

SEQ ID NO: 39115 - DNA, 24 bp, Homo sapiens
aacttgactatctagaggaagtaa

SEQ ID NO: 39116 - DNA, 25 bp, Homo sapiens
aacttgactatctagaggaagtaaa

SEQ ID NO: 39117 - DNA, 27 bp, Homo sapiens
aacttgactatctagaggaagtaaaag

SEQ ID NO: 39118 - DNA, 16 bp, Homo sapiens
acttgactatctagag

SEQ ID NO: 39119 - DNA, 17 bp, Homo sapiens
acttgactatctagagg

SEQ ID NO: 39120 - DNA, 18 bp, Homo sapiens
acttgactatctagagga

SEQ ID NO: 39121 - DNA, 19 bp, Homo sapiens
acttgactatctagaggaa

SEQ ID NO: 39122 - DNA, 20 bp, Homo sapiens
acttgactatctagaggaag

SEQ ID NO: 39123 - DNA, 21 bp, Homo sapiens
acttgactatctagaggaagt

SEQ ID NO: 39124 - DNA, 19 bp, Homo sapiens
cttgactatctagaggaag

SEQ ID NO: 39125 - DNA, 20 bp, Homo sapiens
cttgactatctagaggaagt

SEQ ID NO: 39126 - DNA, 21 bp, Homo sapiens
cttgactatctagaggaagta

SEQ ID NO: 39127 - DNA, 18 bp, Homo sapiens
tctagaggaagtaaaagt

SEQ ID NO: 39128 - DNA, 19 bp, Homo sapiens
tctagaggaagtaaaagtc

SEQ ID NO: 39129 - DNA, 17 bp, Homo sapiens
ctagaggaagtaaaagt

SEQ ID NO: 39130 - DNA, 18 bp, Homo sapiens
ctagaggaagtaaaagtc

SEQ ID NO: 39131 - DNA, 30 bp, Homo sapiens
ctagaggaagtaaaagtcgtaacaaggttt

SEQ ID NO: 39132 - DNA, 20 bp, Homo sapiens
gaggaagtaaaagtcgtaac

SEQ ID NO: 39133 - DNA, 30 bp, Homo sapiens
gaggaagtaaaagtcgtaacaaggtttccg

SEQ ID NO: 39134 - DNA, 21 bp, Homo sapiens
gaagtaaaagtcgtaacaagg

SEQ ID NO: 39135 - DNA, 30 bp, Homo sapiens
gaagtaaaagtcgtaacaaggtttccgtag

SEQ ID NO: 39136 - DNA, 19 bp, Homo sapiens
aagtaaaagtcgtaacaag

SEQ ID NO: 39137 - DNA, 20 bp, Homo sapiens
aagtaaaagtcgtaacaagg

SEQ ID NO: 39138 - DNA, 29 bp, Homo sapiens
aagtaaaagtcgtaacaaggtttccgtag

SEQ ID NO: 39139 - DNA, 30 bp, Homo sapiens
aagtaaaagtcgtaacaaggtttccgtagg

SEQ ID NO: 39140 - DNA, 19 bp, Homo sapiens
agtaaaagtcgtaacaagg

SEQ ID NO: 39141 - DNA, 28 bp, Homo sapiens
agtaaaagtcgtaacaaggtttccgtag

SEQ ID NO: 39142 - DNA, 29 bp, Homo sapiens
agtaaaagtcgtaacaaggtttccgtagg

SEQ ID NO: 39143 - DNA, 18 bp, Homo sapiens
gtaaaagtcgtaacaagg

SEQ ID NO: 39144 - DNA, 27 bp, Homo sapiens
gtaaaagtcgtaacaaggtttccgtag

SEQ ID NO: 39145 - DNA, 28 bp, Homo sapiens
gtaaaagtcgtaacaaggtttccgtagg

SEQ ID NO: 39146 - DNA, 30 bp, Homo sapiens
gtaaaagtcgtaacaaggtttccgtaggtg

SEQ ID NO: 39147 - DNA, 17 bp, Homo sapiens
taaaagtcgtaacaagg

SEQ ID NO: 39148 - DNA, 26 bp, Homo sapiens
taaaagtcgtaacaaggtttccgtag

SEQ ID NO: 39149 - DNA, 27 bp, Homo sapiens
taaaagtcgtaacaaggtttccgtagg

SEQ ID NO: 39150 - DNA, 16 bp, Homo sapiens
aaaagtcgtaacaagg

SEQ ID NO: 39151 - DNA, 25 bp, Homo sapiens
aaaagtcgtaacaaggtttccgtag

SEQ ID NO: 39152 - DNA, 26 bp, Homo sapiens
aaaagtcgtaacaaggtttccgtagg

SEQ ID NO: 39153 - DNA, 24 bp, Homo sapiens
aaagtcgtaacaaggtttccgtag

SEQ ID NO: 39154 - DNA, 25 bp, Homo sapiens
aaagtcgtaacaaggtttccgtagg

SEQ ID NO: 39155 - DNA, 23 bp, Homo sapiens
aagtcgtaacaaggtttccgtag

SEQ ID NO: 39156 - DNA, 24 bp, Homo sapiens
aagtcgtaacaaggtttccgtagg

SEQ ID NO: 39157 - DNA, 22 bp, Homo sapiens
agtcgtaacaaggtttccgtag

SEQ ID NO: 39158 - DNA, 23 bp, Homo sapiens
agtcgtaacaaggtttccgtagg

SEQ ID NO: 39159 - DNA, 20 bp, Homo sapiens
gtcgtaacaaggtttccgta

SEQ ID NO: 39160 - DNA, 21 bp, Homo sapiens
gtcgtaacaaggtttccgtag

SEQ ID NO: 39161 - DNA, 22 bp, Homo sapiens
gtcgtaacaaggtttccgtagg

SEQ ID NO: 39162 - DNA, 23 bp, Homo sapiens
gtcgtaacaaggtttccgtaggt

SEQ ID NO: 39163 - DNA, 30 bp, Homo sapiens
gtcgtaacaaggtttccgtaggtgaacctg

SEQ ID NO: 39164 - DNA, 18 bp, Homo sapiens
tcgtaacaaggtttccgt

SEQ ID NO: 39165 - DNA, 19 bp, Homo sapiens
tcgtaacaaggtttccgta

SEQ ID NO: 39166 - DNA, 20 bp, Homo sapiens
tcgtaacaaggtttccgtag

SEQ ID NO: 39167 - DNA, 21 bp, Homo sapiens
tcgtaacaaggtttccgtagg

SEQ ID NO: 39168 - DNA, 22 bp, Homo sapiens
tcgtaacaaggtttccgtaggt

SEQ ID NO: 39169 - DNA, 19 bp, Homo sapiens
cgtaacaaggtttccgtag

SEQ ID NO: 39170 - DNA, 20 bp, Homo sapiens
cgtaacaaggtttccgtagg

SEQ ID NO: 39171 - DNA, 21 bp, Homo sapiens
cgtaacaaggtttccgtaggt

SEQ ID NO: 39172 - DNA, 30 bp, Homo sapiens
cgtaacaaggtttccgtaggtgaacctgcg

SEQ ID NO: 39173 - DNA, 18 bp, Homo sapiens
gtaacaaggtttccgtag

SEQ ID NO: 39174 - DNA, 19 bp, Homo sapiens
gtaacaaggtttccgtagg

SEQ ID NO: 39175 - DNA, 29 bp, Homo sapiens
gtaacaaggtttccgtaggtgaacctgcg

SEQ ID NO: 39176 - DNA, 30 bp, Homo sapiens; identical to SEQ ID NO: 29186

SEQ ID NO: 39177 - DNA, 17 bp, Homo sapiens
taacaaggtttccgtag

SEQ ID NO: 39178 - DNA, 18 bp, Homo sapiens
taacaaggtttccgtagg

SEQ ID NO: 39179 - DNA, 20 bp, Homo sapiens
taacaaggtttccgtaggtg

SEQ ID NO: 39180 - DNA, 16 bp, Homo sapiens
aacaaggtttccgtag

SEQ ID NO: 39181 - DNA, 17 bp, Homo sapiens
aacaaggtttccgtagg

SEQ ID NO: 39182 - DNA, 18 bp, Homo sapiens
aacaaggtttccgtaggt

SEQ ID NO: 39183 - DNA, 19 bp, Homo sapiens
aacaaggtttccgtaggtg

SEQ ID NO: 39184 - DNA, 18 bp, Homo sapiens
acaaggtttccgtaggtg

SEQ ID NO: 39185 - DNA, 24 bp, Homo sapiens
aaggtttccgtaggtgaacctgcg

SEQ ID NO: 39186 - DNA, 18 bp, Homo sapiens
aggtttccgtaggtgaac

SEQ ID NO: 39187 - DNA, 23 bp, Homo sapiens
gtttccgtaggtgaacctgcgga

SEQ ID NO: 39188 - DNA, 29 bp, Homo sapiens
gtttccgtaggtgaacctgcggaaggatc

SEQ ID NO: 39189 - DNA, 28 bp, Homo sapiens
tttccgtaggtgaacctgcggaaggatc

SEQ ID NO: 39190 - DNA, 29 bp, Homo sapiens
tccgtaggtgaacctgcggaaggatcatt

SEQ ID NO: 39191 - DNA, 28 bp, Homo sapiens
ccgtaggtgaacctgcggaaggatcatt

SEQ ID NO: 39192 - DNA, 29 bp, Homo sapiens
ccgtaggtgaacctgcggaaggatcatta

SEQ ID NO: 39193 - DNA, 28 bp, Homo sapiens
cgtaggtgaacctgcggaaggatcatta

SEQ ID NO: 39194 - DNA, 19 bp, Homo sapiens
gtaggtgaacctgcggaag

SEQ ID NO: 39195 - DNA, 20 bp, Homo sapiens
gtaggtgaacctgcggaagg

SEQ ID NO: 39196 - DNA, 21 bp, Homo sapiens
gtaggtgaacctgcggaagga

SEQ ID NO: 39197 - DNA, 22 bp, Homo sapiens
gtaggtgaacctgcggaaggat

SEQ ID NO: 39198 - DNA, 23 bp, Homo sapiens
gtaggtgaacctgcggaaggatc

SEQ ID NO: 39199 - DNA, 24 bp, Homo sapiens
gtaggtgaacctgcggaaggatca

SEQ ID NO: 39200 - DNA, 26 bp, Homo sapiens
gtaggtgaacctgcggaaggatcatt

SEQ ID NO: 39201 - DNA, 27 bp, Homo sapiens
gtaggtgaacctgcggaaggatcatta

SEQ ID NO: 39202 - DNA, 26 bp, Homo sapiens
taggtgaacctgcggaaggatcatta

SEQ ID NO: 39203 - DNA, 25 bp, Homo sapiens
aggtgaacctgcggaaggatcatta

SEQ ID NO: 39204 - DNA, 19 bp, Homo sapiens
ggtgaacctgcggaaggat

SEQ ID NO: 39205 - DNA, 21 bp, Homo sapiens
ggtgaacctgcggaaggatca

SEQ ID NO: 39206 - DNA, 23 bp, Homo sapiens
ggtgaacctgcggaaggatcatt

SEQ ID NO: 39207 - DNA, 24 bp, Homo sapiens
ggtgaacctgcggaaggatcatta

SEQ ID NO: 39208 - DNA, 18 bp, Homo sapiens
gtgaacctgcggaaggat

SEQ ID NO: 39209 - DNA, 20 bp, Homo sapiens
gtgaacctgcggaaggatca

SEQ ID NO: 39210 - DNA, 22 bp, Homo sapiens
gtgaacctgcggaaggatcatt

SEQ ID NO: 39211 - DNA, 23 bp, Homo sapiens
gtgaacctgcggaaggatcatta

SEQ ID NO: 39212 - DNA, 21 bp, Homo sapiens
tgaacctgcggaaggatcatt

SEQ ID NO: 39213 - DNA, 22 bp, Homo sapiens
tgaacctgcggaaggatcatta

SEQ ID NO: 39214 - DNA, 21 bp, Homo sapiens
gaacctgcggaaggatcatta

SEQ ID NO: 39215 - DNA, 19 bp, Homo sapiens
acctgcggaaggatcatta

SEQ ID NO: 39216 - DNA, 18 bp, Homo sapiens
cctgcggaaggatcatta

SEQ ID NO: 39217 - DNA, 20 bp, Homo sapiens
cctgcggaaggatcattaac

SEQ ID NO: 39218 - DNA, 17 bp, Homo sapiens
ctgcggaaggatcatta

SEQ ID NO: 39219 - DNA, 19 bp, Homo sapiens
ctgcggaaggatcattaac

SEQ ID NO: 39220 - DNA, 16 bp, Homo sapiens
tgcggaaggatcatta

SEQ ID NO: 39221 - DNA, 17 bp, Homo sapiens
gcggaaggatcattaac

SEQ ID NO: 39222 - DNA, 20 bp, Homo sapiens
gcggaaggatcattaacgga

SEQ ID NO: 39223 - DNA, 21 bp, Homo sapiens
gcggaaggatcattaacggag

SEQ ID NO: 39224 - DNA, 22 bp, Homo sapiens
gcggaaggatcattaacggagc

SEQ ID NO: 39225 - DNA, 23 bp, Homo sapiens
gcggaaggatcattaacggagcc

SEQ ID NO: 39226 - DNA, 20 bp, Homo sapiens
cggaaggatcattaacggag

SEQ ID NO: 39227 - DNA, 21 bp, Homo sapiens
cggaaggatcattaacggagc

SEQ ID NO: 39228 - DNA, 22 bp, Homo sapiens
cggaaggatcattaacggagcc

SEQ ID NO: 39229 - DNA, 20 bp, Homo sapiens
ggaaggatcattaacggagc

SEQ ID NO: 39230 - DNA, 18 bp, Homo sapiens
gaaggatcattaacggag

SEQ ID NO: 39231 - DNA, 19 bp, Homo sapiens
gaaggatcattaacggagc

SEQ ID NO: 39232 - DNA, 20 bp, Homo sapiens
gaaggatcattaacggagcc

SEQ ID NO: 39233 - DNA, 17 bp, Homo sapiens
aaggatcattaacggag

SEQ ID NO: 39234 - DNA, 18 bp, Homo sapiens
aaggatcattaacggagc

SEQ ID NO: 39235 - DNA, 19 bp, Homo sapiens
aaggatcattaacggagcc

SEQ ID NO: 39236 - DNA, 17 bp, Homo sapiens
aggatcattaacggagc

SEQ ID NO: 39237 - DNA, 18 bp, Homo sapiens
aggatcattaacggagcc

SEQ ID NO: 39238 - DNA, 16 bp, Homo sapiens
ggatcattaacggagc

SEQ ID NO: 39239 - DNA, 17 bp, Homo sapiens
ggatcattaacggagcc

SEQ ID NO: 39240 - DNA, 16 bp, Homo sapiens
gatcattaacggagcc

SEQ ID NO: 39241 - DNA, 19 bp, Homo sapiens
gcccggagggcgaggcccg

SEQ ID NO: 39242 - DNA, 16 bp, Homo sapiens
gaggcccgcggcggcg

SEQ ID NO: 39243 - DNA, 17 bp, Homo sapiens
gaggcccgcggcggcgc

SEQ ID NO: 39244 - DNA, 19 bp, Homo sapiens
gcgcgcggcggcggcggcg

SEQ ID NO: 39245 - DNA, 18 bp, Homo sapiens
gcgcgcggcggcggcggc

SEQ ID NO: 39246 - DNA, 19 bp, Homo sapiens
agcgcgcggcggcggcggc

SEQ ID NO: 39247 - DNA, 24 bp, Homo sapiens
gctcgctcgttcgttcgccgcccg

SEQ ID NO: 39248 - DNA, 17 bp, Homo sapiens
ccggagaactcgggagg

SEQ ID NO: 39249 - DNA, 18 bp, Homo sapiens
gaactcgggagggagacg

SEQ ID NO: 39250 - DNA, 16 bp, Homo sapiens
ctctctctctcccccg

SEQ ID NO: 39251 - DNA, 17 bp, Homo sapiens
tctctctctctcccccg

SEQ ID NO: 39252 - DNA, 18 bp, Homo sapiens
ctctctctctctcccccg

SEQ ID NO: 39253 - DNA, 19 bp, Homo sapiens
tctctctctctctcccccg

SEQ ID NO: 39254 - DNA, 16 bp, Homo sapiens
tctctctctctccccc

SEQ ID NO: 39255 - DNA, 17 bp, Homo sapiens
ctctctctctctccccc

SEQ ID NO: 39256 - DNA, 19 bp, Homo sapiens
ctctctctctctctccccc

SEQ ID NO: 39257 - DNA, 21 bp, Homo sapiens
ctctctctctctctctccccc

SEQ ID NO: 39258 - DNA, 20 bp, Homo sapiens
aagggcgtgtcgttggtgtg

SEQ ID NO: 39259 - DNA, 19 bp, Homo sapiens
agggcgtgtcgttggtgtg

SEQ ID NO: 39260 - DNA, 18 bp, Homo sapiens
gggcgtgtcgttggtgtg

SEQ ID NO: 39261 - DNA, 20 bp, Homo sapiens
cgtgtcgttggtgtgcgcgt

SEQ ID NO: 39262 - DNA, 20 bp, Homo sapiens
tgggtgtcggcgggcgcggg

SEQ ID NO: 39263 - DNA, 21 bp, Homo sapiens
tgggtgtcggcgggcgcgggg

SEQ ID NO: 39264 - DNA, 24 bp, Homo sapiens
ggggcggttctcggcggcgtcgcg

SEQ ID NO: 39265 - DNA, 18 bp, Homo sapiens
gttctcggcggcgtcgcg

SEQ ID NO: 39266 - DNA, 21 bp, Homo sapiens
ctcggcggcgtcgcggcgggt

SEQ ID NO: 39267 - DNA, 20 bp, Homo sapiens
tcggcggcgtcgcggcgggt

SEQ ID NO: 39268 - DNA, 21 bp, Homo sapiens
tcggcggcgtcgcggcgggtc

SEQ ID NO: 39269 - DNA, 18 bp, Homo sapiens
cggcggcgtcgcggcggg

SEQ ID NO: 39270 - DNA, 19 bp, Homo sapiens
cggcggcgtcgcggcgggt

SEQ ID NO: 39271 - DNA, 20 bp, Homo sapiens
cggcggcgtcgcggcgggtc

SEQ ID NO: 39272 - DNA, 21 bp, Homo sapiens
cggcggcgtcgcggcgggtct

SEQ ID NO: 39273 - DNA, 22 bp, Homo sapiens
cggcggcgtcgcggcgggtctg

SEQ ID NO: 39274 - DNA, 25 bp, Homo sapiens
cggcggcgtcgcggcgggtctgggg

SEQ ID NO: 39275 - DNA, 17 bp, Homo sapiens
ggcggcgtcgcggcggg

SEQ ID NO: 39276 - DNA, 18 bp, Homo sapiens
ggcggcgtcgcggcgggt

SEQ ID NO: 39277 - DNA, 19 bp, Homo sapiens
ggcggcgtcgcggcgggtc

SEQ ID NO: 39278 - DNA, 21 bp, Homo sapiens
ggcggcgtcgcggcgggtctg

SEQ ID NO: 39279 - DNA, 20 bp, Homo sapiens
gcgtcgcggcgggtctgggg

SEQ ID NO: 39280 - DNA, 22 bp, Homo sapiens
ggtctcggtgccctcctccccg

SEQ ID NO: 39281 - DNA, 17 bp, Homo sapiens
ccccgccggggcccgtc

SEQ ID NO: 39282 - DNA, 18 bp, Homo sapiens
ccccgccggggcccgtcg

SEQ ID NO: 39283 - DNA, 19 bp, Homo sapiens
ccccgccggggcccgtcgt

SEQ ID NO: 39284 - DNA, 21 bp, Homo sapiens
ccgcgccggctccccgtcttc

SEQ ID NO: 39285 - DNA, 22 bp, Homo sapiens
ccgcgccggctccccgtcttcg

SEQ ID NO: 39286 - DNA, 26 bp, Homo sapiens
ccgtccaggtacctagcgcgttccgg

SEQ ID NO: 39287 - DNA, 19 bp, Homo sapiens
cgtgggtcgggggcggtgg

SEQ ID NO: 39288 - DNA, 18 bp, Homo sapiens
gtgggtcgggggcggtgg

SEQ ID NO: 39289 - DNA, 19 bp, Homo sapiens
gtgggtcgggggcggtggt

SEQ ID NO: 39290 - DNA, 20 bp, Homo sapiens
gtgggtcgggggcggtggtg

SEQ ID NO: 39291 - DNA, 21 bp, Homo sapiens
gtgggtcgggggcggtggtgg

SEQ ID NO: 39292 - DNA, 22 bp, Homo sapiens
gtgggtcgggggcggtggtggg

SEQ ID NO: 39293 - DNA, 23 bp, Homo sapiens
gtgggtcgggggcggtggtgggc

SEQ ID NO: 39294 - DNA, 19 bp, Homo sapiens
tgggtcgggggcggtggtg

SEQ ID NO: 39295 - DNA, 20 bp, Homo sapiens
tgggtcgggggcggtggtgg

SEQ ID NO: 39296 - DNA, 21 bp, Homo sapiens
tgggtcgggggcggtggtggg

SEQ ID NO: 39297 - DNA, 22 bp, Homo sapiens
tgggtcgggggcggtggtgggc

SEQ ID NO: 39298 - DNA, 18 bp, Homo sapiens
ctccaccgcggactccgc

SEQ ID NO: 39299 - DNA, 17 bp, Homo sapiens
cggcggcggcggcggcg

SEQ ID NO: 39300 - DNA, 18 bp, Homo sapiens
gcggcggcggcggcggcg

SEQ ID NO: 39301 - DNA, 16 bp, Homo sapiens
cggcggcggcggcggc

SEQ ID NO: 39302 - DNA, 17 bp, Homo sapiens
gcggcggcggcggcggc

SEQ ID NO: 39303 - DNA, 18 bp, Homo sapiens
cgcggcggcggcggcggc

SEQ ID NO: 39304 - DNA, 16 bp, Homo sapiens
gcggcggcggcggcgg

SEQ ID NO: 39305 - DNA, 16 bp, Homo sapiens
cgcggcggccgtcggg

SEQ ID NO: 39306 - DNA, 21 bp, Homo sapiens
cgcggcggccgtcgggtgggg

SEQ ID NO: 39307 - DNA, 22 bp, Homo sapiens
cgcggcggccgtcgggtggggg

SEQ ID NO: 39308 - DNA, 23 bp, Homo sapiens
cgcggcggccgtcgggtgggggc

SEQ ID NO: 39309 - DNA, 24 bp, Homo sapiens
cgcggcggccgtcgggtgggggct

SEQ ID NO: 39310 - DNA, 20 bp, Homo sapiens
gcggcggccgtcgggtgggg

SEQ ID NO: 39311 - DNA, 21 bp, Homo sapiens
gcggcggccgtcgggtggggg

SEQ ID NO: 39312 - DNA, 22 bp, Homo sapiens
gcggcggccgtcgggtgggggc

SEQ ID NO: 39313 - DNA, 18 bp, Homo sapiens
gcggccgtcgggtggggg

SEQ ID NO: 39314 - DNA, 19 bp, Homo sapiens
gcggccgtcgggtgggggc

SEQ ID NO: 39315 - DNA, 18 bp, Homo sapiens
cggccgtcgggtgggggc

SEQ ID NO: 39316 - DNA, 17 bp, Homo sapiens
acccggcggccgtcgcg

SEQ ID NO: 39317 - DNA, 18 bp, Homo sapiens
acccggcggccgtcgcgc

SEQ ID NO: 39318 - DNA, 16 bp, Homo sapiens
cccggcggccgtcgcg

SEQ ID NO: 39319 - DNA, 17 bp, Homo sapiens
cccggcggccgtcgcgc

SEQ ID NO: 39320 - DNA, 20 bp, Homo sapiens
cttccgacccctctccggag

SEQ ID NO: 39321 - DNA, 17 bp, Homo sapiens
ctgtctcgtctggccgg

SEQ ID NO: 39322 - DNA, 18 bp, Homo sapiens
ctgtctcgtctggccggc

SEQ ID NO: 39323 - DNA, 19 bp, Homo sapiens
ctgtctcgtctggccggcc

SEQ ID NO: 39324 - DNA, 19 bp, Homo sapiens
tcgtctggccggcctgagg

SEQ ID NO: 39325 - DNA, 18 bp, Homo sapiens
cgtctggccggcctgagg

SEQ ID NO: 39326 - DNA, 30 bp, Homo sapiens; identical to SEQ ID NO: 29198

SEQ ID NO: 39327 - DNA, 30 bp, Homo sapiens
ggcctcctcccggtgcgtcgtcgggagcgc

SEQ ID NO: 39328 - DNA, 19 bp, Homo sapiens
cggtgcgtcgtcgggagcg

SEQ ID NO: 39329 - DNA, 17 bp, Homo sapiens
ggtgcgtcgtcgggagc

SEQ ID NO: 39330 - DNA, 18 bp, Homo sapiens
ggtgcgtcgtcgggagcg

SEQ ID NO: 39331 - DNA, 16 bp, Homo sapiens
gtgcgtcgtcgggagc

SEQ ID NO: 39332 - DNA, 17 bp, Homo sapiens
gtgcgtcgtcgggagcg

SEQ ID NO: 39333 - DNA, 19 bp, Homo sapiens
acctcgtacgactcttagc

SEQ ID NO: 39334 - DNA, 20 bp, Homo sapiens
acctcgtacgactcttagcg

SEQ ID NO: 39335 - DNA, 21 bp, Homo sapiens
acctcgtacgactcttagcgg

SEQ ID NO: 39336 - DNA, 22 bp, Homo sapiens
acctcgtacgactcttagcggt

SEQ ID NO: 39337 - DNA, 23 bp, Homo sapiens
acctcgtacgactcttagcggtg

SEQ ID NO: 39338 - DNA, 24 bp, Homo sapiens
acctcgtacgactcttagcggtgg

SEQ ID NO: 39339 - DNA, 16 bp, Homo sapiens
cctcgtacgactctta

SEQ ID NO: 39340 - DNA, 17 bp, Homo sapiens
cctcgtacgactcttag

SEQ ID NO: 39341 - DNA, 18 bp, Homo sapiens
cctcgtacgactcttagc

SEQ ID NO: 39342 - DNA, 19 bp, Homo sapiens
cctcgtacgactcttagcg

SEQ ID NO: 39343 - DNA, 20 bp, Homo sapiens
cctcgtacgactcttagcgg

SEQ ID NO: 39344 - DNA, 21 bp, Homo sapiens
cctcgtacgactcttagcggt

SEQ ID NO: 39345 - DNA, 22 bp, Homo sapiens
cctcgtacgactcttagcggtg

SEQ ID NO: 39346 - DNA, 23 bp, Homo sapiens
cctcgtacgactcttagcggtgg

SEQ ID NO: 39347 - DNA, 24 bp, Homo sapiens
cctcgtacgactcttagcggtgga

SEQ ID NO: 39348 - DNA, 25 bp, Homo sapiens
cctcgtacgactcttagcggtggat

SEQ ID NO: 39349 - DNA, 26 bp, Homo sapiens
cctcgtacgactcttagcggtggatc

SEQ ID NO: 39350 - DNA, 30 bp, Homo sapiens; identical to SEQ ID NO: 29205

SEQ ID NO: 39351 - DNA, 16 bp, Homo sapiens
ctcgtacgactcttag

SEQ ID NO: 39352 - DNA, 17 bp, Homo sapiens
ctcgtacgactcttagc

SEQ ID NO: 39353 - DNA, 18 bp, Homo sapiens
ctcgtacgactcttagcg

SEQ ID NO: 39354 - DNA, 19 bp, Homo sapiens
ctcgtacgactcttagcgg

SEQ ID NO: 39355 - DNA, 20 bp, Homo sapiens
ctcgtacgactcttagcggt

SEQ ID NO: 39356 - DNA, 21 bp, Homo sapiens
ctcgtacgactcttagcggtg

SEQ ID NO: 39357 - DNA, 22 bp, Homo sapiens
ctcgtacgactcttagcggtgg

SEQ ID NO: 39358 - DNA, 23 bp, Homo sapiens
ctcgtacgactcttagcggtgga

SEQ ID NO: 39359 - DNA, 24 bp, Homo sapiens
ctcgtacgactcttagcggtggat

SEQ ID NO: 39360 - DNA, 25 bp, Homo sapiens
ctcgtacgactcttagcggtggatc

SEQ ID NO: 39361 - DNA, 26 bp, Homo sapiens
ctcgtacgactcttagcggtggatca

SEQ ID NO: 39362 - DNA, 27 bp, Homo sapiens
ctcgtacgactcttagcggtggatcac

SEQ ID NO: 39363 - DNA, 28 bp, Homo sapiens
ctcgtacgactcttagcggtggatcact

SEQ ID NO: 39364 - DNA, 29 bp, Homo sapiens
ctcgtacgactcttagcggtggatcactc

SEQ ID NO: 39365 - DNA, 30 bp, Homo sapiens; identical to SEQ ID NO: 29220

SEQ ID NO: 39366 - DNA, 16 bp, Homo sapiens
tcgtacgactcttagc

SEQ ID NO: 39367 - DNA, 17 bp, Homo sapiens
tcgtacgactcttagcg

SEQ ID NO: 39368 - DNA, 18 bp, Homo sapiens
tcgtacgactcttagcgg

SEQ ID NO: 39369 - DNA, 19 bp, Homo sapiens
tcgtacgactcttagcggt

SEQ ID NO: 39370 - DNA, 20 bp, Homo sapiens
tcgtacgactcttagcggtg

SEQ ID NO: 39371 - DNA, 21 bp, Homo sapiens
tcgtacgactcttagcggtgg

SEQ ID NO: 39372 - DNA, 22 bp, Homo sapiens
tcgtacgactcttagcggtgga

SEQ ID NO: 39373 - DNA, 23 bp, Homo sapiens
tcgtacgactcttagcggtggat

SEQ ID NO: 39374 - DNA, 24 bp, Homo sapiens
tcgtacgactcttagcggtggatc

SEQ ID NO: 39375 - DNA, 25 bp, Homo sapiens
tcgtacgactcttagcggtggatca

SEQ ID NO: 39376 - DNA, 26 bp, Homo sapiens
tcgtacgactcttagcggtggatcac

SEQ ID NO: 39377 - DNA, 27 bp, Homo sapiens
tcgtacgactcttagcggtggatcact

SEQ ID NO: 39378 - DNA, 28 bp, Homo sapiens
tcgtacgactcttagcggtggatcactc

SEQ ID NO: 39379 - DNA, 29 bp, Homo sapiens
tcgtacgactcttagcggtggatcactcg

SEQ ID NO: 39380 - DNA, 30 bp, Homo sapiens; identical to SEQ ID NO: 17328

SEQ ID NO: 39381 - DNA, 16 bp, Homo sapiens
cgtacgactcttagcg

SEQ ID NO: 39382 - DNA, 17 bp, Homo sapiens
cgtacgactcttagcgg

SEQ ID NO: 39383 - DNA, 18 bp, Homo sapiens
cgtacgactcttagcggt

SEQ ID NO: 39384 - DNA, 19 bp, Homo sapiens
cgtacgactcttagcggtg

SEQ ID NO: 39385 - DNA, 20 bp, Homo sapiens
cgtacgactcttagcggtgg

SEQ ID NO: 39386 - DNA, 21 bp, Homo sapiens
cgtacgactcttagcggtgga

SEQ ID NO: 39387 - DNA, 22 bp, Homo sapiens
cgtacgactcttagcggtggat

SEQ ID NO: 39388 - DNA, 23 bp, Homo sapiens
cgtacgactcttagcggtggatc

SEQ ID NO: 39389 - DNA, 24 bp, Homo sapiens
cgtacgactcttagcggtggatca

SEQ ID NO: 39390 - DNA, 25 bp, Homo sapiens
cgtacgactcttagcggtggatcac

SEQ ID NO: 39391 - DNA, 26 bp, Homo sapiens
cgtacgactcttagcggtggatcact

SEQ ID NO: 39392 - DNA, 29 bp, Homo sapiens
cgtacgactcttagcggtggatcactcgg

SEQ ID NO: 39393 - DNA, 30 bp, Homo sapiens; identical to SEQ ID NO: 17342

SEQ ID NO: 39394 - DNA, 16 bp, Homo sapiens
gtacgactcttagcgg

SEQ ID NO: 39395 - DNA, 17 bp, Homo sapiens
gtacgactcttagcggt

SEQ ID NO: 39396 - DNA, 18 bp, Homo sapiens
gtacgactcttagcggtg

SEQ ID NO: 39397 - DNA, 19 bp, Homo sapiens
gtacgactcttagcggtgg

SEQ ID NO: 39398 - DNA, 20 bp, Homo sapiens
gtacgactcttagcggtgga

SEQ ID NO: 39399 - DNA, 21 bp, Homo sapiens
gtacgactcttagcggtggat

SEQ ID NO: 39400 - DNA, 22 bp, Homo sapiens
gtacgactcttagcggtggatc

SEQ ID NO: 39401 - DNA, 23 bp, Homo sapiens
gtacgactcttagcggtggatca

SEQ ID NO: 39402 - DNA, 24 bp, Homo sapiens
gtacgactcttagcggtggatcac

SEQ ID NO: 39403 - DNA, 25 bp, Homo sapiens
gtacgactcttagcggtggatcact

SEQ ID NO: 39404 - DNA, 27 bp, Homo sapiens
gtacgactcttagcggtggatcactcg

SEQ ID NO: 39405 - DNA, 28 bp, Homo sapiens
gtacgactcttagcggtggatcactcgg

SEQ ID NO: 39406 - DNA, 30 bp, Homo sapiens; identical to SEQ ID NO: 3563

SEQ ID NO: 39407 - DNA, 17 bp, Homo sapiens
tacgactcttagcggtg

SEQ ID NO: 39408 - DNA, 18 bp, Homo sapiens
tacgactcttagcggtgg

SEQ ID NO: 39409 - DNA, 19 bp, Homo sapiens
tacgactcttagcggtgga

SEQ ID NO: 39410 - DNA, 20 bp, Homo sapiens
tacgactcttagcggtggat

SEQ ID NO: 39411 - DNA, 21 bp, Homo sapiens
tacgactcttagcggtggatc

SEQ ID NO: 39412 - DNA, 24 bp, Homo sapiens
tacgactcttagcggtggatcact

SEQ ID NO: 39413 - DNA, 28 bp, Homo sapiens
tacgactcttagcggtggatcactcggc

SEQ ID NO: 39414 - DNA, 30 bp, Homo sapiens; identical to SEQ ID NO: 17364

SEQ ID NO: 39415 - DNA, 16 bp, Homo sapiens
acgactcttagcggtg

SEQ ID NO: 39416 - DNA, 17 bp, Homo sapiens
acgactcttagcggtgg

SEQ ID NO: 39417 - DNA, 18 bp, Homo sapiens
acgactcttagcggtgga

SEQ ID NO: 39418 - DNA, 19 bp, Homo sapiens
acgactcttagcggtggat

SEQ ID NO: 39419 - DNA, 20 bp, Homo sapiens
acgactcttagcggtggatc

SEQ ID NO: 39420 - DNA, 21 bp, Homo sapiens
acgactcttagcggtggatca

SEQ ID NO: 39421 - DNA, 22 bp, Homo sapiens
acgactcttagcggtggatcac

SEQ ID NO: 39422 - DNA, 23 bp, Homo sapiens
acgactcttagcggtggatcact

SEQ ID NO: 39423 - DNA, 26 bp, Homo sapiens
acgactcttagcggtggatcactcgg

SEQ ID NO: 39424 - DNA, 27 bp, Homo sapiens
acgactcttagcggtggatcactcggc

SEQ ID NO: 39425 - DNA, 30 bp, Homo sapiens; identical to SEQ ID NO: 17373

SEQ ID NO: 39426 - DNA, 16 bp, Homo sapiens
cgactcttagcggtgg

SEQ ID NO: 39427 - DNA, 17 bp, Homo sapiens
cgactcttagcggtgga

SEQ ID NO: 39428 - DNA, 18 bp, Homo sapiens
cgactcttagcggtggat

SEQ ID NO: 39429 - DNA, 19 bp, Homo sapiens
cgactcttagcggtggatc

SEQ ID NO: 39430 - DNA, 20 bp, Homo sapiens
cgactcttagcggtggatca

SEQ ID NO: 39431 - DNA, 21 bp, Homo sapiens
cgactcttagcggtggatcac

SEQ ID NO: 39432 - DNA, 22 bp, Homo sapiens
cgactcttagcggtggatcact

SEQ ID NO: 39433 - DNA, 23 bp, Homo sapiens
cgactcttagcggtggatcactc

SEQ ID NO: 39434 - DNA, 24 bp, Homo sapiens
cgactcttagcggtggatcactcg

SEQ ID NO: 39435 - DNA, 25 bp, Homo sapiens
cgactcttagcggtggatcactcgg

SEQ ID NO: 39436 - DNA, 26 bp, Homo sapiens
cgactcttagcggtggatcactcggc

SEQ ID NO: 39437 - DNA, 27 bp, Homo sapiens
cgactcttagcggtggatcactcggct

SEQ ID NO: 39438 - DNA, 28 bp, Homo sapiens
cgactcttagcggtggatcactcggctc

SEQ ID NO: 39439 - DNA, 29 bp, Homo sapiens
cgactcttagcggtggatcactcggctcg

SEQ ID NO: 39440 - DNA, 30 bp, Homo sapiens; identical to SEQ ID NO: 3579

SEQ ID NO: 39441 - DNA, 16 bp, Homo sapiens
gactcttagcggtgga

SEQ ID NO: 39442 - DNA, 17 bp, Homo sapiens
gactcttagcggtggat

SEQ ID NO: 39443 - DNA, 18 bp, Homo sapiens
gactcttagcggtggatc

SEQ ID NO: 39444 - DNA, 19 bp, Homo sapiens
gactcttagcggtggatca

SEQ ID NO: 39445 - DNA, 20 bp, Homo sapiens
gactcttagcggtggatcac

SEQ ID NO: 39446 - DNA, 21 bp, Homo sapiens
gactcttagcggtggatcact

SEQ ID NO: 39447 - DNA, 22 bp, Homo sapiens
gactcttagcggtggatcactc

SEQ ID NO: 39448 - DNA, 23 bp, Homo sapiens
gactcttagcggtggatcactcg

SEQ ID NO: 39449 - DNA, 24 bp, Homo sapiens
gactcttagcggtggatcactcgg

SEQ ID NO: 39450 - DNA, 25 bp, Homo sapiens
gactcttagcggtggatcactcggc

SEQ ID NO: 39451 - DNA, 26 bp, Homo sapiens
gactcttagcggtggatcactcggct

SEQ ID NO: 39452 - DNA, 27 bp, Homo sapiens
gactcttagcggtggatcactcggctc

SEQ ID NO: 39453 - DNA, 28 bp, Homo sapiens
gactcttagcggtggatcactcggctcg

SEQ ID NO: 39454 - DNA, 29 bp, Homo sapiens
gactcttagcggtggatcactcggctcgt

SEQ ID NO: 39455 - DNA, 30 bp, Homo sapiens; identical to SEQ ID NO: 3590

SEQ ID NO: 39456 - DNA, 16 bp, Homo sapiens
actcttagcggtggat

SEQ ID NO: 39457 - DNA, 17 bp, Homo sapiens
actcttagcggtggatc

SEQ ID NO: 39458 - DNA, 18 bp, Homo sapiens
actcttagcggtggatca

SEQ ID NO: 39459 - DNA, 19 bp, Homo sapiens
actcttagcggtggatcac

SEQ ID NO: 39460 - DNA, 20 bp, Homo sapiens
actcttagcggtggatcact

SEQ ID NO: 39461 - DNA, 21 bp, Homo sapiens
actcttagcggtggatcactc

SEQ ID NO: 39462 - DNA, 22 bp, Homo sapiens
actcttagcggtggatcactcg

SEQ ID NO: 39463 - DNA, 23 bp, Homo sapiens
actcttagcggtggatcactcgg

SEQ ID NO: 39464 - DNA, 24 bp, Homo sapiens
actcttagcggtggatcactcggc

SEQ ID NO: 39465 - DNA, 25 bp, Homo sapiens
actcttagcggtggatcactcggct

SEQ ID NO: 39466 - DNA, 27 bp, Homo sapiens
actcttagcggtggatcactcggctcg

SEQ ID NO: 39467 - DNA, 28 bp, Homo sapiens
actcttagcggtggatcactcggctcgt

SEQ ID NO: 39468 - DNA, 29 bp, Homo sapiens
actcttagcggtggatcactcggctcgtg

SEQ ID NO: 39469 - DNA, 30 bp, Homo sapiens; identical to SEQ ID NO: 29288

SEQ ID NO: 39470 - DNA, 16 bp, Homo sapiens
ctcttagcggtggatc

SEQ ID NO: 39471 - DNA, 17 bp, Homo sapiens
ctcttagcggtggatca

SEQ ID NO: 39472 - DNA, 18 bp, Homo sapiens
ctcttagcggtggatcac

SEQ ID NO: 39473 - DNA, 19 bp, Homo sapiens
ctcttagcggtggatcact

SEQ ID NO: 39474 - DNA, 20 bp, Homo sapiens
ctcttagcggtggatcactc

SEQ ID NO: 39475 - DNA, 21 bp, Homo sapiens
ctcttagcggtggatcactcg

SEQ ID NO: 39476 - DNA, 22 bp, Homo sapiens
ctcttagcggtggatcactcgg

SEQ ID NO: 39477 - DNA, 23 bp, Homo sapiens
ctcttagcggtggatcactcggc

SEQ ID NO: 39478 - DNA, 24 bp, Homo sapiens
ctcttagcggtggatcactcggct

SEQ ID NO: 39479 - DNA, 26 bp, Homo sapiens
ctcttagcggtggatcactcggctcg

SEQ ID NO: 39480 - DNA, 27 bp, Homo sapiens
ctcttagcggtggatcactcggctcgt

SEQ ID NO: 39481 - DNA, 28 bp, Homo sapiens
ctcttagcggtggatcactcggctcgtg

SEQ ID NO: 39482 - DNA, 30 bp, Homo sapiens; identical to SEQ ID NO: 29290

SEQ ID NO: 39483 - DNA, 21 bp, Homo sapiens
tcttagcggtggatcactcgg

SEQ ID NO: 39484 - DNA, 29 bp, Homo sapiens
tcttagcggtggatcactcggctcgtgcg

SEQ ID NO: 39485 - DNA, 30 bp, Homo sapiens
tcttagcggtggatcactcggctcgtgcgt

SEQ ID NO: 39486 - DNA, 20 bp, Homo sapiens
cttagcggtggatcactcgg

SEQ ID NO: 39487 - DNA, 27 bp, Homo sapiens
cttagcggtggatcactcggctcgtgc

SEQ ID NO: 39488 - DNA, 28 bp, Homo sapiens
cttagcggtggatcactcggctcgtgcg

SEQ ID NO: 39489 - DNA, 19 bp, Homo sapiens
ttagcggtggatcactcgg

SEQ ID NO: 39490 - DNA, 26 bp, Homo sapiens
ttagcggtggatcactcggctcgtgc

SEQ ID NO: 39491 - DNA, 27 bp, Homo sapiens
ttagcggtggatcactcggctcgtgcg

SEQ ID NO: 39492 - DNA, 18 bp, Homo sapiens
tagcggtggatcactcgg

SEQ ID NO: 39493 - DNA, 24 bp, Homo sapiens
tagcggtggatcactcggctcgtg

SEQ ID NO: 39494 - DNA, 25 bp, Homo sapiens
tagcggtggatcactcggctcgtgc

SEQ ID NO: 39495 - DNA, 26 bp, Homo sapiens
tagcggtggatcactcggctcgtgcg

SEQ ID NO: 39496 - DNA, 17 bp, Homo sapiens
agcggtggatcactcgg

SEQ ID NO: 39497 - DNA, 21 bp, Homo sapiens
agcggtggatcactcggctcg

SEQ ID NO: 39498 - DNA, 22 bp, Homo sapiens
agcggtggatcactcggctcgt

SEQ ID NO: 39499 - DNA, 24 bp, Homo sapiens
agcggtggatcactcggctcgtgc

SEQ ID NO: 39500 - DNA, 25 bp, Homo sapiens
agcggtggatcactcggctcgtgcg

SEQ ID NO: 39501 - DNA, 16 bp, Homo sapiens
gcggtggatcactcgg

SEQ ID NO: 39502 - DNA, 17 bp, Homo sapiens
gcggtggatcactcggc

SEQ ID NO: 39503 - DNA, 20 bp, Homo sapiens
gcggtggatcactcggctcg

SEQ ID NO: 39504 - DNA, 21 bp, Homo sapiens
gcggtggatcactcggctcgt

SEQ ID NO: 39505 - DNA, 22 bp, Homo sapiens
gcggtggatcactcggctcgtg

SEQ ID NO: 39506 - DNA, 23 bp, Homo sapiens
gcggtggatcactcggctcgtgc

SEQ ID NO: 39507 - DNA, 24 bp, Homo sapiens
gcggtggatcactcggctcgtgcg

SEQ ID NO: 39508 - DNA, 25 bp, Homo sapiens
gcggtggatcactcggctcgtgcgt

SEQ ID NO: 39509 - DNA, 29 bp, Homo sapiens
gcggtggatcactcggctcgtgcgtcgat

SEQ ID NO: 39510 - DNA, 30 bp, Homo sapiens; identical to SEQ ID NO: 17451

SEQ ID NO: 39511 - DNA, 16 bp, Homo sapiens
cggtggatcactcggc

SEQ ID NO: 39512 - DNA, 17 bp, Homo sapiens
cggtggatcactcggct

SEQ ID NO: 39513 - DNA, 18 bp, Homo sapiens
cggtggatcactcggctc

SEQ ID NO: 39514 - DNA, 19 bp, Homo sapiens
cggtggatcactcggctcg

SEQ ID NO: 39515 - DNA, 20 bp, Homo sapiens
cggtggatcactcggctcgt

SEQ ID NO: 39516 - DNA, 21 bp, Homo sapiens
cggtggatcactcggctcgtg

SEQ ID NO: 39517 - DNA, 22 bp, Homo sapiens
cggtggatcactcggctcgtgc

SEQ ID NO: 39518 - DNA, 23 bp, Homo sapiens
cggtggatcactcggctcgtgcg

SEQ ID NO: 39519 - DNA, 24 bp, Homo sapiens
cggtggatcactcggctcgtgcgt

SEQ ID NO: 39520 - DNA, 25 bp, Homo sapiens
cggtggatcactcggctcgtgcgtc

SEQ ID NO: 39521 - DNA, 26 bp, Homo sapiens
cggtggatcactcggctcgtgcgtcg

SEQ ID NO: 39522 - DNA, 27 bp, Homo sapiens
cggtggatcactcggctcgtgcgtcga

SEQ ID NO: 39523 - DNA, 28 bp, Homo sapiens
cggtggatcactcggctcgtgcgtcgat

SEQ ID NO: 39524 - DNA, 29 bp, Homo sapiens
cggtggatcactcggctcgtgcgtcgatg

SEQ ID NO: 39525 - DNA, 19 bp, Homo sapiens
ggtggatcactcggctcgt

SEQ ID NO: 39526 - DNA, 20 bp, Homo sapiens
ggtggatcactcggctcgtg

SEQ ID NO: 39527 - DNA, 21 bp, Homo sapiens
ggtggatcactcggctcgtgc

SEQ ID NO: 39528 - DNA, 22 bp, Homo sapiens
ggtggatcactcggctcgtgcg

SEQ ID NO: 39529 - DNA, 23 bp, Homo sapiens
ggtggatcactcggctcgtgcgt

SEQ ID NO: 39530 - DNA, 24 bp, Homo sapiens
ggtggatcactcggctcgtgcgtc

SEQ ID NO: 39531 - DNA, 29 bp, Homo sapiens
ggtggatcactcggctcgtgcgtcgatga

SEQ ID NO: 39532 - DNA, 17 bp, Homo sapiens
gtggatcactcggctcg

SEQ ID NO: 39533 - DNA, 18 bp, Homo sapiens
gtggatcactcggctcgt

SEQ ID NO: 39534 - DNA, 19 bp, Homo sapiens
gtggatcactcggctcgtg

SEQ ID NO: 39535 - DNA, 20 bp, Homo sapiens
gtggatcactcggctcgtgc

SEQ ID NO: 39536 - DNA, 21 bp, Homo sapiens
gtggatcactcggctcgtgcg

SEQ ID NO: 39537 - DNA, 22 bp, Homo sapiens
gtggatcactcggctcgtgcgt

SEQ ID NO: 39538 - DNA, 23 bp, Homo sapiens
gtggatcactcggctcgtgcgtc

SEQ ID NO: 39539 - DNA, 24 bp, Homo sapiens
gtggatcactcggctcgtgcgtcg

SEQ ID NO: 39540 - DNA, 25 bp, Homo sapiens
gtggatcactcggctcgtgcgtcga

SEQ ID NO: 39541 - DNA, 26 bp, Homo sapiens
gtggatcactcggctcgtgcgtcgat

SEQ ID NO: 39542 - DNA, 29 bp, Homo sapiens
gtggatcactcggctcgtgcgtcgatgaa

SEQ ID NO: 39543 - DNA, 30 bp, Homo sapiens
gtggatcactcggctcgtgcgtcgatgaag

SEQ ID NO: 39544 - DNA, 16 bp, Homo sapiens
tggatcactcggctcg

SEQ ID NO: 39545 - DNA, 17 bp, Homo sapiens
tggatcactcggctcgt

SEQ ID NO: 39546 - DNA, 18 bp, Homo sapiens
tggatcactcggctcgtg

SEQ ID NO: 39547 - DNA, 19 bp, Homo sapiens
tggatcactcggctcgtgc

SEQ ID NO: 39548 - DNA, 20 bp, Homo sapiens
tggatcactcggctcgtgcg

SEQ ID NO: 39549 - DNA, 21 bp, Homo sapiens
tggatcactcggctcgtgcgt

SEQ ID NO: 39550 - DNA, 22 bp, Homo sapiens
tggatcactcggctcgtgcgtc

SEQ ID NO: 39551 - DNA, 23 bp, Homo sapiens
tggatcactcggctcgtgcgtcg

SEQ ID NO: 39552 - DNA, 24 bp, Homo sapiens
tggatcactcggctcgtgcgtcga

SEQ ID NO: 39553 - DNA, 25 bp, Homo sapiens
tggatcactcggctcgtgcgtcgat

SEQ ID NO: 39554 - DNA, 29 bp, Homo sapiens
tggatcactcggctcgtgcgtcgatgaag

SEQ ID NO: 39555 - DNA, 16 bp, Homo sapiens
ggatcactcggctcgt

SEQ ID NO: 39556 - DNA, 18 bp, Homo sapiens
ggatcactcggctcgtgc

SEQ ID NO: 39557 - DNA, 19 bp, Homo sapiens
ggatcactcggctcgtgcg

SEQ ID NO: 39558 - DNA, 20 bp, Homo sapiens
ggatcactcggctcgtgcgt

SEQ ID NO: 39559 - DNA, 21 bp, Homo sapiens
ggatcactcggctcgtgcgtc

SEQ ID NO: 39560 - DNA, 22 bp, Homo sapiens
ggatcactcggctcgtgcgtcg

SEQ ID NO: 39561 - DNA, 23 bp, Homo sapiens
ggatcactcggctcgtgcgtcga

SEQ ID NO: 39562 - DNA, 24 bp, Homo sapiens
ggatcactcggctcgtgcgtcgat

SEQ ID NO: 39563 - DNA, 17 bp, Homo sapiens
gatcactcggctcgtgc

SEQ ID NO: 39564 - DNA, 18 bp, Homo sapiens
gatcactcggctcgtgcg

SEQ ID NO: 39565 - DNA, 19 bp, Homo sapiens
gatcactcggctcgtgcgt

SEQ ID NO: 39566 - DNA, 20 bp, Homo sapiens
gatcactcggctcgtgcgtc

SEQ ID NO: 39567 - DNA, 21 bp, Homo sapiens
gatcactcggctcgtgcgtcg

SEQ ID NO: 39568 - DNA, 22 bp, Homo sapiens
gatcactcggctcgtgcgtcga

SEQ ID NO: 39569 - DNA, 23 bp, Homo sapiens
gatcactcggctcgtgcgtcgat

SEQ ID NO: 39570 - DNA, 30 bp, Homo sapiens
gatcactcggctcgtgcgtcgatgaagaac

SEQ ID NO: 39571 - DNA, 22 bp, Homo sapiens
tcactcggctcgtgcgtcgatg

SEQ ID NO: 39572 - DNA, 18 bp, Homo sapiens
cactcggctcgtgcgtcg

SEQ ID NO: 39573 - DNA, 20 bp, Homo sapiens
cactcggctcgtgcgtcgat

SEQ ID NO: 39574 - DNA, 21 bp, Homo sapiens
cactcggctcgtgcgtcgatg

SEQ ID NO: 39575 - DNA, 24 bp, Homo sapiens
cactcggctcgtgcgtcgatgaag

SEQ ID NO: 39576 - DNA, 25 bp, Homo sapiens
cactcggctcgtgcgtcgatgaaga

SEQ ID NO: 39577 - DNA, 27 bp, Homo sapiens
cactcggctcgtgcgtcgatgaagaac

SEQ ID NO: 39578 - DNA, 28 bp, Homo sapiens
cactcggctcgtgcgtcgatgaagaacg

SEQ ID NO: 39579 - DNA, 24 bp, Homo sapiens
actcggctcgtgcgtcgatgaaga

SEQ ID NO: 39580 - DNA, 23 bp, Homo sapiens
ctcggctcgtgcgtcgatgaaga

SEQ ID NO: 39581 - DNA, 25 bp, Homo sapiens
ctcggctcgtgcgtcgatgaagaac

SEQ ID NO: 39582 - DNA, 26 bp, Homo sapiens
ctcggctcgtgcgtcgatgaagaacg

SEQ ID NO: 39583 - DNA, 20 bp, Homo sapiens
cggctcgtgcgtcgatgaag

SEQ ID NO: 39584 - DNA, 21 bp, Homo sapiens
cggctcgtgcgtcgatgaaga

SEQ ID NO: 39585 - DNA, 22 bp, Homo sapiens
cggctcgtgcgtcgatgaagaa

SEQ ID NO: 39586 - DNA, 23 bp, Homo sapiens
cggctcgtgcgtcgatgaagaac

SEQ ID NO: 39587 - DNA, 24 bp, Homo sapiens
cggctcgtgcgtcgatgaagaacg

SEQ ID NO: 39588 - DNA, 25 bp, Homo sapiens
cggctcgtgcgtcgatgaagaacgc

SEQ ID NO: 39589 - DNA, 20 bp, Homo sapiens
ggctcgtgcgtcgatgaaga

SEQ ID NO: 39590 - DNA, 23 bp, Homo sapiens
ggctcgtgcgtcgatgaagaacg

SEQ ID NO: 39591 - DNA, 24 bp, Homo sapiens
ggctcgtgcgtcgatgaagaacgc

SEQ ID NO: 39592 - DNA, 18 bp, Homo sapiens
gctcgtgcgtcgatgaag

SEQ ID NO: 39593 - DNA, 19 bp, Homo sapiens
gctcgtgcgtcgatgaaga

SEQ ID NO: 39594 - DNA, 20 bp, Homo sapiens
gctcgtgcgtcgatgaagaa

SEQ ID NO: 39595 - DNA, 21 bp, Homo sapiens
gctcgtgcgtcgatgaagaac

SEQ ID NO: 39596 - DNA, 22 bp, Homo sapiens
gctcgtgcgtcgatgaagaacg

SEQ ID NO: 39597 - DNA, 23 bp, Homo sapiens
gctcgtgcgtcgatgaagaacgc

SEQ ID NO: 39598 - DNA, 17 bp, Homo sapiens
ctcgtgcgtcgatgaag

SEQ ID NO: 39599 - DNA, 18 bp, Homo sapiens
ctcgtgcgtcgatgaaga

SEQ ID NO: 39600 - DNA, 19 bp, Homo sapiens
ctcgtgcgtcgatgaagaa

SEQ ID NO: 39601 - DNA, 20 bp, Homo sapiens
ctcgtgcgtcgatgaagaac

SEQ ID NO: 39602 - DNA, 21 bp, Homo sapiens
ctcgtgcgtcgatgaagaacg

SEQ ID NO: 39603 - DNA, 22 bp, Homo sapiens
ctcgtgcgtcgatgaagaacgc

SEQ ID NO: 39604 - DNA, 17 bp, Homo sapiens
tcgtgcgtcgatgaaga

SEQ ID NO: 39605 - DNA, 18 bp, Homo sapiens
tcgtgcgtcgatgaagaa

SEQ ID NO: 39606 - DNA, 19 bp, Homo sapiens
tcgtgcgtcgatgaagaac

SEQ ID NO: 39607 - DNA, 20 bp, Homo sapiens
tcgtgcgtcgatgaagaacg

SEQ ID NO: 39608 - DNA, 21 bp, Homo sapiens
tcgtgcgtcgatgaagaacgc

SEQ ID NO: 39609 - DNA, 24 bp, Homo sapiens
tcgtgcgtcgatgaagaacgcagc

SEQ ID NO: 39610 - DNA, 16 bp, Homo sapiens
cgtgcgtcgatgaaga

SEQ ID NO: 39611 - DNA, 18 bp, Homo sapiens
cgtgcgtcgatgaagaac

SEQ ID NO: 39612 - DNA, 19 bp, Homo sapiens
cgtgcgtcgatgaagaacg

SEQ ID NO: 39613 - DNA, 20 bp, Homo sapiens
cgtgcgtcgatgaagaacgc

SEQ ID NO: 39614 - DNA, 17 bp, Homo sapiens
gtgcgtcgatgaagaac

SEQ ID NO: 39615 - DNA, 18 bp, Homo sapiens
gtgcgtcgatgaagaacg

SEQ ID NO: 39616 - DNA, 22 bp, Homo sapiens
gtgcgtcgatgaagaacgcagc

SEQ ID NO: 39617 - DNA, 30 bp, Homo sapiens
gtgcgtcgatgaagaacgcagctagctgcg

SEQ ID NO: 39618 - DNA, 16 bp, Homo sapiens
tgcgtcgatgaagaac

SEQ ID NO: 39619 - DNA, 17 bp, Homo sapiens
tgcgtcgatgaagaacg

SEQ ID NO: 39620 - DNA, 17 bp, Homo sapiens
gcgtcgatgaagaacgc

SEQ ID NO: 39621 - DNA, 23 bp, Homo sapiens
gcgtcgatgaagaacgcagctag

SEQ ID NO: 39622 - DNA, 16 bp, Homo sapiens
cgtcgatgaagaacgc

SEQ ID NO: 39623 - DNA, 24 bp, Homo sapiens
tcgatgaagaacgcagctagctgc

SEQ ID NO: 39624 - DNA, 23 bp, Homo sapiens
cgatgaagaacgcagctagctgc

SEQ ID NO: 39625 - DNA, 21 bp, Homo sapiens
gatgaagaacgcagctagctg

SEQ ID NO: 39626 - DNA, 22 bp, Homo sapiens
gatgaagaacgcagctagctgc

SEQ ID NO: 39627 - DNA, 23 bp, Homo sapiens
gatgaagaacgcagctagctgcg

SEQ ID NO: 39628 - DNA, 20 bp, Homo sapiens
tgaagaacgcagctagctgc

SEQ ID NO: 39629 - DNA, 20 bp, Homo sapiens
gaagaacgcagctagctgcg

SEQ ID NO: 39630 - DNA, 21 bp, Homo sapiens
gaagaacgcagctagctgcga

SEQ ID NO: 39631 - DNA, 22 bp, Homo sapiens
gaagaacgcagctagctgcgag

SEQ ID NO: 39632 - DNA, 23 bp, Homo sapiens
gaagaacgcagctagctgcgaga

SEQ ID NO: 39633 - DNA, 24 bp, Homo sapiens
gaagaacgcagctagctgcgagaa

SEQ ID NO: 39634 - DNA, 25 bp, Homo sapiens
gaagaacgcagctagctgcgagaat

SEQ ID NO: 39635 - DNA, 26 bp, Homo sapiens
gaagaacgcagctagctgcgagaatt

SEQ ID NO: 39636 - DNA, 16 bp, Homo sapiens
gcagctagctgcgaga

SEQ ID NO: 39637 - DNA, 17 bp, Homo sapiens
gcagctagctgcgagaa

SEQ ID NO: 39638 - DNA, 18 bp, Homo sapiens
gcagctagctgcgagaat

SEQ ID NO: 39639 - DNA, 19 bp, Homo sapiens
gcagctagctgcgagaatt

SEQ ID NO: 39640 - DNA, 20 bp, Homo sapiens
gcagctagctgcgagaatta

SEQ ID NO: 39641 - DNA, 23 bp, Homo sapiens
gcagctagctgcgagaattaatg

SEQ ID NO: 39642 - DNA, 25 bp, Homo sapiens
gcagctagctgcgagaattaatgtg

SEQ ID NO: 39643 - DNA, 30 bp, Homo sapiens
gcagctagctgcgagaattaatgtgaattg

SEQ ID NO: 39644 - DNA, 16 bp, Homo sapiens
gctagctgcgagaatt

SEQ ID NO: 39645 - DNA, 19 bp, Homo sapiens
ctagctgcgagaattaatg

SEQ ID NO: 39646 - DNA, 17 bp, Homo sapiens
ctgcgagaattaatgtg

SEQ ID NO: 39647 - DNA, 18 bp, Homo sapiens
ctgcgagaattaatgtga

SEQ ID NO: 39648 - DNA, 19 bp, Homo sapiens
ctgcgagaattaatgtgaa

SEQ ID NO: 39649 - DNA, 20 bp, Homo sapiens
ctgcgagaattaatgtgaat

SEQ ID NO: 39650 - DNA, 21 bp, Homo sapiens
ctgcgagaattaatgtgaatt

SEQ ID NO: 39651 - DNA, 22 bp, Homo sapiens
ctgcgagaattaatgtgaattg

SEQ ID NO: 39652 - DNA, 23 bp, Homo sapiens
ctgcgagaattaatgtgaattgc

SEQ ID NO: 39653 - DNA, 21 bp, Homo sapiens
tgcgagaattaatgtgaattg

SEQ ID NO: 39654 - DNA, 22 bp, Homo sapiens
tgcgagaattaatgtgaattgc

SEQ ID NO: 39655 - DNA, 27 bp, Homo sapiens
tgcgagaattaatgtgaattgcaggac

SEQ ID NO: 39656 - DNA, 28 bp, Homo sapiens
tgcgagaattaatgtgaattgcaggaca

SEQ ID NO: 39657 - DNA, 29 bp, Homo sapiens
tgcgagaattaatgtgaattgcaggacac

SEQ ID NO: 39658 - DNA, 21 bp, Homo sapiens
cgagaattaatgtgaattgca

SEQ ID NO: 39659 - DNA, 25 bp, Homo sapiens
cgagaattaatgtgaattgcaggac

SEQ ID NO: 39660 - DNA, 19 bp, Homo sapiens
gagaattaatgtgaattgc

SEQ ID NO: 39661 - DNA, 24 bp, Homo sapiens
gagaattaatgtgaattgcaggac

SEQ ID NO: 39662 - DNA, 25 bp, Homo sapiens
gagaattaatgtgaattgcaggaca

SEQ ID NO: 39663 - DNA, 26 bp, Homo sapiens
gagaattaatgtgaattgcaggacac

SEQ ID NO: 39664 - DNA, 21 bp, Homo sapiens
agaattaatgtgaattgcagg

SEQ ID NO: 39665 - DNA, 22 bp, Homo sapiens
agaattaatgtgaattgcagga

SEQ ID NO: 39666 - DNA, 23 bp, Homo sapiens
agaattaatgtgaattgcaggac

SEQ ID NO: 39667 - DNA, 24 bp, Homo sapiens
agaattaatgtgaattgcaggaca

SEQ ID NO: 39668 - DNA, 25 bp, Homo sapiens
agaattaatgtgaattgcaggacac

SEQ ID NO: 39669 - DNA, 17 bp, Homo sapiens
gaattaatgtgaattgc

SEQ ID NO: 39670 - DNA, 19 bp, Homo sapiens
gaattaatgtgaattgcag

SEQ ID NO: 39671 - DNA, 20 bp, Homo sapiens
gaattaatgtgaattgcagg

SEQ ID NO: 39672 - DNA, 21 bp, Homo sapiens
gaattaatgtgaattgcagga

SEQ ID NO: 39673 - DNA, 22 bp, Homo sapiens
gaattaatgtgaattgcaggac

SEQ ID NO: 39674 - DNA, 23 bp, Homo sapiens
gaattaatgtgaattgcaggaca

SEQ ID NO: 39675 - DNA, 24 bp, Homo sapiens
gaattaatgtgaattgcaggacac

SEQ ID NO: 39676 - DNA, 25 bp, Homo sapiens
gaattaatgtgaattgcaggacaca

SEQ ID NO: 39677 - DNA, 20 bp, Homo sapiens
aattaatgtgaattgcagga

SEQ ID NO: 39678 - DNA, 21 bp, Homo sapiens
aattaatgtgaattgcaggac

SEQ ID NO: 39679 - DNA, 22 bp, Homo sapiens
aattaatgtgaattgcaggaca

SEQ ID NO: 39680 - DNA, 18 bp, Homo sapiens
attaatgtgaattgcagg

SEQ ID NO: 39681 - DNA, 19 bp, Homo sapiens
attaatgtgaattgcagga

SEQ ID NO: 39682 - DNA, 20 bp, Homo sapiens
attaatgtgaattgcaggac

SEQ ID NO: 39683 - DNA, 21 bp, Homo sapiens
attaatgtgaattgcaggaca

SEQ ID NO: 39684 - DNA, 22 bp, Homo sapiens
attaatgtgaattgcaggacac

SEQ ID NO: 39685 - DNA, 23 bp, Homo sapiens
attaatgtgaattgcaggacaca

SEQ ID NO: 39686 - DNA, 18 bp, Homo sapiens
ttaatgtgaattgcagga

SEQ ID NO: 39687 - DNA, 19 bp, Homo sapiens
ttaatgtgaattgcaggac

SEQ ID NO: 39688 - DNA, 20 bp, Homo sapiens
ttaatgtgaattgcaggaca

SEQ ID NO: 39689 - DNA, 21 bp, Homo sapiens
ttaatgtgaattgcaggacac

SEQ ID NO: 39690 - DNA, 22 bp, Homo sapiens
ttaatgtgaattgcaggacaca

SEQ ID NO: 39691 - DNA, 18 bp, Homo sapiens
taatgtgaattgcaggac

SEQ ID NO: 39692 - DNA, 19 bp, Homo sapiens
taatgtgaattgcaggaca

SEQ ID NO: 39693 - DNA, 20 bp, Homo sapiens
taatgtgaattgcaggacac

SEQ ID NO: 39694 - DNA, 17 bp, Homo sapiens
aatgtgaattgcaggac

SEQ ID NO: 39695 - DNA, 18 bp, Homo sapiens
aatgtgaattgcaggaca

SEQ ID NO: 39696 - DNA, 19 bp, Homo sapiens
aatgtgaattgcaggacac

SEQ ID NO: 39697 - DNA, 29 bp, Homo sapiens
atgtgaattgcaggacacattgatcatcg

SEQ ID NO: 39698 - DNA, 30 bp, Homo sapiens
atgtgaattgcaggacacattgatcatcga

SEQ ID NO: 39699 - DNA, 21 bp, Homo sapiens
tgtgaattgcaggacacattg

SEQ ID NO: 39700 - DNA, 22 bp, Homo sapiens
tgtgaattgcaggacacattga

SEQ ID NO: 39701 - DNA, 23 bp, Homo sapiens
tgtgaattgcaggacacattgat

SEQ ID NO: 39702 - DNA, 24 bp, Homo sapiens
tgtgaattgcaggacacattgatc

SEQ ID NO: 39703 - DNA, 25 bp, Homo sapiens
tgtgaattgcaggacacattgatca

SEQ ID NO: 39704 - DNA, 26 bp, Homo sapiens
tgtgaattgcaggacacattgatcat

SEQ ID NO: 39705 - DNA, 27 bp, Homo sapiens
tgtgaattgcaggacacattgatcatc

SEQ ID NO: 39706 - DNA, 28 bp, Homo sapiens
tgtgaattgcaggacacattgatcatcg

SEQ ID NO: 39707 - DNA, 29 bp, Homo sapiens
tgtgaattgcaggacacattgatcatcga

SEQ ID NO: 39708 - DNA, 30 bp, Homo sapiens; identical to SEQ ID NO: 29327

SEQ ID NO: 39709 - DNA, 20 bp, Homo sapiens
gtgaattgcaggacacattg

SEQ ID NO: 39710 - DNA, 21 bp, Homo sapiens
gtgaattgcaggacacattga

SEQ ID NO: 39711 - DNA, 23 bp, Homo sapiens
gtgaattgcaggacacattgatc

SEQ ID NO: 39712 - DNA, 24 bp, Homo sapiens
gtgaattgcaggacacattgatca

SEQ ID NO: 39713 - DNA, 25 bp, Homo sapiens
gtgaattgcaggacacattgatcat

SEQ ID NO: 39714 - DNA, 26 bp, Homo sapiens
gtgaattgcaggacacattgatcatc

SEQ ID NO: 39715 - DNA, 27 bp, Homo sapiens
gtgaattgcaggacacattgatcatcg

SEQ ID NO: 39716 - DNA, 29 bp, Homo sapiens
gtgaattgcaggacacattgatcatcgac

SEQ ID NO: 39717 - DNA, 30 bp, Homo sapiens
gtgaattgcaggacacattgatcatcgaca

SEQ ID NO: 39718 - DNA, 18 bp, Homo sapiens
tgaattgcaggacacatt

SEQ ID NO: 39719 - DNA, 19 bp, Homo sapiens
tgaattgcaggacacattg

SEQ ID NO: 39720 - DNA, 21 bp, Homo sapiens
tgaattgcaggacacattgat

SEQ ID NO: 39721 - DNA, 22 bp, Homo sapiens
tgaattgcaggacacattgatc

SEQ ID NO: 39722 - DNA, 23 bp, Homo sapiens
tgaattgcaggacacattgatca

SEQ ID NO: 39723 - DNA, 24 bp, Homo sapiens
tgaattgcaggacacattgatcat

SEQ ID NO: 39724 - DNA, 25 bp, Homo sapiens
tgaattgcaggacacattgatcatc

SEQ ID NO: 39725 - DNA, 26 bp, Homo sapiens
tgaattgcaggacacattgatcatcg

SEQ ID NO: 39726 - DNA, 27 bp, Homo sapiens
tgaattgcaggacacattgatcatcga

SEQ ID NO: 39727 - DNA, 28 bp, Homo sapiens
tgaattgcaggacacattgatcatcgac

SEQ ID NO: 39728 - DNA, 29 bp, Homo sapiens
tgaattgcaggacacattgatcatcgaca

SEQ ID NO: 39729 - DNA, 30 bp, Homo sapiens; identical to SEQ ID NO: 17602

SEQ ID NO: 39730 - DNA, 19 bp, Homo sapiens
aattgcaggacacattgat

SEQ ID NO: 39731 - DNA, 30 bp, Homo sapiens; identical to SEQ ID NO: 17617

SEQ ID NO: 39732 - DNA, 30 bp, Homo sapiens
attgcaggacacattgatcatcgacacttc

SEQ ID NO: 39733 - DNA, 19 bp, Homo sapiens
ttgcaggacacattgatca

SEQ ID NO: 39734 - DNA, 20 bp, Homo sapiens
ttgcaggacacattgatcat

SEQ ID NO: 39735 - DNA, 21 bp, Homo sapiens
ttgcaggacacattgatcatc

SEQ ID NO: 39736 - DNA, 22 bp, Homo sapiens
ttgcaggacacattgatcatcg

SEQ ID NO: 39737 - DNA, 29 bp, Homo sapiens
ttgcaggacacattgatcatcgacacttc

SEQ ID NO: 39738 - DNA, 30 bp, Homo sapiens; identical to SEQ ID NO: 17641

SEQ ID NO: 39739 - DNA, 16 bp, Homo sapiens
tgcaggacacattgat

SEQ ID NO: 39740 - DNA, 18 bp, Homo sapiens
tgcaggacacattgatca

SEQ ID NO: 39741 - DNA, 19 bp, Homo sapiens
tgcaggacacattgatcat

SEQ ID NO: 39742 - DNA, 20 bp, Homo sapiens
tgcaggacacattgatcatc

SEQ ID NO: 39743 - DNA, 21 bp, Homo sapiens
tgcaggacacattgatcatcg

SEQ ID NO: 39744 - DNA, 22 bp, Homo sapiens
tgcaggacacattgatcatcga

SEQ ID NO: 39745 - DNA, 23 bp, Homo sapiens
tgcaggacacattgatcatcgac

SEQ ID NO: 39746 - DNA, 24 bp, Homo sapiens
tgcaggacacattgatcatcgaca

SEQ ID NO: 39747 - DNA, 25 bp, Homo sapiens
tgcaggacacattgatcatcgacac

SEQ ID NO: 39748 - DNA, 26 bp, Homo sapiens
tgcaggacacattgatcatcgacact

SEQ ID NO: 39749 - DNA, 27 bp, Homo sapiens
tgcaggacacattgatcatcgacactt

SEQ ID NO: 39750 - DNA, 28 bp, Homo sapiens
tgcaggacacattgatcatcgacacttc

SEQ ID NO: 39751 - DNA, 29 bp, Homo sapiens
tgcaggacacattgatcatcgacacttcg

SEQ ID NO: 39752 - DNA, 18 bp, Homo sapiens
gcaggacacattgatcat

SEQ ID NO: 39753 - DNA, 29 bp, Homo sapiens
gcaggacacattgatcatcgacacttcga

SEQ ID NO: 39754 - DNA, 23 bp, Homo sapiens
caggacacattgatcatcgacac

SEQ ID NO: 39755 - DNA, 30 bp, Homo sapiens
caggacacattgatcatcgacacttcgaac

SEQ ID NO: 39756 - DNA, 19 bp, Homo sapiens
aggacacattgatcatcga

SEQ ID NO: 39757 - DNA, 20 bp, Homo sapiens
aggacacattgatcatcgac

SEQ ID NO: 39758 - DNA, 22 bp, Homo sapiens
aggacacattgatcatcgacac

SEQ ID NO: 39759 - DNA, 23 bp, Homo sapiens
aggacacattgatcatcgacact

SEQ ID NO: 39760 - DNA, 30 bp, Homo sapiens
aggacacattgatcatcgacacttcgaacg

SEQ ID NO: 39761 - DNA, 20 bp, Homo sapiens
ggacacattgatcatcgaca

SEQ ID NO: 39762 - DNA, 21 bp, Homo sapiens
ggacacattgatcatcgacac

SEQ ID NO: 39763 - DNA, 22 bp, Homo sapiens
ggacacattgatcatcgacact

SEQ ID NO: 39764 - DNA, 23 bp, Homo sapiens
ggacacattgatcatcgacactt

SEQ ID NO: 39765 - DNA, 26 bp, Homo sapiens
ggacacattgatcatcgacacttcga

SEQ ID NO: 39766 - DNA, 29 bp, Homo sapiens
ggacacattgatcatcgacacttcgaacg

SEQ ID NO: 39767 - DNA, 30 bp, Homo sapiens; identical to SEQ ID NO: 17684

SEQ ID NO: 39768 - DNA, 16 bp, Homo sapiens
gacacattgatcatcg

SEQ ID NO: 39769 - DNA, 19 bp, Homo sapiens
gacacattgatcatcgaca

SEQ ID NO: 39770 - DNA, 20 bp, Homo sapiens
gacacattgatcatcgacac

SEQ ID NO: 39771 - DNA, 21 bp, Homo sapiens
gacacattgatcatcgacact

SEQ ID NO: 39772 - DNA, 22 bp, Homo sapiens
gacacattgatcatcgacactt

SEQ ID NO: 39773 - DNA, 24 bp, Homo sapiens
gacacattgatcatcgacacttcg

SEQ ID NO: 39774 - DNA, 29 bp, Homo sapiens
gacacattgatcatcgacacttcgaacgc

SEQ ID NO: 39775 - DNA, 30 bp, Homo sapiens; identical to SEQ ID NO: 17705

SEQ ID NO: 39776 - DNA, 18 bp, Homo sapiens
acacattgatcatcgaca

SEQ ID NO: 39777 - DNA, 20 bp, Homo sapiens
acacattgatcatcgacact

SEQ ID NO: 39778 - DNA, 21 bp, Homo sapiens
acacattgatcatcgacactt

SEQ ID NO: 39779 - DNA, 23 bp, Homo sapiens
acacattgatcatcgacacttcg

SEQ ID NO: 39780 - DNA, 24 bp, Homo sapiens
acacattgatcatcgacacttcga

SEQ ID NO: 39781 - DNA, 25 bp, Homo sapiens
acacattgatcatcgacacttcgaa

SEQ ID NO: 39782 - DNA, 26 bp, Homo sapiens
acacattgatcatcgacacttcgaac

SEQ ID NO: 39783 - DNA, 27 bp, Homo sapiens
acacattgatcatcgacacttcgaacg

SEQ ID NO: 39784 - DNA, 28 bp, Homo sapiens
acacattgatcatcgacacttcgaacgc

SEQ ID NO: 39785 - DNA, 29 bp, Homo sapiens
acacattgatcatcgacacttcgaacgca

SEQ ID NO: 39786 - DNA, 30 bp, Homo sapiens; identical to SEQ ID NO: 29330

SEQ ID NO: 39787 - DNA, 17 bp, Homo sapiens
cacattgatcatcgaca

SEQ ID NO: 39788 - DNA, 18 bp, Homo sapiens
cacattgatcatcgacac

SEQ ID NO: 39789 - DNA, 19 bp, Homo sapiens
cacattgatcatcgacact

SEQ ID NO: 39790 - DNA, 20 bp, Homo sapiens
cacattgatcatcgacactt

SEQ ID NO: 39791 - DNA, 21 bp, Homo sapiens
cacattgatcatcgacacttc

SEQ ID NO: 39792 - DNA, 22 bp, Homo sapiens
cacattgatcatcgacacttcg

SEQ ID NO: 39793 - DNA, 23 bp, Homo sapiens
cacattgatcatcgacacttcga

SEQ ID NO: 39794 - DNA, 24 bp, Homo sapiens
cacattgatcatcgacacttcgaa

SEQ ID NO: 39795 - DNA, 25 bp, Homo sapiens
cacattgatcatcgacacttcgaac

SEQ ID NO: 39796 - DNA, 26 bp, Homo sapiens
cacattgatcatcgacacttcgaacg

SEQ ID NO: 39797 - DNA, 27 bp, Homo sapiens
cacattgatcatcgacacttcgaacgc

SEQ ID NO: 39798 - DNA, 28 bp, Homo sapiens
cacattgatcatcgacacttcgaacgca

SEQ ID NO: 39799 - DNA, 29 bp, Homo sapiens
cacattgatcatcgacacttcgaacgcac

SEQ ID NO: 39800 - DNA, 30 bp, Homo sapiens; identical to SEQ ID NO: 17736

SEQ ID NO: 39801 - DNA, 16 bp, Homo sapiens
acattgatcatcgaca

SEQ ID NO: 39802 - DNA, 17 bp, Homo sapiens
acattgatcatcgacac

SEQ ID NO: 39803 - DNA, 18 bp, Homo sapiens
acattgatcatcgacact

SEQ ID NO: 39804 - DNA, 19 bp, Homo sapiens
acattgatcatcgacactt

SEQ ID NO: 39805 - DNA, 20 bp, Homo sapiens
acattgatcatcgacacttc

SEQ ID NO: 39806 - DNA, 21 bp, Homo sapiens
acattgatcatcgacacttcg

SEQ ID NO: 39807 - DNA, 22 bp, Homo sapiens
acattgatcatcgacacttcga

SEQ ID NO: 39808 - DNA, 23 bp, Homo sapiens
acattgatcatcgacacttcgaa

SEQ ID NO: 39809 - DNA, 24 bp, Homo sapiens
acattgatcatcgacacttcgaac

SEQ ID NO: 39810 - DNA, 25 bp, Homo sapiens
acattgatcatcgacacttcgaacg

SEQ ID NO: 39811 - DNA, 26 bp, Homo sapiens
acattgatcatcgacacttcgaacgc

SEQ ID NO: 39812 - DNA, 27 bp, Homo sapiens
acattgatcatcgacacttcgaacgca

SEQ ID NO: 39813 - DNA, 28 bp, Homo sapiens
acattgatcatcgacacttcgaacgcac

SEQ ID NO: 39814 - DNA, 29 bp, Homo sapiens
acattgatcatcgacacttcgaacgcact

SEQ ID NO: 39815 - DNA, 30 bp, Homo sapiens; identical to SEQ ID NO: 3670

SEQ ID NO: 39816 - DNA, 16 bp, Homo sapiens
cattgatcatcgacac

SEQ ID NO: 39817 - DNA, 17 bp, Homo sapiens
cattgatcatcgacact

SEQ ID NO: 39818 - DNA, 18 bp, Homo sapiens
cattgatcatcgacactt

SEQ ID NO: 39819 - DNA, 19 bp, Homo sapiens
cattgatcatcgacacttc

SEQ ID NO: 39820 - DNA, 20 bp, Homo sapiens
cattgatcatcgacacttcg

SEQ ID NO: 39821 - DNA, 21 bp, Homo sapiens
cattgatcatcgacacttcga

SEQ ID NO: 39822 - DNA, 22 bp, Homo sapiens
cattgatcatcgacacttcgaa

SEQ ID NO: 39823 - DNA, 23 bp, Homo sapiens
cattgatcatcgacacttcgaac

SEQ ID NO: 39824 - DNA, 24 bp, Homo sapiens
cattgatcatcgacacttcgaacg

SEQ ID NO: 39825 - DNA, 25 bp, Homo sapiens
cattgatcatcgacacttcgaacgc

SEQ ID NO: 39826 - DNA, 26 bp, Homo sapiens
cattgatcatcgacacttcgaacgca

SEQ ID NO: 39827 - DNA, 27 bp, Homo sapiens
cattgatcatcgacacttcgaacgcac

SEQ ID NO: 39828 - DNA, 28 bp, Homo sapiens
cattgatcatcgacacttcgaacgcact

SEQ ID NO: 39829 - DNA, 29 bp, Homo sapiens
cattgatcatcgacacttcgaacgcactt

SEQ ID NO: 39830 - DNA, 30 bp, Homo sapiens; identical to SEQ ID NO: 17772

SEQ ID NO: 39831 - DNA, 16 bp, Homo sapiens
attgatcatcgacact

SEQ ID NO: 39832 - DNA, 18 bp, Homo sapiens
attgatcatcgacacttc

SEQ ID NO: 39833 - DNA, 19 bp, Homo sapiens
attgatcatcgacacttcg

SEQ ID NO: 39834 - DNA, 20 bp, Homo sapiens
attgatcatcgacacttcga

SEQ ID NO: 39835 - DNA, 21 bp, Homo sapiens
attgatcatcgacacttcgaa

SEQ ID NO: 39836 - DNA, 22 bp, Homo sapiens
attgatcatcgacacttcgaac

SEQ ID NO: 39837 - DNA, 23 bp, Homo sapiens
attgatcatcgacacttcgaacg

SEQ ID NO: 39838 - DNA, 24 bp, Homo sapiens
attgatcatcgacacttcgaacgc

SEQ ID NO: 39839 - DNA, 25 bp, Homo sapiens
attgatcatcgacacttcgaacgca

SEQ ID NO: 39840 - DNA, 26 bp, Homo sapiens
attgatcatcgacacttcgaacgcac

SEQ ID NO: 39841 - DNA, 27 bp, Homo sapiens
attgatcatcgacacttcgaacgcact

SEQ ID NO: 39842 - DNA, 29 bp, Homo sapiens
attgatcatcgacacttcgaacgcacttg

SEQ ID NO: 39843 - DNA, 30 bp, Homo sapiens; identical to SEQ ID NO: 17788

SEQ ID NO: 39844 - DNA, 17 bp, Homo sapiens
ttgatcatcgacacttc

SEQ ID NO: 39845 - DNA, 18 bp, Homo sapiens
ttgatcatcgacacttcg

SEQ ID NO: 39846 - DNA, 19 bp, Homo sapiens
ttgatcatcgacacttcga

SEQ ID NO: 39847 - DNA, 20 bp, Homo sapiens
ttgatcatcgacacttcgaa

SEQ ID NO: 39848 - DNA, 21 bp, Homo sapiens
ttgatcatcgacacttcgaac

SEQ ID NO: 39849 - DNA, 22 bp, Homo sapiens
ttgatcatcgacacttcgaacg

SEQ ID NO: 39850 - DNA, 23 bp, Homo sapiens
ttgatcatcgacacttcgaacgc

SEQ ID NO: 39851 - DNA, 24 bp, Homo sapiens
ttgatcatcgacacttcgaacgca

SEQ ID NO: 39852 - DNA, 25 bp, Homo sapiens
ttgatcatcgacacttcgaacgcac

SEQ ID NO: 39853 - DNA, 26 bp, Homo sapiens
ttgatcatcgacacttcgaacgcact

SEQ ID NO: 39854 - DNA, 27 bp, Homo sapiens
ttgatcatcgacacttcgaacgcactt

SEQ ID NO: 39855 - DNA, 28 bp, Homo sapiens
ttgatcatcgacacttcgaacgcacttg

SEQ ID NO: 39856 - DNA, 29 bp, Homo sapiens
ttgatcatcgacacttcgaacgcacttgc

SEQ ID NO: 39857 - DNA, 30 bp, Homo sapiens; identical to SEQ ID NO: 29355

SEQ ID NO: 39858 - DNA, 17 bp, Homo sapiens
tgatcatcgacacttcg

SEQ ID NO: 39859 - DNA, 18 bp, Homo sapiens
tgatcatcgacacttcga

SEQ ID NO: 39860 - DNA, 19 bp, Homo sapiens
tgatcatcgacacttcgaa

SEQ ID NO: 39861 - DNA, 20 bp, Homo sapiens
tgatcatcgacacttcgaac

SEQ ID NO: 39862 - DNA, 21 bp, Homo sapiens
tgatcatcgacacttcgaacg

SEQ ID NO: 39863 - DNA, 22 bp, Homo sapiens
tgatcatcgacacttcgaacgc

SEQ ID NO: 39864 - DNA, 23 bp, Homo sapiens
tgatcatcgacacttcgaacgca

SEQ ID NO: 39865 - DNA, 24 bp, Homo sapiens
tgatcatcgacacttcgaacgcac

SEQ ID NO: 39866 - DNA, 25 bp, Homo sapiens
tgatcatcgacacttcgaacgcact

SEQ ID NO: 39867 - DNA, 26 bp, Homo sapiens
tgatcatcgacacttcgaacgcactt

SEQ ID NO: 39868 - DNA, 27 bp, Homo sapiens
tgatcatcgacacttcgaacgcacttg

SEQ ID NO: 39869 - DNA, 30 bp, Homo sapiens
tgatcatcgacacttcgaacgcacttgcgg

SEQ ID NO: 39870 - DNA, 16 bp, Homo sapiens
gatcatcgacacttcg

SEQ ID NO: 39871 - DNA, 18 bp, Homo sapiens
gatcatcgacacttcgaa

SEQ ID NO: 39872 - DNA, 19 bp, Homo sapiens
gatcatcgacacttcgaac

SEQ ID NO: 39873 - DNA, 20 bp, Homo sapiens
gatcatcgacacttcgaacg

SEQ ID NO: 39874 - DNA, 21 bp, Homo sapiens
gatcatcgacacttcgaacgc

SEQ ID NO: 39875 - DNA, 22 bp, Homo sapiens
gatcatcgacacttcgaacgca

SEQ ID NO: 39876 - DNA, 23 bp, Homo sapiens
gatcatcgacacttcgaacgcac

SEQ ID NO: 39877 - DNA, 24 bp, Homo sapiens
gatcatcgacacttcgaacgcact

SEQ ID NO: 39878 - DNA, 25 bp, Homo sapiens
gatcatcgacacttcgaacgcactt

SEQ ID NO: 39879 - DNA, 30 bp, Homo sapiens; identical to SEQ ID NO: 29360

SEQ ID NO: 39880 - DNA, 19 bp, Homo sapiens
atcatcgacacttcgaacg

SEQ ID NO: 39881 - DNA, 20 bp, Homo sapiens
atcatcgacacttcgaacgc

SEQ ID NO: 39882 - DNA, 23 bp, Homo sapiens
atcatcgacacttcgaacgcact

SEQ ID NO: 39883 - DNA, 17 bp, Homo sapiens
catcgacacttcgaacg

SEQ ID NO: 39884 - DNA, 18 bp, Homo sapiens
catcgacacttcgaacgc

SEQ ID NO: 39885 - DNA, 19 bp, Homo sapiens
catcgacacttcgaacgca

SEQ ID NO: 39886 - DNA, 20 bp, Homo sapiens
catcgacacttcgaacgcac

SEQ ID NO: 39887 - DNA, 21 bp, Homo sapiens
catcgacacttcgaacgcact

SEQ ID NO: 39888 - DNA, 22 bp, Homo sapiens
catcgacacttcgaacgcactt

SEQ ID NO: 39889 - DNA, 17 bp, Homo sapiens
atcgacacttcgaacgc

SEQ ID NO: 39890 - DNA, 19 bp, Homo sapiens
atcgacacttcgaacgcac

SEQ ID NO: 39891 - DNA, 30 bp, Homo sapiens; identical to SEQ ID NO: 3684

SEQ ID NO: 39892 - DNA, 16 bp, Homo sapiens
cgacacttcgaacgca

SEQ ID NO: 39893 - DNA, 17 bp, Homo sapiens
cgacacttcgaacgcac

SEQ ID NO: 39894 - DNA, 18 bp, Homo sapiens
cgacacttcgaacgcact

SEQ ID NO: 39895 - DNA, 19 bp, Homo sapiens
cgacacttcgaacgcactt

SEQ ID NO: 39896 - DNA, 20 bp, Homo sapiens
cgacacttcgaacgcacttg

SEQ ID NO: 39897 - DNA, 24 bp, Homo sapiens
cgacacttcgaacgcacttgcggc

SEQ ID NO: 39898 - DNA, 25 bp, Homo sapiens
cgacacttcgaacgcacttgcggcc

SEQ ID NO: 39899 - DNA, 30 bp, Homo sapiens; identical to SEQ ID NO: 3698

SEQ ID NO: 39900 - DNA, 17 bp, Homo sapiens
gacacttcgaacgcact

SEQ ID NO: 39901 - DNA, 19 bp, Homo sapiens
gacacttcgaacgcacttg

SEQ ID NO: 39902 - DNA, 20 bp, Homo sapiens
gacacttcgaacgcacttgc

SEQ ID NO: 39903 - DNA, 22 bp, Homo sapiens
gacacttcgaacgcacttgcgg

SEQ ID NO: 39904 - DNA, 23 bp, Homo sapiens
gacacttcgaacgcacttgcggc

SEQ ID NO: 39905 - DNA, 24 bp, Homo sapiens
gacacttcgaacgcacttgcggcc

SEQ ID NO: 39906 - DNA, 25 bp, Homo sapiens
gacacttcgaacgcacttgcggccc

SEQ ID NO: 39907 - DNA, 26 bp, Homo sapiens
gacacttcgaacgcacttgcggcccc

SEQ ID NO: 39908 - DNA, 27 bp, Homo sapiens
gacacttcgaacgcacttgcggccccg

SEQ ID NO: 39909 - DNA, 28 bp, Homo sapiens
gacacttcgaacgcacttgcggccccgg

SEQ ID NO: 39910 - DNA, 29 bp, Homo sapiens
gacacttcgaacgcacttgcggccccggg

SEQ ID NO: 39911 - DNA, 30 bp, Homo sapiens; identical to SEQ ID NO: 3706

SEQ ID NO: 39912 - DNA, 22 bp, Homo sapiens
acacttcgaacgcacttgcggc

SEQ ID NO: 39913 - DNA, 26 bp, Homo sapiens
acacttcgaacgcacttgcggccccg

SEQ ID NO: 39914 - DNA, 30 bp, Homo sapiens; identical to SEQ ID NO: 17900

SEQ ID NO: 39915 - DNA, 20 bp, Homo sapiens
acttcgaacgcacttgcggc

SEQ ID NO: 39916 - DNA, 24 bp, Homo sapiens
acttcgaacgcacttgcggccccg

SEQ ID NO: 39917 - DNA, 25 bp, Homo sapiens
acttcgaacgcacttgcggccccgg

SEQ ID NO: 39918 - DNA, 18 bp, Homo sapiens
cttcgaacgcacttgcgg

SEQ ID NO: 39919 - DNA, 19 bp, Homo sapiens
cttcgaacgcacttgcggc

SEQ ID NO: 39920 - DNA, 20 bp, Homo sapiens
cttcgaacgcacttgcggcc

SEQ ID NO: 39921 - DNA, 21 bp, Homo sapiens
cttcgaacgcacttgcggccc

SEQ ID NO: 39922 - DNA, 22 bp, Homo sapiens
cttcgaacgcacttgcggcccc

SEQ ID NO: 39923 - DNA, 23 bp, Homo sapiens
cttcgaacgcacttgcggccccg

SEQ ID NO: 39924 - DNA, 24 bp, Homo sapiens
cttcgaacgcacttgcggccccgg

SEQ ID NO: 39925 - DNA, 25 bp, Homo sapiens
cttcgaacgcacttgcggccccggg

SEQ ID NO: 39926 - DNA, 26 bp, Homo sapiens
cttcgaacgcacttgcggccccgggt

SEQ ID NO: 39927 - DNA, 27 bp, Homo sapiens
cttcgaacgcacttgcggccccgggtt

SEQ ID NO: 39928 - DNA, 30 bp, Homo sapiens; identical to SEQ ID NO: 17921

SEQ ID NO: 39929 - DNA, 22 bp, Homo sapiens
ttcgaacgcacttgcggccccg

SEQ ID NO: 39930 - DNA, 23 bp, Homo sapiens
ttcgaacgcacttgcggccccgg

SEQ ID NO: 39931 - DNA, 24 bp, Homo sapiens
tcgaacgcacttgcggccccgggt

SEQ ID NO: 39932 - DNA, 30 bp, Homo sapiens; identical to SEQ ID NO: 17942

SEQ ID NO: 39933 - DNA, 19 bp, Homo sapiens
gaacgcacttgcggccccg

SEQ ID NO: 39934 - DNA, 20 bp, Homo sapiens
gaacgcacttgcggccccgg

SEQ ID NO: 39935 - DNA, 22 bp, Homo sapiens
gaacgcacttgcggccccgggt

SEQ ID NO: 39936 - DNA, 23 bp, Homo sapiens
gaacgcacttgcggccccgggtt

SEQ ID NO: 39937 - DNA, 30 bp, Homo sapiens; identical to SEQ ID NO: 29362

SEQ ID NO: 39938 - DNA, 18 bp, Homo sapiens
aacgcacttgcggccccg

SEQ ID NO: 39939 - DNA, 19 bp, Homo sapiens
aacgcacttgcggccccgg

SEQ ID NO: 39940 - DNA, 16 bp, Homo sapiens
gcacttgcggccccgg

SEQ ID NO: 39941 - DNA, 17 bp, Homo sapiens
gcacttgcggccccggg

SEQ ID NO: 39942 - DNA, 18 bp, Homo sapiens
gcacttgcggccccgggt

SEQ ID NO: 39943 - DNA, 19 bp, Homo sapiens
gcacttgcggccccgggtt

SEQ ID NO: 39944 - DNA, 30 bp, Homo sapiens
gcacttgcggccccgggttcctcccggggc

SEQ ID NO: 39945 - DNA, 21 bp, Homo sapiens
cacttgcggccccgggttcct

SEQ ID NO: 39946 - DNA, 30 bp, Homo sapiens
tgcggccccgggttcctcccggggctacgc

SEQ ID NO: 39947 - DNA, 20 bp, Homo sapiens
gcggccccgggttcctcccg

SEQ ID NO: 39948 - DNA, 30 bp, Homo sapiens
gcggccccgggttcctcccggggctacgcc

SEQ ID NO: 39949 - DNA, 22 bp, Homo sapiens
gttcctcccggggctacgcctg

SEQ ID NO: 39950 - DNA, 30 bp, Homo sapiens; identical to SEQ ID NO: 17983

SEQ ID NO: 39951 - DNA, 26 bp, Homo sapiens
tcctcccggggctacgcctgtctgag

SEQ ID NO: 39952 - DNA, 30 bp, Homo sapiens; identical to SEQ ID NO: 3739

SEQ ID NO: 39953 - DNA, 30 bp, Homo sapiens
cctcccggggctacgcctgtctgagcgtcg

SEQ ID NO: 39954 - DNA, 30 bp, Homo sapiens; identical to SEQ ID NO: 18013

SEQ ID NO: 39955 - DNA, 23 bp, Homo sapiens
tcccggggctacgcctgtctgag

SEQ ID NO: 39956 - DNA, 29 bp, Homo sapiens
tcccggggctacgcctgtctgagcgtcgc

SEQ ID NO: 39957 - DNA, 22 bp, Homo sapiens
cccggggctacgcctgtctgag

SEQ ID NO: 39958 - DNA, 23 bp, Homo sapiens
cccggggctacgcctgtctgagc

SEQ ID NO: 39959 - DNA, 24 bp, Homo sapiens
cccggggctacgcctgtctgagcg

SEQ ID NO: 39960 - DNA, 25 bp, Homo sapiens
cccggggctacgcctgtctgagcgt

SEQ ID NO: 39961 - DNA, 26 bp, Homo sapiens
cccggggctacgcctgtctgagcgtc

SEQ ID NO: 39962 - DNA, 27 bp, Homo sapiens
cccggggctacgcctgtctgagcgtcg

SEQ ID NO: 39963 - DNA, 28 bp, Homo sapiens
cccggggctacgcctgtctgagcgtcgc

SEQ ID NO: 39964 - DNA, 29 bp, Homo sapiens
cccggggctacgcctgtctgagcgtcgct

SEQ ID NO: 39965 - DNA, 21 bp, Homo sapiens
ccggggctacgcctgtctgag

SEQ ID NO: 39966 - DNA, 23 bp, Homo sapiens
ccggggctacgcctgtctgagcg

SEQ ID NO: 39967 - DNA, 24 bp, Homo sapiens
ccggggctacgcctgtctgagcgt

SEQ ID NO: 39968 - DNA, 25 bp, Homo sapiens
ccggggctacgcctgtctgagcgtc

SEQ ID NO: 39969 - DNA, 26 bp, Homo sapiens
ccggggctacgcctgtctgagcgtcg

SEQ ID NO: 39970 - DNA, 27 bp, Homo sapiens
ccggggctacgcctgtctgagcgtcgc

SEQ ID NO: 39971 - DNA, 28 bp, Homo sapiens
ccggggctacgcctgtctgagcgtcgct

SEQ ID NO: 39972 - DNA, 29 bp, Homo sapiens
ccggggctacgcctgtctgagcgtcgctt

SEQ ID NO: 39973 - DNA, 20 bp, Homo sapiens
cggggctacgcctgtctgag

SEQ ID NO: 39974 - DNA, 22 bp, Homo sapiens
cggggctacgcctgtctgagcg

SEQ ID NO: 39975 - DNA, 23 bp, Homo sapiens
cggggctacgcctgtctgagcgt

SEQ ID NO: 39976 - DNA, 25 bp, Homo sapiens
cggggctacgcctgtctgagcgtcg

SEQ ID NO: 39977 - DNA, 26 bp, Homo sapiens
cggggctacgcctgtctgagcgtcgc

SEQ ID NO: 39978 - DNA, 27 bp, Homo sapiens
cggggctacgcctgtctgagcgtcgct

SEQ ID NO: 39979 - DNA, 19 bp, Homo sapiens
ggggctacgcctgtctgag

SEQ ID NO: 39980 - DNA, 20 bp, Homo sapiens
ggggctacgcctgtctgagc

SEQ ID NO: 39981 - DNA, 21 bp, Homo sapiens
ggggctacgcctgtctgagcg

SEQ ID NO: 39982 - DNA, 22 bp, Homo sapiens
ggggctacgcctgtctgagcgt

SEQ ID NO: 39983 - DNA, 23 bp, Homo sapiens
ggggctacgcctgtctgagcgtc

SEQ ID NO: 39984 - DNA, 24 bp, Homo sapiens
ggggctacgcctgtctgagcgtcg

SEQ ID NO: 39985 - DNA, 25 bp, Homo sapiens
ggggctacgcctgtctgagcgtcgc

SEQ ID NO: 39986 - DNA, 26 bp, Homo sapiens
ggggctacgcctgtctgagcgtcgct

SEQ ID NO: 39987 - DNA, 18 bp, Homo sapiens
gggctacgcctgtctgag

SEQ ID NO: 39988 - DNA, 20 bp, Homo sapiens
gggctacgcctgtctgagcg

SEQ ID NO: 39989 - DNA, 22 bp, Homo sapiens
gggctacgcctgtctgagcgtc

SEQ ID NO: 39990 - DNA, 23 bp, Homo sapiens
gggctacgcctgtctgagcgtcg

SEQ ID NO: 39991 - DNA, 24 bp, Homo sapiens
gggctacgcctgtctgagcgtcgc

SEQ ID NO: 39992 - DNA, 25 bp, Homo sapiens
gggctacgcctgtctgagcgtcgct

SEQ ID NO: 39993 - DNA, 17 bp, Homo sapiens
ggctacgcctgtctgag

SEQ ID NO: 39994 - DNA, 18 bp, Homo sapiens
ggctacgcctgtctgagc

SEQ ID NO: 39995 - DNA, 19 bp, Homo sapiens
ggctacgcctgtctgagcg

SEQ ID NO: 39996 - DNA, 21 bp, Homo sapiens
ggctacgcctgtctgagcgtc

SEQ ID NO: 39997 - DNA, 22 bp, Homo sapiens
ggctacgcctgtctgagcgtcg

SEQ ID NO: 39998 - DNA, 23 bp, Homo sapiens
ggctacgcctgtctgagcgtcgc

SEQ ID NO: 39999 - DNA, 24 bp, Homo sapiens
ggctacgcctgtctgagcgtcgct

SEQ ID NO: 40000 - DNA, 16 bp, Homo sapiens
gctacgcctgtctgag

SEQ ID NO: 40001 - DNA, 17 bp, Homo sapiens
gctacgcctgtctgagc

SEQ ID NO: 40002 - DNA, 18 bp, Homo sapiens
gctacgcctgtctgagcg

SEQ ID NO: 40003 - DNA, 19 bp, Homo sapiens
gctacgcctgtctgagcgt

SEQ ID NO: 40004 - DNA, 21 bp, Homo sapiens
gctacgcctgtctgagcgtcg

SEQ ID NO: 40005 - DNA, 22 bp, Homo sapiens
gctacgcctgtctgagcgtcgc

SEQ ID NO: 40006 - DNA, 23 bp, Homo sapiens
gctacgcctgtctgagcgtcgct

SEQ ID NO: 40007 - DNA, 24 bp, Homo sapiens
gctacgcctgtctgagcgtcgctt

SEQ ID NO: 40008 - DNA, 25 bp, Homo sapiens
gctacgcctgtctgagcgtcgcttg

SEQ ID NO: 40009 - DNA, 16 bp, Homo sapiens
ctacgcctgtctgagc

SEQ ID NO: 40010 - DNA, 20 bp, Homo sapiens
ctacgcctgtctgagcgtcg

SEQ ID NO: 40011 - DNA, 21 bp, Homo sapiens
ctacgcctgtctgagcgtcgc

SEQ ID NO: 40012 - DNA, 22 bp, Homo sapiens
ctacgcctgtctgagcgtcgct

SEQ ID NO: 40013 - DNA, 23 bp, Homo sapiens
ctacgcctgtctgagcgtcgctt

SEQ ID NO: 40014 - DNA, 20 bp, Homo sapiens
tacgcctgtctgagcgtcgc

SEQ ID NO: 40015 - DNA, 21 bp, Homo sapiens
tacgcctgtctgagcgtcgct

SEQ ID NO: 40016 - DNA, 22 bp, Homo sapiens
tacgcctgtctgagcgtcgctt

SEQ ID NO: 40017 - DNA, 23 bp, Homo sapiens
tacgcctgtctgagcgtcgcttg

SEQ ID NO: 40018 - DNA, 17 bp, Homo sapiens
acgcctgtctgagcgtc

SEQ ID NO: 40019 - DNA, 18 bp, Homo sapiens
acgcctgtctgagcgtcg

SEQ ID NO: 40020 - DNA, 19 bp, Homo sapiens
acgcctgtctgagcgtcgc

SEQ ID NO: 40021 - DNA, 20 bp, Homo sapiens
acgcctgtctgagcgtcgct

SEQ ID NO: 40022 - DNA, 21 bp, Homo sapiens
acgcctgtctgagcgtcgctt

SEQ ID NO: 40023 - DNA, 17 bp, Homo sapiens
cgcctgtctgagcgtcg

SEQ ID NO: 40024 - DNA, 18 bp, Homo sapiens
cgcctgtctgagcgtcgc

SEQ ID NO: 40025 - DNA, 19 bp, Homo sapiens
cgcctgtctgagcgtcgct

SEQ ID NO: 40026 - DNA, 20 bp, Homo sapiens
cgcctgtctgagcgtcgctt

SEQ ID NO: 40027 - DNA, 21 bp, Homo sapiens
cgcctgtctgagcgtcgcttg

SEQ ID NO: 40028 - DNA, 22 bp, Homo sapiens
cgcctgtctgagcgtcgcttgc

SEQ ID NO: 40029 - DNA, 16 bp, Homo sapiens
gcctgtctgagcgtcg

SEQ ID NO: 40030 - DNA, 17 bp, Homo sapiens
gcctgtctgagcgtcgc

SEQ ID NO: 40031 - DNA, 18 bp, Homo sapiens
gcctgtctgagcgtcgct

SEQ ID NO: 40032 - DNA, 19 bp, Homo sapiens
gcctgtctgagcgtcgctt

SEQ ID NO: 40033 - DNA, 20 bp, Homo sapiens
gcctgtctgagcgtcgcttg

SEQ ID NO: 40034 - DNA, 16 bp, Homo sapiens
cctgtctgagcgtcgc

SEQ ID NO: 40035 - DNA, 17 bp, Homo sapiens
cctgtctgagcgtcgct

SEQ ID NO: 40036 - DNA, 18 bp, Homo sapiens
cctgtctgagcgtcgctt

SEQ ID NO: 40037 - DNA, 19 bp, Homo sapiens
cctgtctgagcgtcgcttg

SEQ ID NO: 40038 - DNA, 20 bp, Homo sapiens
cctgtctgagcgtcgcttgc

SEQ ID NO: 40039 - DNA, 23 bp, Homo sapiens
cctgtctgagcgtcgcttgccga

SEQ ID NO: 40040 - DNA, 16 bp, Homo sapiens
ctgtctgagcgtcgct

SEQ ID NO: 40041 - DNA, 17 bp, Homo sapiens
ctgtctgagcgtcgctt

SEQ ID NO: 40042 - DNA, 18 bp, Homo sapiens
ctgtctgagcgtcgcttg

SEQ ID NO: 40043 - DNA, 19 bp, Homo sapiens
ctgtctgagcgtcgcttgc

SEQ ID NO: 40044 - DNA, 20 bp, Homo sapiens
ctgtctgagcgtcgcttgcc

SEQ ID NO: 40045 - DNA, 16 bp, Homo sapiens
tgtctgagcgtcgctt

SEQ ID NO: 40046 - DNA, 17 bp, Homo sapiens
tgtctgagcgtcgcttg

SEQ ID NO: 40047 - DNA, 18 bp, Homo sapiens
tgtctgagcgtcgcttgc

SEQ ID NO: 40048 - DNA, 16 bp, Homo sapiens
gtctgagcgtcgcttg

SEQ ID NO: 40049 - DNA, 17 bp, Homo sapiens
gtctgagcgtcgcttgc

SEQ ID NO: 40050 - DNA, 30 bp, Homo sapiens
ggtgcgcggctgggggttccctcgcagggc

SEQ ID NO: 40051 - DNA, 25 bp, Homo sapiens
ccctccgtccccctaagcgcagacc

SEQ ID NO: 40052 - DNA, 26 bp, Homo sapiens
ccctccgtccccctaagcgcagaccc

SEQ ID NO: 40053 - DNA, 22 bp, Homo sapiens
cctccgtccccctaagcgcaga

SEQ ID NO: 40054 - DNA, 19 bp, Homo sapiens
cgcgcccgccccttccccc

SEQ ID NO: 40055 - DNA, 21 bp, Homo sapiens
cttccccctccccccgcgggc

SEQ ID NO: 40056 - DNA, 23 bp, Homo sapiens
ggccctgcgtggtcacgcgtcgg

SEQ ID NO: 40057 - DNA, 17 bp, Homo sapiens
cgggggggagagggggg

SEQ ID NO: 40058 - DNA, 19 bp, Homo sapiens
gggggggagaggggggcgc

SEQ ID NO: 40059 - DNA, 28 bp, Homo sapiens
ggctgagagagacggggagggcggcgcc

SEQ ID NO: 40060 - DNA, 23 bp, Homo sapiens
gacggggagggcggcgccgccgc

SEQ ID NO: 40061 - DNA, 19 bp, Homo sapiens
ggagagggaaagagagagc

SEQ ID NO: 40062 - DNA, 22 bp, Homo sapiens
ggagagggaaagagagagccgg

SEQ ID NO: 40063 - DNA, 23 bp, Homo sapiens
ggagagggaaagagagagccggc

SEQ ID NO: 40064 - DNA, 22 bp, Homo sapiens
gagagggaaagagagagccggc

SEQ ID NO: 40065 - DNA, 17 bp, Homo sapiens
ggccgagttcccgtggc

SEQ ID NO: 40066 - DNA, 18 bp, Homo sapiens
gggttcggggttcgtcgg

SEQ ID NO: 40067 - DNA, 20 bp, Homo sapiens
ggttcgtcggccccggccgg

SEQ ID NO: 40068 - DNA, 21 bp, Homo sapiens
cgggtggaaggtcccgtgccc

SEQ ID NO: 40069 - DNA, 27 bp, Homo sapiens
gggtggaaggtcccgtgcccgtcgtcg

SEQ ID NO: 40070 - DNA, 21 bp, Homo sapiens
ggtcccgtgcccgtcgtcgtc

SEQ ID NO: 40071 - DNA, 18 bp, Homo sapiens
gtcccgtgcccgtcgtcg

SEQ ID NO: 40072 - DNA, 19 bp, Homo sapiens
gtcccgtgcccgtcgtcgt

SEQ ID NO: 40073 - DNA, 20 bp, Homo sapiens
gtcccgtgcccgtcgtcgtc

SEQ ID NO: 40074 - DNA, 21 bp, Homo sapiens
gtcccgtgcccgtcgtcgtcg

SEQ ID NO: 40075 - DNA, 22 bp, Homo sapiens
gtcccgtgcccgtcgtcgtcgt

SEQ ID NO: 40076 - DNA, 23 bp, Homo sapiens
gtcccgtgcccgtcgtcgtcgtc

SEQ ID NO: 40077 - DNA, 20 bp, Homo sapiens
tcccgtgcccgtcgtcgtcg

SEQ ID NO: 40078 - DNA, 22 bp, Homo sapiens
tcccgtgcccgtcgtcgtcgtc

SEQ ID NO: 40079 - DNA, 23 bp, Homo sapiens
tcccgtgcccgtcgtcgtcgtcg

SEQ ID NO: 40080 - DNA, 20 bp, Homo sapiens
ccgtgcccgtcgtcgtcgtc

SEQ ID NO: 40081 - DNA, 19 bp, Homo sapiens
cgtgcccgtcgtcgtcgtc

SEQ ID NO: 40082 - DNA, 23 bp, Homo sapiens
cgtgcccgtcgtcgtcgtcgtcg

SEQ ID NO: 40083 - DNA, 18 bp, Homo sapiens
gtgcccgtcgtcgtcgtc

SEQ ID NO: 40084 - DNA, 22 bp, Homo sapiens
gtgcccgtcgtcgtcgtcgtcg

SEQ ID NO: 40085 - DNA, 17 bp, Homo sapiens
cgtcgtcgtcgtcgtcg

SEQ ID NO: 40086 - DNA, 20 bp, Homo sapiens
cgtcgtcgtcgtcgtcgtcg

SEQ ID NO: 40087 - DNA, 17 bp, Homo sapiens
cgtcgtcgtcgtcgtcg

SEQ ID NO: 40088 - DNA, 19 bp, Homo sapiens
cgtcgtcgtcgtcgtcgcg

SEQ ID NO: 40089 - DNA, 21 bp, Homo sapiens
gtcgtcgtcgcgcgtcgtcgg

SEQ ID NO: 40090 - DNA, 20 bp, Homo sapiens
tcgtcgtcgcgcgtcgtcgg

SEQ ID NO: 40091 - DNA, 21 bp, Homo sapiens
tcgtcgtcgcgcgtcgtcggc

SEQ ID NO: 40092 - DNA, 18 bp, Homo sapiens
gtcgtcgcgcgtcgtcgg

SEQ ID NO: 40093 - DNA, 23 bp, Homo sapiens
gtcgtcgcgcgtcgtcggcggtg

SEQ ID NO: 40094 - DNA, 24 bp, Homo sapiens
gtcgtcgcgcgtcgtcggcggtgg

SEQ ID NO: 40095 - DNA, 22 bp, Homo sapiens
tcgtcgcgcgtcgtcggcggtg

SEQ ID NO: 40096 - DNA, 23 bp, Homo sapiens
tcgtcgcgcgtcgtcggcggtgg

SEQ ID NO: 40097 - DNA, 21 bp, Homo sapiens
cgtcgcgcgtcgtcggcggtg

SEQ ID NO: 40098 - DNA, 22 bp, Homo sapiens
cgtcgcgcgtcgtcggcggtgg

SEQ ID NO: 40099 - DNA, 18 bp, Homo sapiens
gtcgcgcgtcgtcggcgg

SEQ ID NO: 40100 - DNA, 20 bp, Homo sapiens
gtcgcgcgtcgtcggcggtg

SEQ ID NO: 40101 - DNA, 21 bp, Homo sapiens
gtcgcgcgtcgtcggcggtgg

SEQ ID NO: 40102 - DNA, 22 bp, Homo sapiens
gtcgcgcgtcgtcggcggtggg

SEQ ID NO: 40103 - DNA, 16 bp, Homo sapiens
tcgcgcgtcgtcggcg

SEQ ID NO: 40104 - DNA, 19 bp, Homo sapiens
tcgcgcgtcgtcggcggtg

SEQ ID NO: 40105 - DNA, 20 bp, Homo sapiens
tcgcgcgtcgtcggcggtgg

SEQ ID NO: 40106 - DNA, 21 bp, Homo sapiens
tcgcgcgtcgtcggcggtggg

SEQ ID NO: 40107 - DNA, 22 bp, Homo sapiens
tcgcgcgtcgtcggcggtgggg

SEQ ID NO: 40108 - DNA, 23 bp, Homo sapiens
tcgcgcgtcgtcggcggtggggg

SEQ ID NO: 40109 - DNA, 24 bp, Homo sapiens
tcgcgcgtcgtcggcggtgggggc

SEQ ID NO: 40110 - DNA, 25 bp, Homo sapiens
tcgcgcgtcgtcggcggtgggggcg

SEQ ID NO: 40111 - DNA, 18 bp, Homo sapiens
cgcgcgtcgtcggcggtg

SEQ ID NO: 40112 - DNA, 17 bp, Homo sapiens
gcgcgtcgtcggcggtg

SEQ ID NO: 40113 - DNA, 18 bp, Homo sapiens
gcgcgtcgtcggcggtgg

SEQ ID NO: 40114 - DNA, 19 bp, Homo sapiens
gcgcgtcgtcggcggtggg

SEQ ID NO: 40115 - DNA, 20 bp, Homo sapiens
gcgcgtcgtcggcggtgggg

SEQ ID NO: 40116 - DNA, 21 bp, Homo sapiens
gcgcgtcgtcggcggtggggg

SEQ ID NO: 40117 - DNA, 22 bp, Homo sapiens
gcgcgtcgtcggcggtgggggc

SEQ ID NO: 40118 - DNA, 23 bp, Homo sapiens
gcgcgtcgtcggcggtgggggcg

SEQ ID NO: 40119 - DNA, 16 bp, Homo sapiens
cgcgtcgtcggcggtg

SEQ ID NO: 40120 - DNA, 17 bp, Homo sapiens
cgcgtcgtcggcggtgg

SEQ ID NO: 40121 - DNA, 18 bp, Homo sapiens
cgcgtcgtcggcggtggg

SEQ ID NO: 40122 - DNA, 19 bp, Homo sapiens
cgcgtcgtcggcggtgggg

SEQ ID NO: 40123 - DNA, 20 bp, Homo sapiens
cgcgtcgtcggcggtggggg

SEQ ID NO: 40124 - DNA, 21 bp, Homo sapiens
cgcgtcgtcggcggtgggggc

SEQ ID NO: 40125 - DNA, 22 bp, Homo sapiens
cgcgtcgtcggcggtgggggcg

SEQ ID NO: 40126 - DNA, 24 bp, Homo sapiens
cgcgtcgtcggcggtgggggcgtg

SEQ ID NO: 40127 - DNA, 16 bp, Homo sapiens
gcgtcgtcggcggtgg

SEQ ID NO: 40128 - DNA, 19 bp, Homo sapiens
gcgtcgtcggcggtggggg

SEQ ID NO: 40129 - DNA, 20 bp, Homo sapiens
gcgtcgtcggcggtgggggc

SEQ ID NO: 40130 - DNA, 21 bp, Homo sapiens
gcgtcgtcggcggtgggggcg

SEQ ID NO: 40131 - DNA, 19 bp, Homo sapiens
cgtcgtcggcggtgggggc

SEQ ID NO: 40132 - DNA, 20 bp, Homo sapiens
cgtcgtcggcggtgggggcg

SEQ ID NO: 40133 - DNA, 26 bp, Homo sapiens
gtggtggtgggggaggaggaaggcgg

SEQ ID NO: 40134 - DNA, 17 bp, Homo sapiens
ggtccggaaggggaagg

SEQ ID NO: 40135 - DNA, 21 bp, Homo sapiens
ggtccggaaggggaagggtgc

SEQ ID NO: 40136 - DNA, 21 bp, Homo sapiens
ggaaggggaagggtgccggcg

SEQ ID NO: 40137 - DNA, 22 bp, Homo sapiens
gcggggagagagggtcggggga

SEQ ID NO: 40138 - DNA, 23 bp, Homo sapiens
gcggggagagagggtcgggggag

SEQ ID NO: 40139 - DNA, 20 bp, Homo sapiens
cggggagagagggtcggggg

SEQ ID NO: 40140 - DNA, 21 bp, Homo sapiens
cggggagagagggtcggggga

SEQ ID NO: 40141 - DNA, 22 bp, Homo sapiens
cggggagagagggtcgggggag

SEQ ID NO: 40142 - DNA, 18 bp, Homo sapiens
gagggtcgggggagcgcg

SEQ ID NO: 40143 - DNA, 20 bp, Homo sapiens
gtcccggtcgccgcggttcg

SEQ ID NO: 40144 - DNA, 23 bp, Homo sapiens
gtcccggtcgccgcggttcgccg

SEQ ID NO: 40145 - DNA, 21 bp, Homo sapiens
cccggtcgccgcggttcgccg

SEQ ID NO: 40146 - DNA, 24 bp, Homo sapiens
cccggtcgccgcggttcgccgccc

SEQ ID NO: 40147 - DNA, 21 bp, Homo sapiens
ccggtcgccgcggttcgccgc

SEQ ID NO: 40148 - DNA, 23 bp, Homo sapiens
ccggtcgccgcggttcgccgccc

SEQ ID NO: 40149 - DNA, 16 bp, Homo sapiens
ggtcgccgcggttcgc

SEQ ID NO: 40150 - DNA, 20 bp, Homo sapiens
ggtcgccgcggttcgccgcc

SEQ ID NO: 40151 - DNA, 21 bp, Homo sapiens
ggtcgccgcggttcgccgccc

SEQ ID NO: 40152 - DNA, 23 bp, Homo sapiens
ggtcgccgcggttcgccgcccgc

SEQ ID NO: 40153 - DNA, 22 bp, Homo sapiens
gtcgccgcggttcgccgcccgc

SEQ ID NO: 40154 - DNA, 23 bp, Homo sapiens
gtcgccgcggttcgccgcccgcc

SEQ ID NO: 40155 - DNA, 24 bp, Homo sapiens
gtcgccgcggttcgccgcccgccc

SEQ ID NO: 40156 - DNA, 22 bp, Homo sapiens
ccggtggcggcccggcgtccgg

SEQ ID NO: 40157 - DNA, 23 bp, Homo sapiens
ccggtggcggcccggcgtccggc

SEQ ID NO: 40158 - DNA, 20 bp, Homo sapiens
cggtggcggcccggcgtccg

SEQ ID NO: 40159 - DNA, 21 bp, Homo sapiens
cggtggcggcccggcgtccgg

SEQ ID NO: 40160 - DNA, 22 bp, Homo sapiens
cggtggcggcccggcgtccggc

SEQ ID NO: 40161 - DNA, 20 bp, Homo sapiens
ggtggcggcccggcgtccgg

SEQ ID NO: 40162 - DNA, 21 bp, Homo sapiens
ggtggcggcccggcgtccggc

SEQ ID NO: 40163 - DNA, 19 bp, Homo sapiens
gtggcggcccggcgtccgg

SEQ ID NO: 40164 - DNA, 20 bp, Homo sapiens
gtggcggcccggcgtccggc

SEQ ID NO: 40165 - DNA, 18 bp, Homo sapiens
ccgctcccgcgcccctcc

SEQ ID NO: 40166 - DNA, 17 bp, Homo sapiens
ccccgccgcccctcctc

SEQ ID NO: 40167 - DNA, 18 bp, Homo sapiens
ccccgccgcccctcctcc

SEQ ID NO: 40168 - DNA, 16 bp, Homo sapiens
cccgccgcccctcctc

SEQ ID NO: 40169 - DNA, 17 bp, Homo sapiens
cccgccgcccctcctcc

SEQ ID NO: 40170 - DNA, 16 bp, Homo sapiens
ccgccgcccctcctcc

SEQ ID NO: 40171 - DNA, 22 bp, Homo sapiens
cctcgccctccccgcgcgtacg

SEQ ID NO: 40172 - DNA, 20 bp, Homo sapiens
ctcgcctcgcggcgcgtcgg

SEQ ID NO: 40173 - DNA, 24 bp, Homo sapiens
ctcgcctcgcggcgcgtcggccgg

SEQ ID NO: 40174 - DNA, 23 bp, Homo sapiens
tcgcctcgcggcgcgtcggccgg

SEQ ID NO: 40175 - DNA, 22 bp, Homo sapiens
cgcctcgcggcgcgtcggccgg

SEQ ID NO: 40176 - DNA, 21 bp, Homo sapiens
gcctcgcggcgcgtcggccgg

SEQ ID NO: 40177 - DNA, 16 bp, Homo sapiens
cctcgcggcgcgtcgg

SEQ ID NO: 40178 - DNA, 20 bp, Homo sapiens
cctcgcggcgcgtcggccgg

SEQ ID NO: 40179 - DNA, 21 bp, Homo sapiens
cctcgcggcgcgtcggccggg

SEQ ID NO: 40180 - DNA, 19 bp, Homo sapiens
tcgcggcgcgtcggccggg

SEQ ID NO: 40181 - DNA, 20 bp, Homo sapiens
ccgtggccgcggcgccgggg

SEQ ID NO: 40182 - DNA, 19 bp, Homo sapiens
cgtggccgcggcgccgggg

SEQ ID NO: 40183 - DNA, 20 bp, Homo sapiens
cgtggccgcggcgccggggt

SEQ ID NO: 40184 - DNA, 21 bp, Homo sapiens
cgtggccgcggcgccggggtt

SEQ ID NO: 40185 - DNA, 18 bp, Homo sapiens
ggttcgcgtgtccccggc

SEQ ID NO: 40186 - DNA, 19 bp, Homo sapiens
ggttcgcgtgtccccggcg

SEQ ID NO: 40187 - DNA, 21 bp, Homo sapiens
ggttcgcgtgtccccggcggc

SEQ ID NO: 40188 - DNA, 22 bp, Homo sapiens
ggttcgcgtgtccccggcggcg

SEQ ID NO: 40189 - DNA, 21 bp, Homo sapiens
cgtgtccccggcggcgacccg

SEQ ID NO: 40190 - DNA, 21 bp, Homo sapiens
gccgcggtgtcgtccgccgtc

SEQ ID NO: 40191 - DNA, 19 bp, Homo sapiens
ctccggctcgcggccgcgc

SEQ ID NO: 40192 - DNA, 20 bp, Homo sapiens
cgggtcggggcgtgcggcgc

SEQ ID NO: 40193 - DNA, 17 bp, Homo sapiens
ggtcggggcgtgcggcg

SEQ ID NO: 40194 - DNA, 18 bp, Homo sapiens
ggtcggggcgtgcggcgc

SEQ ID NO: 40195 - DNA, 19 bp, Homo sapiens
ccgtcccgcccccggcccg

SEQ ID NO: 40196 - DNA, 18 bp, Homo sapiens
cctccctccggtcgtccc

SEQ ID NO: 40197 - DNA, 19 bp, Homo sapiens
cctccctccggtcgtcccg

SEQ ID NO: 40198 - DNA, 16 bp, Homo sapiens
ctccctccggtcgtcc

SEQ ID NO: 40199 - DNA, 17 bp, Homo sapiens
ctccctccggtcgtccc

SEQ ID NO: 40200 - DNA, 18 bp, Homo sapiens
ctccctccggtcgtcccg

SEQ ID NO: 40201 - DNA, 16 bp, Homo sapiens
tccctccggtcgtccc

SEQ ID NO: 40202 - DNA, 17 bp, Homo sapiens
tccctccggtcgtcccg

SEQ ID NO: 40203 - DNA, 19 bp, Homo sapiens
tccctccggtcgtcccgct

SEQ ID NO: 40204 - DNA, 20 bp, Homo sapiens
tccctccggtcgtcccgctc

SEQ ID NO: 40205 - DNA, 16 bp, Homo sapiens
ccctccggtcgtcccg

SEQ ID NO: 40206 - DNA, 17 bp, Homo sapiens
ccctccggtcgtcccgc

SEQ ID NO: 40207 - DNA, 18 bp, Homo sapiens
ccctccggtcgtcccgct

SEQ ID NO: 40208 - DNA, 19 bp, Homo sapiens
ccctccggtcgtcccgctc

SEQ ID NO: 40209 - DNA, 16 bp, Homo sapiens
cctccggtcgtcccgc

SEQ ID NO: 40210 - DNA, 17 bp, Homo sapiens
cctccggtcgtcccgct

SEQ ID NO: 40211 - DNA, 18 bp, Homo sapiens
cctccggtcgtcccgctc

SEQ ID NO: 40212 - DNA, 22 bp, Homo sapiens
cctccggtcgtcccgctccggc

SEQ ID NO: 40213 - DNA, 21 bp, Homo sapiens
ctccggtcgtcccgctccggc

SEQ ID NO: 40214 - DNA, 20 bp, Homo sapiens
tccggtcgtcccgctccggc

SEQ ID NO: 40215 - DNA, 17 bp, Homo sapiens
ggtcgtcccgctccggc

SEQ ID NO: 40216 - DNA, 19 bp, Homo sapiens
ggccgcgcgctctctctcc

SEQ ID NO: 40217 - DNA, 21 bp, Homo sapiens
ggccgcgcgctctctctcccg

SEQ ID NO: 40218 - DNA, 17 bp, Homo sapiens
cgacggagcgtcgggcg

SEQ ID NO: 40219 - DNA, 18 bp, Homo sapiens
cgacggagcgtcgggcgg

SEQ ID NO: 40220 - DNA, 19 bp, Homo sapiens
cgacggagcgtcgggcggg

SEQ ID NO: 40221 - DNA, 20 bp, Homo sapiens
cgacggagcgtcgggcgggc

SEQ ID NO: 40222 - DNA, 21 bp, Homo sapiens
cgacggagcgtcgggcgggcg

SEQ ID NO: 40223 - DNA, 22 bp, Homo sapiens
cgacggagcgtcgggcgggcgg

SEQ ID NO: 40224 - DNA, 23 bp, Homo sapiens
cgacggagcgtcgggcgggcggt

SEQ ID NO: 40225 - DNA, 16 bp, Homo sapiens
gacggagcgtcgggcg

SEQ ID NO: 40226 - DNA, 17 bp, Homo sapiens
gacggagcgtcgggcgg

SEQ ID NO: 40227 - DNA, 18 bp, Homo sapiens
gacggagcgtcgggcggg

SEQ ID NO: 40228 - DNA, 19 bp, Homo sapiens
gacggagcgtcgggcgggc

SEQ ID NO: 40229 - DNA, 20 bp, Homo sapiens
gacggagcgtcgggcgggcg

SEQ ID NO: 40230 - DNA, 21 bp, Homo sapiens
gacggagcgtcgggcgggcgg

SEQ ID NO: 40231 - DNA, 22 bp, Homo sapiens
gacggagcgtcgggcgggcggt

SEQ ID NO: 40232 - DNA, 23 bp, Homo sapiens
gacggagcgtcgggcgggcggtc

SEQ ID NO: 40233 - DNA, 16 bp, Homo sapiens
acggagcgtcgggcgg

SEQ ID NO: 40234 - DNA, 17 bp, Homo sapiens
acggagcgtcgggcggg

SEQ ID NO: 40235 - DNA, 18 bp, Homo sapiens
acggagcgtcgggcgggc

SEQ ID NO: 40236 - DNA, 19 bp, Homo sapiens
acggagcgtcgggcgggcg

SEQ ID NO: 40237 - DNA, 20 bp, Homo sapiens
acggagcgtcgggcgggcgg

SEQ ID NO: 40238 - DNA, 21 bp, Homo sapiens
acggagcgtcgggcgggcggt

SEQ ID NO: 40239 - DNA, 22 bp, Homo sapiens
acggagcgtcgggcgggcggtc

SEQ ID NO: 40240 - DNA, 23 bp, Homo sapiens
acggagcgtcgggcgggcggtcg

SEQ ID NO: 40241 - DNA, 24 bp, Homo sapiens
acggagcgtcgggcgggcggtcgg

SEQ ID NO: 40242 - DNA, 26 bp, Homo sapiens
acggagcgtcgggcgggcggtcgggc

SEQ ID NO: 40243 - DNA, 16 bp, Homo sapiens
cggagcgtcgggcggg

SEQ ID NO: 40244 - DNA, 17 bp, Homo sapiens
cggagcgtcgggcgggc

SEQ ID NO: 40245 - DNA, 18 bp, Homo sapiens
cggagcgtcgggcgggcg

SEQ ID NO: 40246 - DNA, 19 bp, Homo sapiens
cggagcgtcgggcgggcgg

SEQ ID NO: 40247 - DNA, 20 bp, Homo sapiens
cggagcgtcgggcgggcggt

SEQ ID NO: 40248 - DNA, 21 bp, Homo sapiens
cggagcgtcgggcgggcggtc

SEQ ID NO: 40249 - DNA, 22 bp, Homo sapiens
cggagcgtcgggcgggcggtcg

SEQ ID NO: 40250 - DNA, 16 bp, Homo sapiens
ggagcgtcgggcgggc

SEQ ID NO: 40251 - DNA, 17 bp, Homo sapiens
ggagcgtcgggcgggcg

SEQ ID NO: 40252 - DNA, 18 bp, Homo sapiens
ggagcgtcgggcgggcgg

SEQ ID NO: 40253 - DNA, 19 bp, Homo sapiens
ggagcgtcgggcgggcggt

SEQ ID NO: 40254 - DNA, 20 bp, Homo sapiens
ggagcgtcgggcgggcggtc

SEQ ID NO: 40255 - DNA, 21 bp, Homo sapiens
ggagcgtcgggcgggcggtcg

SEQ ID NO: 40256 - DNA, 16 bp, Homo sapiens
gagcgtcgggcgggcg

SEQ ID NO: 40257 - DNA, 17 bp, Homo sapiens
gagcgtcgggcgggcgg

SEQ ID NO: 40258 - DNA, 18 bp, Homo sapiens
gagcgtcgggcgggcggt

SEQ ID NO: 40259 - DNA, 19 bp, Homo sapiens
gagcgtcgggcgggcggtc

SEQ ID NO: 40260 - DNA, 20 bp, Homo sapiens
gagcgtcgggcgggcggtcg

SEQ ID NO: 40261 - DNA, 19 bp, Homo sapiens
agcgtcgggcgggcggtcg

SEQ ID NO: 40262 - DNA, 20 bp, Homo sapiens
agcgtcgggcgggcggtcgg

SEQ ID NO: 40263 - DNA, 20 bp, Homo sapiens
cgggcgggcggtcgggccgg

SEQ ID NO: 40264 - DNA, 21 bp, Homo sapiens
cgggcgggcggtcgggccggc

SEQ ID NO: 40265 - DNA, 22 bp, Homo sapiens
cgggcgggcggtcgggccggcg

SEQ ID NO: 40266 - DNA, 23 bp, Homo sapiens
cgggcgggcggtcgggccggcgc

SEQ ID NO: 40267 - DNA, 20 bp, Homo sapiens
ggcgggcggtcgggccggcg

SEQ ID NO: 40268 - DNA, 18 bp, Homo sapiens
gcgggcggtcgggccggc

SEQ ID NO: 40269 - DNA, 19 bp, Homo sapiens
gcgggcggtcgggccggcg

SEQ ID NO: 40270 - DNA, 20 bp, Homo sapiens
gcgggcggtcgggccggcgc

SEQ ID NO: 40271 - DNA, 18 bp, Homo sapiens
cgggcggtcgggccggcg

SEQ ID NO: 40272 - DNA, 20 bp, Homo sapiens
cgggcggtcgggccggcgcg

SEQ ID NO: 40273 - DNA, 21 bp, Homo sapiens
cgggcggtcgggccggcgcga

SEQ ID NO: 40274 - DNA, 22 bp, Homo sapiens
cgggcggtcgggccggcgcgat

SEQ ID NO: 40275 - DNA, 19 bp, Homo sapiens
ggcggtcgggccggcgcga

SEQ ID NO: 40276 - DNA, 16 bp, Homo sapiens
tccgtccgtccgtccg

SEQ ID NO: 40277 - DNA, 22 bp, Homo sapiens
tccgtccgtccgtccgccgagc

SEQ ID NO: 40278 - DNA, 21 bp, Homo sapiens
ccgtccgtccgtccgccgagc

SEQ ID NO: 40279 - DNA, 19 bp, Homo sapiens
cgtccgtccgtccgccgag

SEQ ID NO: 40280 - DNA, 20 bp, Homo sapiens
cgtccgtccgtccgccgagc

SEQ ID NO: 40281 - DNA, 19 bp, Homo sapiens
gtccgtccgtccgccgagc

SEQ ID NO: 40282 - DNA, 18 bp, Homo sapiens
tccgagacgcgacctcag

SEQ ID NO: 40283 - DNA, 19 bp, Homo sapiens
tccgagacgcgacctcaga

SEQ ID NO: 40284 - DNA, 21 bp, Homo sapiens
tccgagacgcgacctcagatc

SEQ ID NO: 40285 - DNA, 24 bp, Homo sapiens
tccgagacgcgacctcagatcaga

SEQ ID NO: 40286 - DNA, 30 bp, Homo sapiens; identical to SEQ ID NO: 3821

SEQ ID NO: 40287 - DNA, 18 bp, Homo sapiens
ccgagacgcgacctcaga

SEQ ID NO: 40288 - DNA, 20 bp, Homo sapiens
ccgagacgcgacctcagatc

SEQ ID NO: 40289 - DNA, 23 bp, Homo sapiens
ccgagacgcgacctcagatcaga

SEQ ID NO: 40290 - DNA, 30 bp, Homo sapiens
ccgagacgcgacctcagatcagacgtggcg

SEQ ID NO: 40291 - DNA, 17 bp, Homo sapiens
cgagacgcgacctcaga

SEQ ID NO: 40292 - DNA, 22 bp, Homo sapiens
cgagacgcgacctcagatcaga

SEQ ID NO: 40293 - DNA, 27 bp, Homo sapiens
cgagacgcgacctcagatcagacgtgg

SEQ ID NO: 40294 - DNA, 28 bp, Homo sapiens
cgagacgcgacctcagatcagacgtggc

SEQ ID NO: 40295 - DNA, 29 bp, Homo sapiens
cgagacgcgacctcagatcagacgtggcg

SEQ ID NO: 40296 - DNA, 21 bp, Homo sapiens
gagacgcgacctcagatcaga

SEQ ID NO: 40297 - DNA, 26 bp, Homo sapiens
gagacgcgacctcagatcagacgtgg

SEQ ID NO: 40298 - DNA, 27 bp, Homo sapiens
gagacgcgacctcagatcagacgtggc

SEQ ID NO: 40299 - DNA, 30 bp, Homo sapiens
gagacgcgacctcagatcagacgtggcgac

SEQ ID NO: 40300 - DNA, 20 bp, Homo sapiens
agacgcgacctcagatcaga

SEQ ID NO: 40301 - DNA, 22 bp, Homo sapiens
agacgcgacctcagatcagacg

SEQ ID NO: 40302 - DNA, 23 bp, Homo sapiens
agacgcgacctcagatcagacgt

SEQ ID NO: 40303 - DNA, 25 bp, Homo sapiens
agacgcgacctcagatcagacgtgg

SEQ ID NO: 40304 - DNA, 26 bp, Homo sapiens
agacgcgacctcagatcagacgtggc

SEQ ID NO: 40305 - DNA, 30 bp, Homo sapiens; identical to SEQ ID NO: 18175

SEQ ID NO: 40306 - DNA, 16 bp, Homo sapiens
gacgcgacctcagatc

SEQ ID NO: 40307 - DNA, 18 bp, Homo sapiens
gacgcgacctcagatcag

SEQ ID NO: 40308 - DNA, 19 bp, Homo sapiens
gacgcgacctcagatcaga

SEQ ID NO: 40309 - DNA, 20 bp, Homo sapiens
gacgcgacctcagatcagac

SEQ ID NO: 40310 - DNA, 21 bp, Homo sapiens
gacgcgacctcagatcagacg

SEQ ID NO: 40311 - DNA, 22 bp, Homo sapiens
gacgcgacctcagatcagacgt

SEQ ID NO: 40312 - DNA, 23 bp, Homo sapiens
gacgcgacctcagatcagacgtg

SEQ ID NO: 40313 - DNA, 24 bp, Homo sapiens
gacgcgacctcagatcagacgtgg

SEQ ID NO: 40314 - DNA, 25 bp, Homo sapiens
gacgcgacctcagatcagacgtggc

SEQ ID NO: 40315 - DNA, 26 bp, Homo sapiens
gacgcgacctcagatcagacgtggcg

SEQ ID NO: 40316 - DNA, 29 bp, Homo sapiens
gacgcgacctcagatcagacgtggcgacc

SEQ ID NO: 40317 - DNA, 30 bp, Homo sapiens; identical to SEQ ID NO: 3832

SEQ ID NO: 40318 - DNA, 17 bp, Homo sapiens
acgcgacctcagatcag

SEQ ID NO: 40319 - DNA, 18 bp, Homo sapiens
acgcgacctcagatcaga

SEQ ID NO: 40320 - DNA, 19 bp, Homo sapiens
acgcgacctcagatcagac

SEQ ID NO: 40321 - DNA, 20 bp, Homo sapiens
acgcgacctcagatcagacg

SEQ ID NO: 40322 - DNA, 21 bp, Homo sapiens
acgcgacctcagatcagacgt

SEQ ID NO: 40323 - DNA, 22 bp, Homo sapiens
acgcgacctcagatcagacgtg

SEQ ID NO: 40324 - DNA, 23 bp, Homo sapiens
acgcgacctcagatcagacgtgg

SEQ ID NO: 40325 - DNA, 24 bp, Homo sapiens
acgcgacctcagatcagacgtggc

SEQ ID NO: 40326 - DNA, 25 bp, Homo sapiens
acgcgacctcagatcagacgtggcg

SEQ ID NO: 40327 - DNA, 26 bp, Homo sapiens
acgcgacctcagatcagacgtggcga

SEQ ID NO: 40328 - DNA, 27 bp, Homo sapiens
acgcgacctcagatcagacgtggcgac

SEQ ID NO: 40329 - DNA, 28 bp, Homo sapiens
acgcgacctcagatcagacgtggcgacc

SEQ ID NO: 40330 - DNA, 29 bp, Homo sapiens
acgcgacctcagatcagacgtggcgaccc

SEQ ID NO: 40331 - DNA, 30 bp, Homo sapiens; identical to SEQ ID NO: 3848

SEQ ID NO: 40332 - DNA, 16 bp, Homo sapiens
cgcgacctcagatcag

SEQ ID NO: 40333 - DNA, 17 bp, Homo sapiens
cgcgacctcagatcaga

SEQ ID NO: 40334 - DNA, 18 bp, Homo sapiens
cgcgacctcagatcagac

SEQ ID NO: 40335 - DNA, 19 bp, Homo sapiens
cgcgacctcagatcagacg

SEQ ID NO: 40336 - DNA, 20 bp, Homo sapiens
cgcgacctcagatcagacgt

SEQ ID NO: 40337 - DNA, 21 bp, Homo sapiens
cgcgacctcagatcagacgtg

SEQ ID NO: 40338 - DNA, 22 bp, Homo sapiens
cgcgacctcagatcagacgtgg

SEQ ID NO: 40339 - DNA, 23 bp, Homo sapiens
cgcgacctcagatcagacgtggc

SEQ ID NO: 40340 - DNA, 24 bp, Homo sapiens
cgcgacctcagatcagacgtggcg

SEQ ID NO: 40341 - DNA, 25 bp, Homo sapiens
cgcgacctcagatcagacgtggcga

SEQ ID NO: 40342 - DNA, 26 bp, Homo sapiens
cgcgacctcagatcagacgtggcgac

SEQ ID NO: 40343 - DNA, 27 bp, Homo sapiens
cgcgacctcagatcagacgtggcgacc

SEQ ID NO: 40344 - DNA, 28 bp, Homo sapiens
cgcgacctcagatcagacgtggcgaccc

SEQ ID NO: 40345 - DNA, 29 bp, Homo sapiens
cgcgacctcagatcagacgtggcgacccg

SEQ ID NO: 40346 - DNA, 30 bp, Homo sapiens; identical to SEQ ID NO: 3865

SEQ ID NO: 40347 - DNA, 16 bp, Homo sapiens
gcgacctcagatcaga

SEQ ID NO: 40348 - DNA, 17 bp, Homo sapiens
gcgacctcagatcagac

SEQ ID NO: 40349 - DNA, 18 bp, Homo sapiens
gcgacctcagatcagacg

SEQ ID NO: 40350 - DNA, 19 bp, Homo sapiens
gcgacctcagatcagacgt

SEQ ID NO: 40351 - DNA, 20 bp, Homo sapiens
gcgacctcagatcagacgtg

SEQ ID NO: 40352 - DNA, 21 bp, Homo sapiens
gcgacctcagatcagacgtgg

SEQ ID NO: 40353 - DNA, 22 bp, Homo sapiens
gcgacctcagatcagacgtggc

SEQ ID NO: 40354 - DNA, 23 bp, Homo sapiens
gcgacctcagatcagacgtggcg

SEQ ID NO: 40355 - DNA, 24 bp, Homo sapiens
gcgacctcagatcagacgtggcga

SEQ ID NO: 40356 - DNA, 25 bp, Homo sapiens
gcgacctcagatcagacgtggcgac

SEQ ID NO: 40357 - DNA, 26 bp, Homo sapiens
gcgacctcagatcagacgtggcgacc

SEQ ID NO: 40358 - DNA, 27 bp, Homo sapiens
gcgacctcagatcagacgtggcgaccc

SEQ ID NO: 40359 - DNA, 28 bp, Homo sapiens
gcgacctcagatcagacgtggcgacccg

SEQ ID NO: 40360 - DNA, 29 bp, Homo sapiens
gcgacctcagatcagacgtggcgacccgc

SEQ ID NO: 40361 - DNA, 30 bp, Homo sapiens; identical to SEQ ID NO: 3876

SEQ ID NO: 40362 - DNA, 17 bp, Homo sapiens
cgacctcagatcagacg

SEQ ID NO: 40363 - DNA, 18 bp, Homo sapiens
cgacctcagatcagacgt

SEQ ID NO: 40364 - DNA, 19 bp, Homo sapiens
cgacctcagatcagacgtg

SEQ ID NO: 40365 - DNA, 20 bp, Homo sapiens
cgacctcagatcagacgtgg

SEQ ID NO: 40366 - DNA, 21 bp, Homo sapiens
cgacctcagatcagacgtggc

SEQ ID NO: 40367 - DNA, 22 bp, Homo sapiens
cgacctcagatcagacgtggcg

SEQ ID NO: 40368 - DNA, 23 bp, Homo sapiens
cgacctcagatcagacgtggcga

SEQ ID NO: 40369 - DNA, 24 bp, Homo sapiens
cgacctcagatcagacgtggcgac

SEQ ID NO: 40370 - DNA, 25 bp, Homo sapiens
cgacctcagatcagacgtggcgacc

SEQ ID NO: 40371 - DNA, 26 bp, Homo sapiens
cgacctcagatcagacgtggcgaccc

SEQ ID NO: 40372 - DNA, 27 bp, Homo sapiens
cgacctcagatcagacgtggcgacccg

SEQ ID NO: 40373 - DNA, 28 bp, Homo sapiens
cgacctcagatcagacgtggcgacccgc

SEQ ID NO: 40374 - DNA, 29 bp, Homo sapiens
cgacctcagatcagacgtggcgacccgct

SEQ ID NO: 40375 - DNA, 30 bp, Homo sapiens; identical to SEQ ID NO: 3888

SEQ ID NO: 40376 - DNA, 16 bp, Homo sapiens
gacctcagatcagacg

SEQ ID NO: 40377 - DNA, 17 bp, Homo sapiens
gacctcagatcagacgt

SEQ ID NO: 40378 - DNA, 18 bp, Homo sapiens
gacctcagatcagacgtg

SEQ ID NO: 40379 - DNA, 19 bp, Homo sapiens
gacctcagatcagacgtgg

SEQ ID NO: 40380 - DNA, 20 bp, Homo sapiens
gacctcagatcagacgtggc

SEQ ID NO: 40381 - DNA, 21 bp, Homo sapiens
gacctcagatcagacgtggcg

SEQ ID NO: 40382 - DNA, 22 bp, Homo sapiens
gacctcagatcagacgtggcga

SEQ ID NO: 40383 - DNA, 23 bp, Homo sapiens
gacctcagatcagacgtggcgac

SEQ ID NO: 40384 - DNA, 24 bp, Homo sapiens
gacctcagatcagacgtggcgacc

SEQ ID NO: 40385 - DNA, 25 bp, Homo sapiens
gacctcagatcagacgtggcgaccc

SEQ ID NO: 40386 - DNA, 26 bp, Homo sapiens
gacctcagatcagacgtggcgacccg

SEQ ID NO: 40387 - DNA, 27 bp, Homo sapiens
gacctcagatcagacgtggcgacccgc

SEQ ID NO: 40388 - DNA, 28 bp, Homo sapiens
gacctcagatcagacgtggcgacccgct

SEQ ID NO: 40389 - DNA, 29 bp, Homo sapiens
gacctcagatcagacgtggcgacccgctg

SEQ ID NO: 40390 - DNA, 16 bp, Homo sapiens
acctcagatcagacgt

SEQ ID NO: 40391 - DNA, 17 bp, Homo sapiens
acctcagatcagacgtg

SEQ ID NO: 40392 - DNA, 18 bp, Homo sapiens
acctcagatcagacgtgg

SEQ ID NO: 40393 - DNA, 19 bp, Homo sapiens
acctcagatcagacgtggc

SEQ ID NO: 40394 - DNA, 20 bp, Homo sapiens
acctcagatcagacgtggcg

SEQ ID NO: 40395 - DNA, 21 bp, Homo sapiens
acctcagatcagacgtggcga

SEQ ID NO: 40396 - DNA, 22 bp, Homo sapiens
acctcagatcagacgtggcgac

SEQ ID NO: 40397 - DNA, 23 bp, Homo sapiens
acctcagatcagacgtggcgacc

SEQ ID NO: 40398 - DNA, 24 bp, Homo sapiens
acctcagatcagacgtggcgaccc

SEQ ID NO: 40399 - DNA, 25 bp, Homo sapiens
acctcagatcagacgtggcgacccg

SEQ ID NO: 40400 - DNA, 26 bp, Homo sapiens
acctcagatcagacgtggcgacccgc

SEQ ID NO: 40401 - DNA, 27 bp, Homo sapiens
acctcagatcagacgtggcgacccgct

SEQ ID NO: 40402 - DNA, 28 bp, Homo sapiens
acctcagatcagacgtggcgacccgctg

SEQ ID NO: 40403 - DNA, 29 bp, Homo sapiens
acctcagatcagacgtggcgacccgctga

SEQ ID NO: 40404 - DNA, 16 bp, Homo sapiens
cctcagatcagacgtg

SEQ ID NO: 40405 - DNA, 17 bp, Homo sapiens
cctcagatcagacgtgg

SEQ ID NO: 40406 - DNA, 18 bp, Homo sapiens
cctcagatcagacgtggc

SEQ ID NO: 40407 - DNA, 19 bp, Homo sapiens
cctcagatcagacgtggcg

SEQ ID NO: 40408 - DNA, 20 bp, Homo sapiens
cctcagatcagacgtggcga

SEQ ID NO: 40409 - DNA, 21 bp, Homo sapiens
cctcagatcagacgtggcgac

SEQ ID NO: 40410 - DNA, 22 bp, Homo sapiens
cctcagatcagacgtggcgacc

SEQ ID NO: 40411 - DNA, 23 bp, Homo sapiens
cctcagatcagacgtggcgaccc

SEQ ID NO: 40412 - DNA, 24 bp, Homo sapiens
cctcagatcagacgtggcgacccg

SEQ ID NO: 40413 - DNA, 25 bp, Homo sapiens
cctcagatcagacgtggcgacccgc

SEQ ID NO: 40414 - DNA, 26 bp, Homo sapiens
cctcagatcagacgtggcgacccgct

SEQ ID NO: 40415 - DNA, 28 bp, Homo sapiens
cctcagatcagacgtggcgacccgctga

SEQ ID NO: 40416 - DNA, 29 bp, Homo sapiens
cctcagatcagacgtggcgacccgctgaa

SEQ ID NO: 40417 - DNA, 16 bp, Homo sapiens
ctcagatcagacgtgg

SEQ ID NO: 40418 - DNA, 17 bp, Homo sapiens
ctcagatcagacgtggc

SEQ ID NO: 40419 - DNA, 18 bp, Homo sapiens
ctcagatcagacgtggcg

SEQ ID NO: 40420 - DNA, 19 bp, Homo sapiens
ctcagatcagacgtggcga

SEQ ID NO: 40421 - DNA, 20 bp, Homo sapiens
ctcagatcagacgtggcgac

SEQ ID NO: 40422 - DNA, 21 bp, Homo sapiens
ctcagatcagacgtggcgacc

SEQ ID NO: 40423 - DNA, 22 bp, Homo sapiens
ctcagatcagacgtggcgaccc

SEQ ID NO: 40424 - DNA, 23 bp, Homo sapiens
ctcagatcagacgtggcgacccg

SEQ ID NO: 40425 - DNA, 24 bp, Homo sapiens
ctcagatcagacgtggcgacccgc

SEQ ID NO: 40426 - DNA, 25 bp, Homo sapiens
ctcagatcagacgtggcgacccgct

SEQ ID NO: 40427 - DNA, 26 bp, Homo sapiens
ctcagatcagacgtggcgacccgctg

SEQ ID NO: 40428 - DNA, 27 bp, Homo sapiens
ctcagatcagacgtggcgacccgctga

SEQ ID NO: 40429 - DNA, 28 bp, Homo sapiens
ctcagatcagacgtggcgacccgctgaa

SEQ ID NO: 40430 - DNA, 29 bp, Homo sapiens
ctcagatcagacgtggcgacccgctgaat

SEQ ID NO: 40431 - DNA, 30 bp, Homo sapiens
ctcagatcagacgtggcgacccgctgaatt

SEQ ID NO: 40432 - DNA, 16 bp, Homo sapiens
tcagatcagacgtggc

SEQ ID NO: 40433 - DNA, 17 bp, Homo sapiens
tcagatcagacgtggcg

SEQ ID NO: 40434 - DNA, 18 bp, Homo sapiens
tcagatcagacgtggcga

SEQ ID NO: 40435 - DNA, 19 bp, Homo sapiens
tcagatcagacgtggcgac

SEQ ID NO: 40436 - DNA, 20 bp, Homo sapiens
tcagatcagacgtggcgacc

SEQ ID NO: 40437 - DNA, 21 bp, Homo sapiens
tcagatcagacgtggcgaccc

SEQ ID NO: 40438 - DNA, 22 bp, Homo sapiens
tcagatcagacgtggcgacccg

SEQ ID NO: 40439 - DNA, 23 bp, Homo sapiens
tcagatcagacgtggcgacccgc

SEQ ID NO: 40440 - DNA, 24 bp, Homo sapiens
tcagatcagacgtggcgacccgct

SEQ ID NO: 40441 - DNA, 26 bp, Homo sapiens
tcagatcagacgtggcgacccgctga

SEQ ID NO: 40442 - DNA, 27 bp, Homo sapiens
tcagatcagacgtggcgacccgctgaa

SEQ ID NO: 40443 - DNA, 28 bp, Homo sapiens
tcagatcagacgtggcgacccgctgaat

SEQ ID NO: 40444 - DNA, 30 bp, Homo sapiens
tcagatcagacgtggcgacccgctgaattt

SEQ ID NO: 40445 - DNA, 18 bp, Homo sapiens
cagatcagacgtggcgac

SEQ ID NO: 40446 - DNA, 19 bp, Homo sapiens
cagatcagacgtggcgacc

SEQ ID NO: 40447 - DNA, 20 bp, Homo sapiens
cagatcagacgtggcgaccc

SEQ ID NO: 40448 - DNA, 21 bp, Homo sapiens
cagatcagacgtggcgacccg

SEQ ID NO: 40449 - DNA, 22 bp, Homo sapiens
cagatcagacgtggcgacccgc

SEQ ID NO: 40450 - DNA, 23 bp, Homo sapiens
cagatcagacgtggcgacccgct

SEQ ID NO: 40451 - DNA, 25 bp, Homo sapiens
cagatcagacgtggcgacccgctga

SEQ ID NO: 40452 - DNA, 26 bp, Homo sapiens
cagatcagacgtggcgacccgctgaa

SEQ ID NO: 40453 - DNA, 29 bp, Homo sapiens
cagatcagacgtggcgacccgctgaattt

SEQ ID NO: 40454 - DNA, 21 bp, Homo sapiens
agatcagacgtggcgacccgc

SEQ ID NO: 40455 - DNA, 22 bp, Homo sapiens
agatcagacgtggcgacccgct

SEQ ID NO: 40456 - DNA, 20 bp, Homo sapiens
gatcagacgtggcgacccgc

SEQ ID NO: 40457 - DNA, 21 bp, Homo sapiens
gatcagacgtggcgacccgct

SEQ ID NO: 40458 - DNA, 18 bp, Homo sapiens
atcagacgtggcgacccg

SEQ ID NO: 40459 - DNA, 19 bp, Homo sapiens
atcagacgtggcgacccgc

SEQ ID NO: 40460 - DNA, 20 bp, Homo sapiens
atcagacgtggcgacccgct

SEQ ID NO: 40461 - DNA, 21 bp, Homo sapiens
atcagacgtggcgacccgctg

SEQ ID NO: 40462 - DNA, 22 bp, Homo sapiens
atcagacgtggcgacccgctga

SEQ ID NO: 40463 - DNA, 23 bp, Homo sapiens
atcagacgtggcgacccgctgaa

SEQ ID NO: 40464 - DNA, 24 bp, Homo sapiens
atcagacgtggcgacccgctgaat

SEQ ID NO: 40465 - DNA, 30 bp, Homo sapiens
atcagacgtggcgacccgctgaatttaagc

SEQ ID NO: 40466 - DNA, 18 bp, Homo sapiens
tcagacgtggcgacccgc

SEQ ID NO: 40467 - DNA, 20 bp, Homo sapiens
tcagacgtggcgacccgctg

SEQ ID NO: 40468 - DNA, 21 bp, Homo sapiens
tcagacgtggcgacccgctga

SEQ ID NO: 40469 - DNA, 23 bp, Homo sapiens
tcagacgtggcgacccgctgaat

SEQ ID NO: 40470 - DNA, 18 bp, Homo sapiens
cagacgtggcgacccgct

SEQ ID NO: 40471 - DNA, 19 bp, Homo sapiens
cagacgtggcgacccgctg

SEQ ID NO: 40472 - DNA, 20 bp, Homo sapiens
cagacgtggcgacccgctga

SEQ ID NO: 40473 - DNA, 21 bp, Homo sapiens
cagacgtggcgacccgctgaa

SEQ ID NO: 40474 - DNA, 22 bp, Homo sapiens
cagacgtggcgacccgctgaat

SEQ ID NO: 40475 - DNA, 23 bp, Homo sapiens
cagacgtggcgacccgctgaatt

SEQ ID NO: 40476 - DNA, 28 bp, Homo sapiens
cagacgtggcgacccgctgaatttaagc

SEQ ID NO: 40477 - DNA, 16 bp, Homo sapiens
gacgtggcgacccgct

SEQ ID NO: 40478 - DNA, 18 bp, Homo sapiens
gacgtggcgacccgctga

SEQ ID NO: 40479 - DNA, 19 bp, Homo sapiens
gacgtggcgacccgctgaa

SEQ ID NO: 40480 - DNA, 20 bp, Homo sapiens
gacgtggcgacccgctgaat

SEQ ID NO: 40481 - DNA, 21 bp, Homo sapiens
gacgtggcgacccgctgaatt

SEQ ID NO: 40482 - DNA, 22 bp, Homo sapiens
gacgtggcgacccgctgaattt

SEQ ID NO: 40483 - DNA, 20 bp, Homo sapiens
cgtggcgacccgctgaattt

SEQ ID NO: 40484 - DNA, 16 bp, Homo sapiens
gcgacccgctgaattt

SEQ ID NO: 40485 - DNA, 18 bp, Homo sapiens
gacccgctgaatttaagc

SEQ ID NO: 40486 - DNA, 17 bp, Homo sapiens
aagcatattagtcagcg

SEQ ID NO: 40487 - DNA, 18 bp, Homo sapiens
catattagtcagcggagg

SEQ ID NO: 40488 - DNA, 19 bp, Homo sapiens
catattagtcagcggagga

SEQ ID NO: 40489 - DNA, 20 bp, Homo sapiens
catattagtcagcggaggag

SEQ ID NO: 40490 - DNA, 17 bp, Homo sapiens
tattagtcagcggagga

SEQ ID NO: 40491 - DNA, 21 bp, Homo sapiens
tattagtcagcggaggagaag

SEQ ID NO: 40492 - DNA, 22 bp, Homo sapiens
tattagtcagcggaggagaaga

SEQ ID NO: 40493 - DNA, 23 bp, Homo sapiens
tattagtcagcggaggagaagaa

SEQ ID NO: 40494 - DNA, 17 bp, Homo sapiens
attagtcagcggaggag

SEQ ID NO: 40495 - DNA, 19 bp, Homo sapiens
attagtcagcggaggagaa

SEQ ID NO: 40496 - DNA, 20 bp, Homo sapiens
attagtcagcggaggagaag

SEQ ID NO: 40497 - DNA, 21 bp, Homo sapiens
attagtcagcggaggagaaga

SEQ ID NO: 40498 - DNA, 22 bp, Homo sapiens
attagtcagcggaggagaagaa

SEQ ID NO: 40499 - DNA, 19 bp, Homo sapiens
ttagtcagcggaggagaag

SEQ ID NO: 40500 - DNA, 20 bp, Homo sapiens
ttagtcagcggaggagaaga

SEQ ID NO: 40501 - DNA, 18 bp, Homo sapiens
tagtcagcggaggagaag

SEQ ID NO: 40502 - DNA, 19 bp, Homo sapiens
tagtcagcggaggagaaga

SEQ ID NO: 40503 - DNA, 20 bp, Homo sapiens
tagtcagcggaggagaagaa

SEQ ID NO: 40504 - DNA, 23 bp, Homo sapiens
tagtcagcggaggagaagaaact

SEQ ID NO: 40505 - DNA, 17 bp, Homo sapiens
agtcagcggaggagaag

SEQ ID NO: 40506 - DNA, 18 bp, Homo sapiens
agtcagcggaggagaaga

SEQ ID NO: 40507 - DNA, 22 bp, Homo sapiens
agtcagcggaggagaagaaact

SEQ ID NO: 40508 - DNA, 20 bp, Homo sapiens
gtcagcggaggagaagaaac

SEQ ID NO: 40509 - DNA, 21 bp, Homo sapiens
gtcagcggaggagaagaaact

SEQ ID NO: 40510 - DNA, 20 bp, Homo sapiens
tcagcggaggagaagaaact

SEQ ID NO: 40511 - DNA, 19 bp, Homo sapiens
cagcggaggagaagaaact

SEQ ID NO: 40512 - DNA, 18 bp, Homo sapiens
agcggaggagaagaaact

SEQ ID NO: 40513 - DNA, 16 bp, Homo sapiens
gcggaggagaagaaac

SEQ ID NO: 40514 - DNA, 17 bp, Homo sapiens
gcggaggagaagaaact

SEQ ID NO: 40515 - DNA, 16 bp, Homo sapiens
cggaggagaagaaact

SEQ ID NO: 40516 - DNA, 22 bp, Homo sapiens
cggaggagaagaaactaaccag

SEQ ID NO: 40517 - DNA, 20 bp, Homo sapiens
gaggagaagaaactaaccag

SEQ ID NO: 40518 - DNA, 19 bp, Homo sapiens
aggagaagaaactaaccag

SEQ ID NO: 40519 - DNA, 18 bp, Homo sapiens
ggagaagaaactaaccag

SEQ ID NO: 40520 - DNA, 19 bp, Homo sapiens
ggagaagaaactaaccagg

SEQ ID NO: 40521 - DNA, 20 bp, Homo sapiens
ggagaagaaactaaccagga

SEQ ID NO: 40522 - DNA, 22 bp, Homo sapiens
ggagaagaaactaaccaggatt

SEQ ID NO: 40523 - DNA, 24 bp, Homo sapiens
ggagaagaaactaaccaggattcc

SEQ ID NO: 40524 - DNA, 30 bp, Homo sapiens
ggagaagaaactaaccaggattccctcagt

SEQ ID NO: 40525 - DNA, 17 bp, Homo sapiens
gagaagaaactaaccag

SEQ ID NO: 40526 - DNA, 18 bp, Homo sapiens
gagaagaaactaaccagg

SEQ ID NO: 40527 - DNA, 16 bp, Homo sapiens
agaagaaactaaccag

SEQ ID NO: 40528 - DNA, 18 bp, Homo sapiens
aagaaactaaccaggatt

SEQ ID NO: 40529 - DNA, 22 bp, Homo sapiens
aaactaaccaggattccctcag

SEQ ID NO: 40530 - DNA, 23 bp, Homo sapiens
aaactaaccaggattccctcagt

SEQ ID NO: 40531 - DNA, 21 bp, Homo sapiens
aactaaccaggattccctcag

SEQ ID NO: 40532 - DNA, 22 bp, Homo sapiens
aactaaccaggattccctcagt

SEQ ID NO: 40533 - DNA, 20 bp, Homo sapiens
actaaccaggattccctcag

SEQ ID NO: 40534 - DNA, 21 bp, Homo sapiens
actaaccaggattccctcagt

SEQ ID NO: 40535 - DNA, 19 bp, Homo sapiens
ctaaccaggattccctcag

SEQ ID NO: 40536 - DNA, 20 bp, Homo sapiens
ctaaccaggattccctcagt

SEQ ID NO: 40537 - DNA, 26 bp, Homo sapiens
ctaaccaggattccctcagtaacggc

SEQ ID NO: 40538 - DNA, 25 bp, Homo sapiens
taaccaggattccctcagtaacggc

SEQ ID NO: 40539 - DNA, 18 bp, Homo sapiens
aaccaggattccctcagt

SEQ ID NO: 40540 - DNA, 19 bp, Homo sapiens
aaccaggattccctcagta

SEQ ID NO: 40541 - DNA, 22 bp, Homo sapiens
aaccaggattccctcagtaacg

SEQ ID NO: 40542 - DNA, 23 bp, Homo sapiens
aaccaggattccctcagtaacgg

SEQ ID NO: 40543 - DNA, 24 bp, Homo sapiens
aaccaggattccctcagtaacggc

SEQ ID NO: 40544 - DNA, 25 bp, Homo sapiens
aaccaggattccctcagtaacggcg

SEQ ID NO: 40545 - DNA, 17 bp, Homo sapiens
accaggattccctcagt

SEQ ID NO: 40546 - DNA, 21 bp, Homo sapiens
accaggattccctcagtaacg

SEQ ID NO: 40547 - DNA, 22 bp, Homo sapiens
accaggattccctcagtaacgg

SEQ ID NO: 40548 - DNA, 24 bp, Homo sapiens
accaggattccctcagtaacggcg

SEQ ID NO: 40549 - DNA, 16 bp, Homo sapiens
ccaggattccctcagt

SEQ ID NO: 40550 - DNA, 20 bp, Homo sapiens
ccaggattccctcagtaacg

SEQ ID NO: 40551 - DNA, 21 bp, Homo sapiens
ccaggattccctcagtaacgg

SEQ ID NO: 40552 - DNA, 22 bp, Homo sapiens
ccaggattccctcagtaacggc

SEQ ID NO: 40553 - DNA, 23 bp, Homo sapiens
ccaggattccctcagtaacggcg

SEQ ID NO: 40554 - DNA, 21 bp, Homo sapiens
caggattccctcagtaacggc

SEQ ID NO: 40555 - DNA, 20 bp, Homo sapiens
aggattccctcagtaacggc

SEQ ID NO: 40556 - DNA, 18 bp, Homo sapiens
ggattccctcagtaacgg

SEQ ID NO: 40557 - DNA, 19 bp, Homo sapiens
ggattccctcagtaacggc

SEQ ID NO: 40558 - DNA, 18 bp, Homo sapiens
gattccctcagtaacggc

SEQ ID NO: 40559 - DNA, 17 bp, Homo sapiens
attccctcagtaacggc

SEQ ID NO: 40560 - DNA, 25 bp, Homo sapiens
tccctcagtaacggcgagtgaacag

SEQ ID NO: 40561 - DNA, 22 bp, Homo sapiens
taacggcgagtgaacagggaag

SEQ ID NO: 40562 - DNA, 18 bp, Homo sapiens
aacggcgagtgaacaggg

SEQ ID NO: 40563 - DNA, 19 bp, Homo sapiens
aacggcgagtgaacaggga

SEQ ID NO: 40564 - DNA, 20 bp, Homo sapiens
aacggcgagtgaacagggaa

SEQ ID NO: 40565 - DNA, 21 bp, Homo sapiens
aacggcgagtgaacagggaag

SEQ ID NO: 40566 - DNA, 22 bp, Homo sapiens
aacggcgagtgaacagggaaga

SEQ ID NO: 40567 - DNA, 23 bp, Homo sapiens
aacggcgagtgaacagggaagag

SEQ ID NO: 40568 - DNA, 19 bp, Homo sapiens
acggcgagtgaacagggaa

SEQ ID NO: 40569 - DNA, 20 bp, Homo sapiens
acggcgagtgaacagggaag

SEQ ID NO: 40570 - DNA, 22 bp, Homo sapiens
acggcgagtgaacagggaagag

SEQ ID NO: 40571 - DNA, 19 bp, Homo sapiens
cggcgagtgaacagggaag

SEQ ID NO: 40572 - DNA, 16 bp, Homo sapiens
gcgagtgaacagggaa

SEQ ID NO: 40573 - DNA, 17 bp, Homo sapiens
gcgagtgaacagggaag

SEQ ID NO: 40574 - DNA, 19 bp, Homo sapiens
gcgagtgaacagggaagag

SEQ ID NO: 40575 - DNA, 25 bp, Homo sapiens
gcgagtgaacagggaagagcccagc

SEQ ID NO: 40576 - DNA, 16 bp, Homo sapiens
cgagtgaacagggaag

SEQ ID NO: 40577 - DNA, 17 bp, Homo sapiens
cgagtgaacagggaaga

SEQ ID NO: 40578 - DNA, 18 bp, Homo sapiens
cgagtgaacagggaagag

SEQ ID NO: 40579 - DNA, 20 bp, Homo sapiens
gtgaacagggaagagcccag

SEQ ID NO: 40580 - DNA, 25 bp, Homo sapiens
ggaagagcccagcgccgaatccccg

SEQ ID NO: 40581 - DNA, 26 bp, Homo sapiens
ggaagagcccagcgccgaatccccgc

SEQ ID NO: 40582 - DNA, 27 bp, Homo sapiens
ggaagagcccagcgccgaatccccgcc

SEQ ID NO: 40583 - DNA, 28 bp, Homo sapiens
ggaagagcccagcgccgaatccccgccc

SEQ ID NO: 40584 - DNA, 23 bp, Homo sapiens
gaagagcccagcgccgaatcccc

SEQ ID NO: 40585 - DNA, 24 bp, Homo sapiens
gaagagcccagcgccgaatccccg

SEQ ID NO: 40586 - DNA, 25 bp, Homo sapiens
gaagagcccagcgccgaatccccgc

SEQ ID NO: 40587 - DNA, 26 bp, Homo sapiens
gaagagcccagcgccgaatccccgcc

SEQ ID NO: 40588 - DNA, 27 bp, Homo sapiens
gaagagcccagcgccgaatccccgccc

SEQ ID NO: 40589 - DNA, 21 bp, Homo sapiens
aagagcccagcgccgaatccc

SEQ ID NO: 40590 - DNA, 22 bp, Homo sapiens
aagagcccagcgccgaatcccc

SEQ ID NO: 40591 - DNA, 23 bp, Homo sapiens
aagagcccagcgccgaatccccg

SEQ ID NO: 40592 - DNA, 24 bp, Homo sapiens
aagagcccagcgccgaatccccgc

SEQ ID NO: 40593 - DNA, 25 bp, Homo sapiens
aagagcccagcgccgaatccccgcc

SEQ ID NO: 40594 - DNA, 26 bp, Homo sapiens
aagagcccagcgccgaatccccgccc

SEQ ID NO: 40595 - DNA, 20 bp, Homo sapiens
agagcccagcgccgaatccc

SEQ ID NO: 40596 - DNA, 21 bp, Homo sapiens
agagcccagcgccgaatcccc

SEQ ID NO: 40597 - DNA, 22 bp, Homo sapiens
agagcccagcgccgaatccccg

SEQ ID NO: 40598 - DNA, 23 bp, Homo sapiens
agagcccagcgccgaatccccgc

SEQ ID NO: 40599 - DNA, 24 bp, Homo sapiens
agagcccagcgccgaatccccgcc

SEQ ID NO: 40600 - DNA, 25 bp, Homo sapiens
agagcccagcgccgaatccccgccc

SEQ ID NO: 40601 - DNA, 17 bp, Homo sapiens
gagcccagcgccgaatc

SEQ ID NO: 40602 - DNA, 18 bp, Homo sapiens
gagcccagcgccgaatcc

SEQ ID NO: 40603 - DNA, 19 bp, Homo sapiens
gagcccagcgccgaatccc

SEQ ID NO: 40604 - DNA, 20 bp, Homo sapiens
gagcccagcgccgaatcccc

SEQ ID NO: 40605 - DNA, 21 bp, Homo sapiens
gagcccagcgccgaatccccg

SEQ ID NO: 40606 - DNA, 22 bp, Homo sapiens
gagcccagcgccgaatccccgc

SEQ ID NO: 40607 - DNA, 23 bp, Homo sapiens
gagcccagcgccgaatccccgcc

SEQ ID NO: 40608 - DNA, 24 bp, Homo sapiens
gagcccagcgccgaatccccgccc

SEQ ID NO: 40609 - DNA, 25 bp, Homo sapiens
gagcccagcgccgaatccccgcccc

SEQ ID NO: 40610 - DNA, 26 bp, Homo sapiens
gagcccagcgccgaatccccgccccg

SEQ ID NO: 40611 - DNA, 27 bp, Homo sapiens
gagcccagcgccgaatccccgccccgc

SEQ ID NO: 40612 - DNA, 29 bp, Homo sapiens
gagcccagcgccgaatccccgccccgcgg

SEQ ID NO: 40613 - DNA, 18 bp, Homo sapiens
agcccagcgccgaatccc

SEQ ID NO: 40614 - DNA, 19 bp, Homo sapiens
agcccagcgccgaatcccc

SEQ ID NO: 40615 - DNA, 20 bp, Homo sapiens
agcccagcgccgaatccccg

SEQ ID NO: 40616 - DNA, 21 bp, Homo sapiens
agcccagcgccgaatccccgc

SEQ ID NO: 40617 - DNA, 22 bp, Homo sapiens
agcccagcgccgaatccccgcc

SEQ ID NO: 40618 - DNA, 23 bp, Homo sapiens
agcccagcgccgaatccccgccc

SEQ ID NO: 40619 - DNA, 18 bp, Homo sapiens
gcccagcgccgaatcccc

SEQ ID NO: 40620 - DNA, 20 bp, Homo sapiens
gcccagcgccgaatccccgc

SEQ ID NO: 40621 - DNA, 21 bp, Homo sapiens
gcccagcgccgaatccccgcc

SEQ ID NO: 40622 - DNA, 22 bp, Homo sapiens
gcccagcgccgaatccccgccc

SEQ ID NO: 40623 - DNA, 19 bp, Homo sapiens
cccagcgccgaatccccgc

SEQ ID NO: 40624 - DNA, 20 bp, Homo sapiens
cccagcgccgaatccccgcc

SEQ ID NO: 40625 - DNA, 21 bp, Homo sapiens
cccagcgccgaatccccgccc

SEQ ID NO: 40626 - DNA, 25 bp, Homo sapiens
cccagcgccgaatccccgccccgcg

SEQ ID NO: 40627 - DNA, 26 bp, Homo sapiens
cccagcgccgaatccccgccccgcgg

SEQ ID NO: 40628 - DNA, 20 bp, Homo sapiens
gcgccgaatccccgccccgc

SEQ ID NO: 40629 - DNA, 21 bp, Homo sapiens
gcgccgaatccccgccccgcg

SEQ ID NO: 40630 - DNA, 20 bp, Homo sapiens
cgccgaatccccgccccgcg

SEQ ID NO: 40631 - DNA, 28 bp, Homo sapiens
gccgaatccccgccccgcggcggggcgc

SEQ ID NO: 40632 - DNA, 25 bp, Homo sapiens
gaatccccgccccgcggcggggcgc

SEQ ID NO: 40633 - DNA, 18 bp, Homo sapiens
ccgcggcggggcgcggga

SEQ ID NO: 40634 - DNA, 30 bp, Homo sapiens
ccgcggcggggcgcgggacatgtggcgtac

SEQ ID NO: 40635 - DNA, 24 bp, Homo sapiens
cgcggcggggcgcgggacatgtgg

SEQ ID NO: 40636 - DNA, 25 bp, Homo sapiens
cgcggcggggcgcgggacatgtggc

SEQ ID NO: 40637 - DNA, 26 bp, Homo sapiens
cgcggcggggcgcgggacatgtggcg

SEQ ID NO: 40638 - DNA, 28 bp, Homo sapiens
cgcggcggggcgcgggacatgtggcgta

SEQ ID NO: 40639 - DNA, 30 bp, Homo sapiens; identical to SEQ ID NO: 18681

SEQ ID NO: 40640 - DNA, 17 bp, Homo sapiens
gcggcggggcgcgggac

SEQ ID NO: 40641 - DNA, 18 bp, Homo sapiens
gcggcggggcgcgggaca

SEQ ID NO: 40642 - DNA, 22 bp, Homo sapiens
gcggcggggcgcgggacatgtg

SEQ ID NO: 40643 - DNA, 23 bp, Homo sapiens
gcggcggggcgcgggacatgtgg

SEQ ID NO: 40644 - DNA, 24 bp, Homo sapiens
gcggcggggcgcgggacatgtggc

SEQ ID NO: 40645 - DNA, 25 bp, Homo sapiens
gcggcggggcgcgggacatgtggcg

SEQ ID NO: 40646 - DNA, 26 bp, Homo sapiens
gcggcggggcgcgggacatgtggcgt

SEQ ID NO: 40647 - DNA, 27 bp, Homo sapiens
gcggcggggcgcgggacatgtggcgta

SEQ ID NO: 40648 - DNA, 29 bp, Homo sapiens
gcggcggggcgcgggacatgtggcgtacg

SEQ ID NO: 40649 - DNA, 30 bp, Homo sapiens
gcggcggggcgcgggacatgtggcgtacgg

SEQ ID NO: 40650 - DNA, 22 bp, Homo sapiens
cggcggggcgcgggacatgtgg

SEQ ID NO: 40651 - DNA, 24 bp, Homo sapiens
cggcggggcgcgggacatgtggcg

SEQ ID NO: 40652 - DNA, 29 bp, Homo sapiens
cggcggggcgcgggacatgtggcgtacgg

SEQ ID NO: 40653 - DNA, 21 bp, Homo sapiens
ggcggggcgcgggacatgtgg

SEQ ID NO: 40654 - DNA, 23 bp, Homo sapiens
ggcggggcgcgggacatgtggcg

SEQ ID NO: 40655 - DNA, 25 bp, Homo sapiens
ggcggggcgcgggacatgtggcgta

SEQ ID NO: 40656 - DNA, 29 bp, Homo sapiens
ggcggggcgcgggacatgtggcgtacgga

SEQ ID NO: 40657 - DNA, 17 bp, Homo sapiens
gcggggcgcgggacatg

SEQ ID NO: 40658 - DNA, 18 bp, Homo sapiens
gcggggcgcgggacatgt

SEQ ID NO: 40659 - DNA, 19 bp, Homo sapiens
gcggggcgcgggacatgtg

SEQ ID NO: 40660 - DNA, 20 bp, Homo sapiens
gcggggcgcgggacatgtgg

SEQ ID NO: 40661 - DNA, 21 bp, Homo sapiens
gcggggcgcgggacatgtggc

SEQ ID NO: 40662 - DNA, 22 bp, Homo sapiens
gcggggcgcgggacatgtggcg

SEQ ID NO: 40663 - DNA, 24 bp, Homo sapiens
gcggggcgcgggacatgtggcgta

SEQ ID NO: 40664 - DNA, 30 bp, Homo sapiens
gcggggcgcgggacatgtggcgtacggaag

SEQ ID NO: 40665 - DNA, 17 bp, Homo sapiens
cggggcgcgggacatgt

SEQ ID NO: 40666 - DNA, 19 bp, Homo sapiens
cggggcgcgggacatgtgg

SEQ ID NO: 40667 - DNA, 29 bp, Homo sapiens
cggggcgcgggacatgtggcgtacggaag

SEQ ID NO: 40668 - DNA, 19 bp, Homo sapiens
ggggcgcgggacatgtggc

SEQ ID NO: 40669 - DNA, 20 bp, Homo sapiens
ggggcgcgggacatgtggcg

SEQ ID NO: 40670 - DNA, 22 bp, Homo sapiens
ggggcgcgggacatgtggcgta

SEQ ID NO: 40671 - DNA, 23 bp, Homo sapiens
ggggcgcgggacatgtggcgtac

SEQ ID NO: 40672 - DNA, 24 bp, Homo sapiens
ggggcgcgggacatgtggcgtacg

SEQ ID NO: 40673 - DNA, 25 bp, Homo sapiens
ggggcgcgggacatgtggcgtacgg

SEQ ID NO: 40674 - DNA, 26 bp, Homo sapiens
ggggcgcgggacatgtggcgtacgga

SEQ ID NO: 40675 - DNA, 27 bp, Homo sapiens
ggggcgcgggacatgtggcgtacggaa

SEQ ID NO: 40676 - DNA, 28 bp, Homo sapiens
ggggcgcgggacatgtggcgtacggaag

SEQ ID NO: 40677 - DNA, 29 bp, Homo sapiens
ggggcgcgggacatgtggcgtacggaaga

SEQ ID NO: 40678 - DNA, 30 bp, Homo sapiens
ggggcgcgggacatgtggcgtacggaagac

SEQ ID NO: 40679 - DNA, 18 bp, Homo sapiens
gggcgcgggacatgtggc

SEQ ID NO: 40680 - DNA, 19 bp, Homo sapiens
gggcgcgggacatgtggcg

SEQ ID NO: 40681 - DNA, 20 bp, Homo sapiens
gggcgcgggacatgtggcgt

SEQ ID NO: 40682 - DNA, 21 bp, Homo sapiens
gggcgcgggacatgtggcgta

SEQ ID NO: 40683 - DNA, 22 bp, Homo sapiens
gggcgcgggacatgtggcgtac

SEQ ID NO: 40684 - DNA, 23 bp, Homo sapiens
gggcgcgggacatgtggcgtacg

SEQ ID NO: 40685 - DNA, 24 bp, Homo sapiens
gggcgcgggacatgtggcgtacgg

SEQ ID NO: 40686 - DNA, 25 bp, Homo sapiens
gggcgcgggacatgtggcgtacgga

SEQ ID NO: 40687 - DNA, 26 bp, Homo sapiens
gggcgcgggacatgtggcgtacggaa

SEQ ID NO: 40688 - DNA, 27 bp, Homo sapiens
gggcgcgggacatgtggcgtacggaag

SEQ ID NO: 40689 - DNA, 28 bp, Homo sapiens
gggcgcgggacatgtggcgtacggaaga

SEQ ID NO: 40690 - DNA, 29 bp, Homo sapiens
gggcgcgggacatgtggcgtacggaagac

SEQ ID NO: 40691 - DNA, 30 bp, Homo sapiens
gggcgcgggacatgtggcgtacggaagacc

SEQ ID NO: 40692 - DNA, 17 bp, Homo sapiens
ggcgcgggacatgtggc

SEQ ID NO: 40693 - DNA, 18 bp, Homo sapiens
ggcgcgggacatgtggcg

SEQ ID NO: 40694 - DNA, 20 bp, Homo sapiens
ggcgcgggacatgtggcgta

SEQ ID NO: 40695 - DNA, 21 bp, Homo sapiens
ggcgcgggacatgtggcgtac

SEQ ID NO: 40696 - DNA, 22 bp, Homo sapiens
ggcgcgggacatgtggcgtacg

SEQ ID NO: 40697 - DNA, 23 bp, Homo sapiens
ggcgcgggacatgtggcgtacgg

SEQ ID NO: 40698 - DNA, 24 bp, Homo sapiens
ggcgcgggacatgtggcgtacgga

SEQ ID NO: 40699 - DNA, 25 bp, Homo sapiens
ggcgcgggacatgtggcgtacggaa

SEQ ID NO: 40700 - DNA, 26 bp, Homo sapiens
ggcgcgggacatgtggcgtacggaag

SEQ ID NO: 40701 - DNA, 27 bp, Homo sapiens
ggcgcgggacatgtggcgtacggaaga

SEQ ID NO: 40702 - DNA, 28 bp, Homo sapiens
ggcgcgggacatgtggcgtacggaagac

SEQ ID NO: 40703 - DNA, 29 bp, Homo sapiens
ggcgcgggacatgtggcgtacggaagacc

SEQ ID NO: 40704 - DNA, 19 bp, Homo sapiens
gcgcgggacatgtggcgta

SEQ ID NO: 40705 - DNA, 20 bp, Homo sapiens
gcgcgggacatgtggcgtac

SEQ ID NO: 40706 - DNA, 21 bp, Homo sapiens
gcgcgggacatgtggcgtacg

SEQ ID NO: 40707 - DNA, 22 bp, Homo sapiens
gcgcgggacatgtggcgtacgg

SEQ ID NO: 40708 - DNA, 23 bp, Homo sapiens
gcgcgggacatgtggcgtacgga

SEQ ID NO: 40709 - DNA, 24 bp, Homo sapiens
gcgcgggacatgtggcgtacggaa

SEQ ID NO: 40710 - DNA, 25 bp, Homo sapiens
gcgcgggacatgtggcgtacggaag

SEQ ID NO: 40711 - DNA, 26 bp, Homo sapiens
gcgcgggacatgtggcgtacggaaga

SEQ ID NO: 40712 - DNA, 27 bp, Homo sapiens
gcgcgggacatgtggcgtacggaagac

SEQ ID NO: 40713 - DNA, 28 bp, Homo sapiens
gcgcgggacatgtggcgtacggaagacc

SEQ ID NO: 40714 - DNA, 30 bp, Homo sapiens
gcgcgggacatgtggcgtacggaagacccg

SEQ ID NO: 40715 - DNA, 18 bp, Homo sapiens
cgcgggacatgtggcgta

SEQ ID NO: 40716 - DNA, 19 bp, Homo sapiens
cgcgggacatgtggcgtac

SEQ ID NO: 40717 - DNA, 20 bp, Homo sapiens
cgcgggacatgtggcgtacg

SEQ ID NO: 40718 - DNA, 21 bp, Homo sapiens
cgcgggacatgtggcgtacgg

SEQ ID NO: 40719 - DNA, 22 bp, Homo sapiens
cgcgggacatgtggcgtacgga

SEQ ID NO: 40720 - DNA, 23 bp, Homo sapiens
cgcgggacatgtggcgtacggaa

SEQ ID NO: 40721 - DNA, 24 bp, Homo sapiens
cgcgggacatgtggcgtacggaag

SEQ ID NO: 40722 - DNA, 25 bp, Homo sapiens
cgcgggacatgtggcgtacggaaga

SEQ ID NO: 40723 - DNA, 26 bp, Homo sapiens
cgcgggacatgtggcgtacggaagac

SEQ ID NO: 40724 - DNA, 27 bp, Homo sapiens
cgcgggacatgtggcgtacggaagacc

SEQ ID NO: 40725 - DNA, 30 bp, Homo sapiens; identical to SEQ ID NO: 4015

SEQ ID NO: 40726 - DNA, 17 bp, Homo sapiens
gcgggacatgtggcgta

SEQ ID NO: 40727 - DNA, 18 bp, Homo sapiens
gcgggacatgtggcgtac

SEQ ID NO: 40728 - DNA, 19 bp, Homo sapiens
gcgggacatgtggcgtacg

SEQ ID NO: 40729 - DNA, 20 bp, Homo sapiens
gcgggacatgtggcgtacgg

SEQ ID NO: 40730 - DNA, 21 bp, Homo sapiens
gcgggacatgtggcgtacgga

SEQ ID NO: 40731 - DNA, 22 bp, Homo sapiens
gcgggacatgtggcgtacggaa

SEQ ID NO: 40732 - DNA, 23 bp, Homo sapiens
gcgggacatgtggcgtacggaag

SEQ ID NO: 40733 - DNA, 24 bp, Homo sapiens
gcgggacatgtggcgtacggaaga

SEQ ID NO: 40734 - DNA, 25 bp, Homo sapiens
gcgggacatgtggcgtacggaagac

SEQ ID NO: 40735 - DNA, 26 bp, Homo sapiens
gcgggacatgtggcgtacggaagacc

SEQ ID NO: 40736 - DNA, 29 bp, Homo sapiens
gcgggacatgtggcgtacggaagacccgc

SEQ ID NO: 40737 - DNA, 16 bp, Homo sapiens
cgggacatgtggcgta

SEQ ID NO: 40738 - DNA, 17 bp, Homo sapiens
cgggacatgtggcgtac

SEQ ID NO: 40739 - DNA, 18 bp, Homo sapiens
cgggacatgtggcgtacg

SEQ ID NO: 40740 - DNA, 19 bp, Homo sapiens
cgggacatgtggcgtacgg

SEQ ID NO: 40741 - DNA, 20 bp, Homo sapiens
cgggacatgtggcgtacgga

SEQ ID NO: 40742 - DNA, 21 bp, Homo sapiens
cgggacatgtggcgtacggaa

SEQ ID NO: 40743 - DNA, 22 bp, Homo sapiens
cgggacatgtggcgtacggaag

SEQ ID NO: 40744 - DNA, 23 bp, Homo sapiens
cgggacatgtggcgtacggaaga

SEQ ID NO: 40745 - DNA, 24 bp, Homo sapiens
cgggacatgtggcgtacggaagac

SEQ ID NO: 40746 - DNA, 25 bp, Homo sapiens
cgggacatgtggcgtacggaagacc

SEQ ID NO: 40747 - DNA, 26 bp, Homo sapiens
cgggacatgtggcgtacggaagaccc

SEQ ID NO: 40748 - DNA, 28 bp, Homo sapiens
cgggacatgtggcgtacggaagacccgc

SEQ ID NO: 40749 - DNA, 17 bp, Homo sapiens
gggacatgtggcgtacg

SEQ ID NO: 40750 - DNA, 18 bp, Homo sapiens
gggacatgtggcgtacgg

SEQ ID NO: 40751 - DNA, 19 bp, Homo sapiens
gggacatgtggcgtacgga

SEQ ID NO: 40752 - DNA, 20 bp, Homo sapiens
gggacatgtggcgtacggaa

SEQ ID NO: 40753 - DNA, 21 bp, Homo sapiens
gggacatgtggcgtacggaag

SEQ ID NO: 40754 - DNA, 22 bp, Homo sapiens
gggacatgtggcgtacggaaga

SEQ ID NO: 40755 - DNA, 23 bp, Homo sapiens
gggacatgtggcgtacggaagac

SEQ ID NO: 40756 - DNA, 24 bp, Homo sapiens
gggacatgtggcgtacggaagacc

SEQ ID NO: 40757 - DNA, 27 bp, Homo sapiens
gggacatgtggcgtacggaagacccgc

SEQ ID NO: 40758 - DNA, 21 bp, Homo sapiens
ggacatgtggcgtacggaaga

SEQ ID NO: 40759 - DNA, 26 bp, Homo sapiens
ggacatgtggcgtacggaagacccgc

SEQ ID NO: 40760 - DNA, 18 bp, Homo sapiens
gacatgtggcgtacggaa

SEQ ID NO: 40761 - DNA, 19 bp, Homo sapiens
gacatgtggcgtacggaag

SEQ ID NO: 40762 - DNA, 20 bp, Homo sapiens
gacatgtggcgtacggaaga

SEQ ID NO: 40763 - DNA, 21 bp, Homo sapiens
gacatgtggcgtacggaagac

SEQ ID NO: 40764 - DNA, 22 bp, Homo sapiens
gacatgtggcgtacggaagacc

SEQ ID NO: 40765 - DNA, 24 bp, Homo sapiens
gacatgtggcgtacggaagacccg

SEQ ID NO: 40766 - DNA, 25 bp, Homo sapiens
gacatgtggcgtacggaagacccgc

SEQ ID NO: 40767 - DNA, 18 bp, Homo sapiens
acatgtggcgtacggaag

SEQ ID NO: 40768 - DNA, 19 bp, Homo sapiens
acatgtggcgtacggaaga

SEQ ID NO: 40769 - DNA, 20 bp, Homo sapiens
acatgtggcgtacggaagac

SEQ ID NO: 40770 - DNA, 24 bp, Homo sapiens
acatgtggcgtacggaagacccgc

SEQ ID NO: 40771 - DNA, 17 bp, Homo sapiens
catgtggcgtacggaag

SEQ ID NO: 40772 - DNA, 18 bp, Homo sapiens
catgtggcgtacggaaga

SEQ ID NO: 40773 - DNA, 19 bp, Homo sapiens
catgtggcgtacggaagac

SEQ ID NO: 40774 - DNA, 22 bp, Homo sapiens
catgtggcgtacggaagacccg

SEQ ID NO: 40775 - DNA, 23 bp, Homo sapiens
catgtggcgtacggaagacccgc

SEQ ID NO: 40776 - DNA, 24 bp, Homo sapiens
catgtggcgtacggaagacccgct

SEQ ID NO: 40777 - DNA, 18 bp, Homo sapiens
atgtggcgtacggaagac

SEQ ID NO: 40778 - DNA, 22 bp, Homo sapiens
atgtggcgtacggaagacccgc

SEQ ID NO: 40779 - DNA, 20 bp, Homo sapiens
tgtggcgtacggaagacccg

SEQ ID NO: 40780 - DNA, 21 bp, Homo sapiens
tgtggcgtacggaagacccgc

SEQ ID NO: 40781 - DNA, 20 bp, Homo sapiens
gtggcgtacggaagacccgc

SEQ ID NO: 40782 - DNA, 18 bp, Homo sapiens
tggcgtacggaagacccg

SEQ ID NO: 40783 - DNA, 19 bp, Homo sapiens
tggcgtacggaagacccgc

SEQ ID NO: 40784 - DNA, 26 bp, Homo sapiens
acggaagacccgctccccggcgccgc

SEQ ID NO: 40785 - DNA, 20 bp, Homo sapiens
cggaagacccgctccccggc

SEQ ID NO: 40786 - DNA, 21 bp, Homo sapiens
cggaagacccgctccccggcg

SEQ ID NO: 40787 - DNA, 22 bp, Homo sapiens
cggaagacccgctccccggcgc

SEQ ID NO: 40788 - DNA, 23 bp, Homo sapiens
cggaagacccgctccccggcgcc

SEQ ID NO: 40789 - DNA, 24 bp, Homo sapiens
cggaagacccgctccccggcgccg

SEQ ID NO: 40790 - DNA, 25 bp, Homo sapiens
cggaagacccgctccccggcgccgc

SEQ ID NO: 40791 - DNA, 26 bp, Homo sapiens
cggaagacccgctccccggcgccgct

SEQ ID NO: 40792 - DNA, 27 bp, Homo sapiens
cggaagacccgctccccggcgccgctc

SEQ ID NO: 40793 - DNA, 28 bp, Homo sapiens
cggaagacccgctccccggcgccgctcg

SEQ ID NO: 40794 - DNA, 19 bp, Homo sapiens
ggaagacccgctccccggc

SEQ ID NO: 40795 - DNA, 20 bp, Homo sapiens
ggaagacccgctccccggcg

SEQ ID NO: 40796 - DNA, 21 bp, Homo sapiens
ggaagacccgctccccggcgc

SEQ ID NO: 40797 - DNA, 22 bp, Homo sapiens
ggaagacccgctccccggcgcc

SEQ ID NO: 40798 - DNA, 23 bp, Homo sapiens
ggaagacccgctccccggcgccg

SEQ ID NO: 40799 - DNA, 24 bp, Homo sapiens
ggaagacccgctccccggcgccgc

SEQ ID NO: 40800 - DNA, 25 bp, Homo sapiens
ggaagacccgctccccggcgccgct

SEQ ID NO: 40801 - DNA, 26 bp, Homo sapiens
ggaagacccgctccccggcgccgctc

SEQ ID NO: 40802 - DNA, 27 bp, Homo sapiens
ggaagacccgctccccggcgccgctcg

SEQ ID NO: 40803 - DNA, 19 bp, Homo sapiens
gaagacccgctccccggcg

SEQ ID NO: 40804 - DNA, 20 bp, Homo sapiens
gaagacccgctccccggcgc

SEQ ID NO: 40805 - DNA, 21 bp, Homo sapiens
gaagacccgctccccggcgcc

SEQ ID NO: 40806 - DNA, 22 bp, Homo sapiens
gaagacccgctccccggcgccg

SEQ ID NO: 40807 - DNA, 23 bp, Homo sapiens
gaagacccgctccccggcgccgc

SEQ ID NO: 40808 - DNA, 24 bp, Homo sapiens
gaagacccgctccccggcgccgct

SEQ ID NO: 40809 - DNA, 25 bp, Homo sapiens
gaagacccgctccccggcgccgctc

SEQ ID NO: 40810 - DNA, 19 bp, Homo sapiens
aagacccgctccccggcgc

SEQ ID NO: 40811 - DNA, 17 bp, Homo sapiens
agacccgctccccggcg

SEQ ID NO: 40812 - DNA, 18 bp, Homo sapiens
agacccgctccccggcgc

SEQ ID NO: 40813 - DNA, 19 bp, Homo sapiens
agacccgctccccggcgcc

SEQ ID NO: 40814 - DNA, 20 bp, Homo sapiens
agacccgctccccggcgccg

SEQ ID NO: 40815 - DNA, 21 bp, Homo sapiens
agacccgctccccggcgccgc

SEQ ID NO: 40816 - DNA, 22 bp, Homo sapiens
agacccgctccccggcgccgct

SEQ ID NO: 40817 - DNA, 24 bp, Homo sapiens
agacccgctccccggcgccgctcg

SEQ ID NO: 40818 - DNA, 16 bp, Homo sapiens
gacccgctccccggcg

SEQ ID NO: 40819 - DNA, 17 bp, Homo sapiens
gacccgctccccggcgc

SEQ ID NO: 40820 - DNA, 18 bp, Homo sapiens
gacccgctccccggcgcc

SEQ ID NO: 40821 - DNA, 19 bp, Homo sapiens
gacccgctccccggcgccg

SEQ ID NO: 40822 - DNA, 20 bp, Homo sapiens
gacccgctccccggcgccgc

SEQ ID NO: 40823 - DNA, 21 bp, Homo sapiens
gacccgctccccggcgccgct

SEQ ID NO: 40824 - DNA, 22 bp, Homo sapiens
gacccgctccccggcgccgctc

SEQ ID NO: 40825 - DNA, 23 bp, Homo sapiens
gacccgctccccggcgccgctcg

SEQ ID NO: 40826 - DNA, 16 bp, Homo sapiens
acccgctccccggcgc

SEQ ID NO: 40827 - DNA, 17 bp, Homo sapiens
acccgctccccggcgcc

SEQ ID NO: 40828 - DNA, 18 bp, Homo sapiens
acccgctccccggcgccg

SEQ ID NO: 40829 - DNA, 19 bp, Homo sapiens
acccgctccccggcgccgc

SEQ ID NO: 40830 - DNA, 20 bp, Homo sapiens
acccgctccccggcgccgct

SEQ ID NO: 40831 - DNA, 21 bp, Homo sapiens
acccgctccccggcgccgctc

SEQ ID NO: 40832 - DNA, 22 bp, Homo sapiens
acccgctccccggcgccgctcg

SEQ ID NO: 40833 - DNA, 16 bp, Homo sapiens
cccgctccccggcgcc

SEQ ID NO: 40834 - DNA, 17 bp, Homo sapiens
cccgctccccggcgccg

SEQ ID NO: 40835 - DNA, 18 bp, Homo sapiens
cccgctccccggcgccgc

SEQ ID NO: 40836 - DNA, 19 bp, Homo sapiens
cccgctccccggcgccgct

SEQ ID NO: 40837 - DNA, 20 bp, Homo sapiens
cccgctccccggcgccgctc

SEQ ID NO: 40838 - DNA, 21 bp, Homo sapiens
cccgctccccggcgccgctcg

SEQ ID NO: 40839 - DNA, 22 bp, Homo sapiens
cccgctccccggcgccgctcgt

SEQ ID NO: 40840 - DNA, 16 bp, Homo sapiens
ccgctccccggcgccg

SEQ ID NO: 40841 - DNA, 17 bp, Homo sapiens
ccgctccccggcgccgc

SEQ ID NO: 40842 - DNA, 18 bp, Homo sapiens
ccgctccccggcgccgct

SEQ ID NO: 40843 - DNA, 20 bp, Homo sapiens
ccgctccccggcgccgctcg

SEQ ID NO: 40844 - DNA, 21 bp, Homo sapiens
ccgctccccggcgccgctcgt

SEQ ID NO: 40845 - DNA, 22 bp, Homo sapiens
ccgctccccggcgccgctcgtg

SEQ ID NO: 40846 - DNA, 23 bp, Homo sapiens
ccgctccccggcgccgctcgtgg

SEQ ID NO: 40847 - DNA, 17 bp, Homo sapiens
cgctccccggcgccgct

SEQ ID NO: 40848 - DNA, 18 bp, Homo sapiens
cgctccccggcgccgctc

SEQ ID NO: 40849 - DNA, 19 bp, Homo sapiens
cgctccccggcgccgctcg

SEQ ID NO: 40850 - DNA, 21 bp, Homo sapiens
cgctccccggcgccgctcgtg

SEQ ID NO: 40851 - DNA, 20 bp, Homo sapiens
gctccccggcgccgctcgtg

SEQ ID NO: 40852 - DNA, 21 bp, Homo sapiens
gctccccggcgccgctcgtgg

SEQ ID NO: 40853 - DNA, 19 bp, Homo sapiens
ctccccggcgccgctcgtg

SEQ ID NO: 40854 - DNA, 20 bp, Homo sapiens
ctccccggcgccgctcgtgg

SEQ ID NO: 40855 - DNA, 19 bp, Homo sapiens
tccccggcgccgctcgtgg

SEQ ID NO: 40856 - DNA, 18 bp, Homo sapiens
ccccggcgccgctcgtgg

SEQ ID NO: 40857 - DNA, 19 bp, Homo sapiens
cccggcgccgctcgtgggg

SEQ ID NO: 40858 - DNA, 17 bp, Homo sapiens
ccggcgccgctcgtggg

SEQ ID NO: 40859 - DNA, 18 bp, Homo sapiens
ccggcgccgctcgtgggg

SEQ ID NO: 40860 - DNA, 19 bp, Homo sapiens
ccggcgccgctcgtggggg

SEQ ID NO: 40861 - DNA, 20 bp, Homo sapiens
ccggcgccgctcgtgggggg

SEQ ID NO: 40862 - DNA, 21 bp, Homo sapiens
ccggcgccgctcgtggggggc

SEQ ID NO: 40863 - DNA, 19 bp, Homo sapiens
gcgccgctcgtggggggcc

SEQ ID NO: 40864 - DNA, 18 bp, Homo sapiens
gctcgtggggggcccaag

SEQ ID NO: 40865 - DNA, 19 bp, Homo sapiens
gctcgtggggggcccaagt

SEQ ID NO: 40866 - DNA, 20 bp, Homo sapiens
gctcgtggggggcccaagtc

SEQ ID NO: 40867 - DNA, 21 bp, Homo sapiens
gctcgtggggggcccaagtcc

SEQ ID NO: 40868 - DNA, 22 bp, Homo sapiens
gctcgtggggggcccaagtcct

SEQ ID NO: 40869 - DNA, 23 bp, Homo sapiens
gctcgtggggggcccaagtcctt

SEQ ID NO: 40870 - DNA, 30 bp, Homo sapiens
gctcgtggggggcccaagtccttctgatcg

SEQ ID NO: 40871 - DNA, 19 bp, Homo sapiens
cgtggggggcccaagtcct

SEQ ID NO: 40872 - DNA, 30 bp, Homo sapiens; identical to SEQ ID NO: 4027

SEQ ID NO: 40873 - DNA, 17 bp, Homo sapiens
gtggggggcccaagtcc

SEQ ID NO: 40874 - DNA, 18 bp, Homo sapiens
gtggggggcccaagtcct

SEQ ID NO: 40875 - DNA, 19 bp, Homo sapiens
gtggggggcccaagtcctt

SEQ ID NO: 40876 - DNA, 20 bp, Homo sapiens
gtggggggcccaagtccttc

SEQ ID NO: 40877 - DNA, 30 bp, Homo sapiens; identical to SEQ ID NO: 4032

SEQ ID NO: 40878 - DNA, 30 bp, Homo sapiens; identical to SEQ ID NO: 4038

SEQ ID NO: 40879 - DNA, 26 bp, Homo sapiens
ggggggcccaagtccttctgatcgag

SEQ ID NO: 40880 - DNA, 25 bp, Homo sapiens
gggggcccaagtccttctgatcgag

SEQ ID NO: 40881 - DNA, 21 bp, Homo sapiens
ggggcccaagtccttctgatc

SEQ ID NO: 40882 - DNA, 22 bp, Homo sapiens
ggggcccaagtccttctgatcg

SEQ ID NO: 40883 - DNA, 24 bp, Homo sapiens
ggggcccaagtccttctgatcgag

SEQ ID NO: 40884 - DNA, 25 bp, Homo sapiens
ggggcccaagtccttctgatcgagg

SEQ ID NO: 40885 - DNA, 27 bp, Homo sapiens
ggggcccaagtccttctgatcgaggcc

SEQ ID NO: 40886 - DNA, 20 bp, Homo sapiens
gggcccaagtccttctgatc

SEQ ID NO: 40887 - DNA, 21 bp, Homo sapiens
gggcccaagtccttctgatcg

SEQ ID NO: 40888 - DNA, 23 bp, Homo sapiens
gggcccaagtccttctgatcgag

SEQ ID NO: 40889 - DNA, 24 bp, Homo sapiens
gggcccaagtccttctgatcgagg

SEQ ID NO: 40890 - DNA, 25 bp, Homo sapiens
gggcccaagtccttctgatcgaggc

SEQ ID NO: 40891 - DNA, 26 bp, Homo sapiens
gggcccaagtccttctgatcgaggcc

SEQ ID NO: 40892 - DNA, 19 bp, Homo sapiens
ggcccaagtccttctgatc

SEQ ID NO: 40893 - DNA, 20 bp, Homo sapiens
ggcccaagtccttctgatcg

SEQ ID NO: 40894 - DNA, 21 bp, Homo sapiens
ggcccaagtccttctgatcga

SEQ ID NO: 40895 - DNA, 22 bp, Homo sapiens
ggcccaagtccttctgatcgag

SEQ ID NO: 40896 - DNA, 23 bp, Homo sapiens
ggcccaagtccttctgatcgagg

SEQ ID NO: 40897 - DNA, 25 bp, Homo sapiens
ggcccaagtccttctgatcgaggcc

SEQ ID NO: 40898 - DNA, 19 bp, Homo sapiens
gcccaagtccttctgatcg

SEQ ID NO: 40899 - DNA, 23 bp, Homo sapiens
gcccaagtccttctgatcgaggc

SEQ ID NO: 40900 - DNA, 24 bp, Homo sapiens
gcccaagtccttctgatcgaggcc

SEQ ID NO: 40901 - DNA, 25 bp, Homo sapiens
gcccaagtccttctgatcgaggccc

SEQ ID NO: 40902 - DNA, 18 bp, Homo sapiens
cccaagtccttctgatcg

SEQ ID NO: 40903 - DNA, 19 bp, Homo sapiens
cccaagtccttctgatcga

SEQ ID NO: 40904 - DNA, 20 bp, Homo sapiens
cccaagtccttctgatcgag

SEQ ID NO: 40905 - DNA, 21 bp, Homo sapiens
cccaagtccttctgatcgagg

SEQ ID NO: 40906 - DNA, 22 bp, Homo sapiens
cccaagtccttctgatcgaggc

SEQ ID NO: 40907 - DNA, 23 bp, Homo sapiens
cccaagtccttctgatcgaggcc

SEQ ID NO: 40908 - DNA, 24 bp, Homo sapiens
cccaagtccttctgatcgaggccc

SEQ ID NO: 40909 - DNA, 26 bp, Homo sapiens
cccaagtccttctgatcgaggcccag

SEQ ID NO: 40910 - DNA, 16 bp, Homo sapiens
ccaagtccttctgatc

SEQ ID NO: 40911 - DNA, 17 bp, Homo sapiens
ccaagtccttctgatcg

SEQ ID NO: 40912 - DNA, 18 bp, Homo sapiens
ccaagtccttctgatcga

SEQ ID NO: 40913 - DNA, 19 bp, Homo sapiens
ccaagtccttctgatcgag

SEQ ID NO: 40914 - DNA, 20 bp, Homo sapiens
ccaagtccttctgatcgagg

SEQ ID NO: 40915 - DNA, 21 bp, Homo sapiens
ccaagtccttctgatcgaggc

SEQ ID NO: 40916 - DNA, 22 bp, Homo sapiens
ccaagtccttctgatcgaggcc

SEQ ID NO: 40917 - DNA, 23 bp, Homo sapiens
ccaagtccttctgatcgaggccc

SEQ ID NO: 40918 - DNA, 24 bp, Homo sapiens
ccaagtccttctgatcgaggccca

SEQ ID NO: 40919 - DNA, 19 bp, Homo sapiens
caagtccttctgatcgagg

SEQ ID NO: 40920 - DNA, 20 bp, Homo sapiens
caagtccttctgatcgaggc

SEQ ID NO: 40921 - DNA, 21 bp, Homo sapiens
caagtccttctgatcgaggcc

SEQ ID NO: 40922 - DNA, 22 bp, Homo sapiens
caagtccttctgatcgaggccc

SEQ ID NO: 40923 - DNA, 23 bp, Homo sapiens
caagtccttctgatcgaggccca

SEQ ID NO: 40924 - DNA, 17 bp, Homo sapiens
aagtccttctgatcgag

SEQ ID NO: 40925 - DNA, 19 bp, Homo sapiens
aagtccttctgatcgaggc

SEQ ID NO: 40926 - DNA, 20 bp, Homo sapiens
aagtccttctgatcgaggcc

SEQ ID NO: 40927 - DNA, 21 bp, Homo sapiens
aagtccttctgatcgaggccc

SEQ ID NO: 40928 - DNA, 24 bp, Homo sapiens
aagtccttctgatcgaggcccagc

SEQ ID NO: 40929 - DNA, 16 bp, Homo sapiens
agtccttctgatcgag

SEQ ID NO: 40930 - DNA, 19 bp, Homo sapiens
agtccttctgatcgaggcc

SEQ ID NO: 40931 - DNA, 20 bp, Homo sapiens
agtccttctgatcgaggccc

SEQ ID NO: 40932 - DNA, 22 bp, Homo sapiens
agtccttctgatcgaggcccag

SEQ ID NO: 40933 - DNA, 18 bp, Homo sapiens
gtccttctgatcgaggcc

SEQ ID NO: 40934 - DNA, 19 bp, Homo sapiens
gtccttctgatcgaggccc

SEQ ID NO: 40935 - DNA, 21 bp, Homo sapiens
gtccttctgatcgaggcccag

SEQ ID NO: 40936 - DNA, 17 bp, Homo sapiens
tccttctgatcgaggcc

SEQ ID NO: 40937 - DNA, 18 bp, Homo sapiens
tccttctgatcgaggccc

SEQ ID NO: 40938 - DNA, 16 bp, Homo sapiens
ccttctgatcgaggcc

SEQ ID NO: 40939 - DNA, 17 bp, Homo sapiens
ccttctgatcgaggccc

SEQ ID NO: 40940 - DNA, 19 bp, Homo sapiens
ccttctgatcgaggcccag

SEQ ID NO: 40941 - DNA, 20 bp, Homo sapiens
ccttctgatcgaggcccagc

SEQ ID NO: 40942 - DNA, 23 bp, Homo sapiens
ccttctgatcgaggcccagcccg

SEQ ID NO: 40943 - DNA, 28 bp, Homo sapiens
ccttctgatcgaggcccagcccgtggac

SEQ ID NO: 40944 - DNA, 29 bp, Homo sapiens
ccttctgatcgaggcccagcccgtggacg

SEQ ID NO: 40945 - DNA, 30 bp, Homo sapiens
ccttctgatcgaggcccagcccgtggacgg

SEQ ID NO: 40946 - DNA, 16 bp, Homo sapiens
cttctgatcgaggccc

SEQ ID NO: 40947 - DNA, 18 bp, Homo sapiens
cttctgatcgaggcccag

SEQ ID NO: 40948 - DNA, 19 bp, Homo sapiens
cttctgatcgaggcccagc

SEQ ID NO: 40949 - DNA, 20 bp, Homo sapiens
cttctgatcgaggcccagcc

SEQ ID NO: 40950 - DNA, 21 bp, Homo sapiens
cttctgatcgaggcccagccc

SEQ ID NO: 40951 - DNA, 22 bp, Homo sapiens
cttctgatcgaggcccagcccg

SEQ ID NO: 40952 - DNA, 26 bp, Homo sapiens
cttctgatcgaggcccagcccgtgga

SEQ ID NO: 40953 - DNA, 28 bp, Homo sapiens
cttctgatcgaggcccagcccgtggacg

SEQ ID NO: 40954 - DNA, 30 bp, Homo sapiens; identical to SEQ ID NO: 4091

SEQ ID NO: 40955 - DNA, 17 bp, Homo sapiens
ttctgatcgaggcccag

SEQ ID NO: 40956 - DNA, 18 bp, Homo sapiens
ttctgatcgaggcccagc

SEQ ID NO: 40957 - DNA, 19 bp, Homo sapiens
ttctgatcgaggcccagcc

SEQ ID NO: 40958 - DNA, 20 bp, Homo sapiens
ttctgatcgaggcccagccc

SEQ ID NO: 40959 - DNA, 21 bp, Homo sapiens
ttctgatcgaggcccagcccg

SEQ ID NO: 40960 - DNA, 23 bp, Homo sapiens
ttctgatcgaggcccagcccgtg

SEQ ID NO: 40961 - DNA, 24 bp, Homo sapiens
ttctgatcgaggcccagcccgtgg

SEQ ID NO: 40962 - DNA, 25 bp, Homo sapiens
ttctgatcgaggcccagcccgtgga

SEQ ID NO: 40963 - DNA, 27 bp, Homo sapiens
ttctgatcgaggcccagcccgtggacg

SEQ ID NO: 40964 - DNA, 28 bp, Homo sapiens
ttctgatcgaggcccagcccgtggacgg

SEQ ID NO: 40965 - DNA, 29 bp, Homo sapiens
ttctgatcgaggcccagcccgtggacggt

SEQ ID NO: 40966 - DNA, 30 bp, Homo sapiens; identical to SEQ ID NO: 18916

SEQ ID NO: 40967 - DNA, 16 bp, Homo sapiens
tctgatcgaggcccag

SEQ ID NO: 40968 - DNA, 22 bp, Homo sapiens
tctgatcgaggcccagcccgtg

SEQ ID NO: 40969 - DNA, 24 bp, Homo sapiens
tctgatcgaggcccagcccgtgga

SEQ ID NO: 40970 - DNA, 30 bp, Homo sapiens
tctgatcgaggcccagcccgtggacggtgt

SEQ ID NO: 40971 - DNA, 19 bp, Homo sapiens
ctgatcgaggcccagcccg

SEQ ID NO: 40972 - DNA, 20 bp, Homo sapiens
ctgatcgaggcccagcccgt

SEQ ID NO: 40973 - DNA, 21 bp, Homo sapiens
ctgatcgaggcccagcccgtg

SEQ ID NO: 40974 - DNA, 22 bp, Homo sapiens
ctgatcgaggcccagcccgtgg

SEQ ID NO: 40975 - DNA, 23 bp, Homo sapiens
ctgatcgaggcccagcccgtgga

SEQ ID NO: 40976 - DNA, 30 bp, Homo sapiens
ctgatcgaggcccagcccgtggacggtgtg

SEQ ID NO: 40977 - DNA, 23 bp, Homo sapiens
tgatcgaggcccagcccgtggac

SEQ ID NO: 40978 - DNA, 24 bp, Homo sapiens
tgatcgaggcccagcccgtggacg

SEQ ID NO: 40979 - DNA, 29 bp, Homo sapiens
tgatcgaggcccagcccgtggacggtgtg

SEQ ID NO: 40980 - DNA, 16 bp, Homo sapiens
gatcgaggcccagccc

SEQ ID NO: 40981 - DNA, 18 bp, Homo sapiens
gatcgaggcccagcccgt

SEQ ID NO: 40982 - DNA, 19 bp, Homo sapiens
gatcgaggcccagcccgtg

SEQ ID NO: 40983 - DNA, 20 bp, Homo sapiens
gatcgaggcccagcccgtgg

SEQ ID NO: 40984 - DNA, 21 bp, Homo sapiens
gatcgaggcccagcccgtgga

SEQ ID NO: 40985 - DNA, 22 bp, Homo sapiens
gatcgaggcccagcccgtggac

SEQ ID NO: 40986 - DNA, 23 bp, Homo sapiens
gatcgaggcccagcccgtggacg

SEQ ID NO: 40987 - DNA, 24 bp, Homo sapiens
gatcgaggcccagcccgtggacgg

SEQ ID NO: 40988 - DNA, 25 bp, Homo sapiens
gatcgaggcccagcccgtggacggt

SEQ ID NO: 40989 - DNA, 26 bp, Homo sapiens
gatcgaggcccagcccgtggacggtg

SEQ ID NO: 40990 - DNA, 28 bp, Homo sapiens
gatcgaggcccagcccgtggacggtgtg

SEQ ID NO: 40991 - DNA, 29 bp, Homo sapiens
gatcgaggcccagcccgtggacggtgtga

SEQ ID NO: 40992 - DNA, 30 bp, Homo sapiens; identical to SEQ ID NO: 18940

SEQ ID NO: 40993 - DNA, 22 bp, Homo sapiens
atcgaggcccagcccgtggacg

SEQ ID NO: 40994 - DNA, 24 bp, Homo sapiens
atcgaggcccagcccgtggacggt

SEQ ID NO: 40995 - DNA, 25 bp, Homo sapiens
atcgaggcccagcccgtggacggtg

SEQ ID NO: 40996 - DNA, 27 bp, Homo sapiens
atcgaggcccagcccgtggacggtgtg

SEQ ID NO: 40997 - DNA, 28 bp, Homo sapiens
atcgaggcccagcccgtggacggtgtga

SEQ ID NO: 40998 - DNA, 29 bp, Homo sapiens
atcgaggcccagcccgtggacggtgtgag

SEQ ID NO: 40999 - DNA, 30 bp, Homo sapiens; identical to SEQ ID NO: 18947

SEQ ID NO: 41000 - DNA, 21 bp, Homo sapiens
tcgaggcccagcccgtggacg

SEQ ID NO: 41001 - DNA, 22 bp, Homo sapiens
tcgaggcccagcccgtggacgg

SEQ ID NO: 41002 - DNA, 23 bp, Homo sapiens
tcgaggcccagcccgtggacggt

SEQ ID NO: 41003 - DNA, 24 bp, Homo sapiens
tcgaggcccagcccgtggacggtg

SEQ ID NO: 41004 - DNA, 26 bp, Homo sapiens
tcgaggcccagcccgtggacggtgtg

SEQ ID NO: 41005 - DNA, 27 bp, Homo sapiens
tcgaggcccagcccgtggacggtgtga

SEQ ID NO: 41006 - DNA, 28 bp, Homo sapiens
tcgaggcccagcccgtggacggtgtgag

SEQ ID NO: 41007 - DNA, 30 bp, Homo sapiens
tcgaggcccagcccgtggacggtgtgaggc

SEQ ID NO: 41008 - DNA, 17 bp, Homo sapiens
cgaggcccagcccgtgg

SEQ ID NO: 41009 - DNA, 18 bp, Homo sapiens
cgaggcccagcccgtgga

SEQ ID NO: 41010 - DNA, 20 bp, Homo sapiens
cgaggcccagcccgtggacg

SEQ ID NO: 41011 - DNA, 21 bp, Homo sapiens
cgaggcccagcccgtggacgg

SEQ ID NO: 41012 - DNA, 22 bp, Homo sapiens
cgaggcccagcccgtggacggt

SEQ ID NO: 41013 - DNA, 23 bp, Homo sapiens
cgaggcccagcccgtggacggtg

SEQ ID NO: 41014 - DNA, 24 bp, Homo sapiens
cgaggcccagcccgtggacggtgt

SEQ ID NO: 41015 - DNA, 25 bp, Homo sapiens
cgaggcccagcccgtggacggtgtg

SEQ ID NO: 41016 - DNA, 26 bp, Homo sapiens
cgaggcccagcccgtggacggtgtga

SEQ ID NO: 41017 - DNA, 27 bp, Homo sapiens
cgaggcccagcccgtggacggtgtgag

SEQ ID NO: 41018 - DNA, 29 bp, Homo sapiens
cgaggcccagcccgtggacggtgtgaggc

SEQ ID NO: 41019 - DNA, 18 bp, Homo sapiens
gaggcccagcccgtggac

SEQ ID NO: 41020 - DNA, 19 bp, Homo sapiens
gaggcccagcccgtggacg

SEQ ID NO: 41021 - DNA, 20 bp, Homo sapiens
gaggcccagcccgtggacgg

SEQ ID NO: 41022 - DNA, 21 bp, Homo sapiens
gaggcccagcccgtggacggt

SEQ ID NO: 41023 - DNA, 22 bp, Homo sapiens
gaggcccagcccgtggacggtg

SEQ ID NO: 41024 - DNA, 23 bp, Homo sapiens
gaggcccagcccgtggacggtgt

SEQ ID NO: 41025 - DNA, 24 bp, Homo sapiens
gaggcccagcccgtggacggtgtg

SEQ ID NO: 41026 - DNA, 25 bp, Homo sapiens
gaggcccagcccgtggacggtgtga

SEQ ID NO: 41027 - DNA, 26 bp, Homo sapiens
gaggcccagcccgtggacggtgtgag

SEQ ID NO: 41028 - DNA, 27 bp, Homo sapiens
gaggcccagcccgtggacggtgtgagg

SEQ ID NO: 41029 - DNA, 28 bp, Homo sapiens
gaggcccagcccgtggacggtgtgaggc

SEQ ID NO: 41030 - DNA, 16 bp, Homo sapiens
aggcccagcccgtgga

SEQ ID NO: 41031 - DNA, 17 bp, Homo sapiens
aggcccagcccgtggac

SEQ ID NO: 41032 - DNA, 18 bp, Homo sapiens
aggcccagcccgtggacg

SEQ ID NO: 41033 - DNA, 19 bp, Homo sapiens
aggcccagcccgtggacgg

SEQ ID NO: 41034 - DNA, 20 bp, Homo sapiens
aggcccagcccgtggacggt

SEQ ID NO: 41035 - DNA, 21 bp, Homo sapiens
aggcccagcccgtggacggtg

SEQ ID NO: 41036 - DNA, 22 bp, Homo sapiens
aggcccagcccgtggacggtgt

SEQ ID NO: 41037 - DNA, 23 bp, Homo sapiens
aggcccagcccgtggacggtgtg

SEQ ID NO: 41038 - DNA, 24 bp, Homo sapiens
aggcccagcccgtggacggtgtga

SEQ ID NO: 41039 - DNA, 25 bp, Homo sapiens
aggcccagcccgtggacggtgtgag

SEQ ID NO: 41040 - DNA, 26 bp, Homo sapiens
aggcccagcccgtggacggtgtgagg

SEQ ID NO: 41041 - DNA, 27 bp, Homo sapiens
aggcccagcccgtggacggtgtgaggc

SEQ ID NO: 41042 - DNA, 20 bp, Homo sapiens
ggcccagcccgtggacggtg

SEQ ID NO: 41043 - DNA, 22 bp, Homo sapiens
ggcccagcccgtggacggtgtg

SEQ ID NO: 41044 - DNA, 23 bp, Homo sapiens
ggcccagcccgtggacggtgtga

SEQ ID NO: 41045 - DNA, 24 bp, Homo sapiens
ggcccagcccgtggacggtgtgag

SEQ ID NO: 41046 - DNA, 25 bp, Homo sapiens
ggcccagcccgtggacggtgtgagg

SEQ ID NO: 41047 - DNA, 26 bp, Homo sapiens
ggcccagcccgtggacggtgtgaggc

SEQ ID NO: 41048 - DNA, 19 bp, Homo sapiens
gcccagcccgtggacggtg

SEQ ID NO: 41049 - DNA, 20 bp, Homo sapiens
gcccagcccgtggacggtgt

SEQ ID NO: 41050 - DNA, 21 bp, Homo sapiens
gcccagcccgtggacggtgtg

SEQ ID NO: 41051 - DNA, 22 bp, Homo sapiens
gcccagcccgtggacggtgtga

SEQ ID NO: 41052 - DNA, 23 bp, Homo sapiens
gcccagcccgtggacggtgtgag

SEQ ID NO: 41053 - DNA, 24 bp, Homo sapiens
gcccagcccgtggacggtgtgagg

SEQ ID NO: 41054 - DNA, 25 bp, Homo sapiens
gcccagcccgtggacggtgtgaggc

SEQ ID NO: 41055 - DNA, 18 bp, Homo sapiens
cccagcccgtggacggtg

SEQ ID NO: 41056 - DNA, 20 bp, Homo sapiens
cccagcccgtggacggtgtg

SEQ ID NO: 41057 - DNA, 21 bp, Homo sapiens
cccagcccgtggacggtgtga

SEQ ID NO: 41058 - DNA, 22 bp, Homo sapiens
cccagcccgtggacggtgtgag

SEQ ID NO: 41059 - DNA, 23 bp, Homo sapiens
cccagcccgtggacggtgtgagg

SEQ ID NO: 41060 - DNA, 24 bp, Homo sapiens
cccagcccgtggacggtgtgaggc

SEQ ID NO: 41061 - DNA, 25 bp, Homo sapiens
cccagcccgtggacggtgtgaggcc

SEQ ID NO: 41062 - DNA, 28 bp, Homo sapiens
cccagcccgtggacggtgtgaggccggt

SEQ ID NO: 41063 - DNA, 19 bp, Homo sapiens
ccagcccgtggacggtgtg

SEQ ID NO: 41064 - DNA, 20 bp, Homo sapiens
ccagcccgtggacggtgtga

SEQ ID NO: 41065 - DNA, 21 bp, Homo sapiens
ccagcccgtggacggtgtgag

SEQ ID NO: 41066 - DNA, 23 bp, Homo sapiens
ccagcccgtggacggtgtgaggc

SEQ ID NO: 41067 - DNA, 19 bp, Homo sapiens
cagcccgtggacggtgtga

SEQ ID NO: 41068 - DNA, 25 bp, Homo sapiens
cagcccgtggacggtgtgaggccgg

SEQ ID NO: 41069 - DNA, 16 bp, Homo sapiens
agcccgtggacggtgt

SEQ ID NO: 41070 - DNA, 24 bp, Homo sapiens
agcccgtggacggtgtgaggccgg

SEQ ID NO: 41071 - DNA, 30 bp, Homo sapiens
agcccgtggacggtgtgaggccggtagcgg

SEQ ID NO: 41072 - DNA, 20 bp, Homo sapiens
gcccgtggacggtgtgaggc

SEQ ID NO: 41073 - DNA, 21 bp, Homo sapiens
gcccgtggacggtgtgaggcc

SEQ ID NO: 41074 - DNA, 22 bp, Homo sapiens
gcccgtggacggtgtgaggccg

SEQ ID NO: 41075 - DNA, 23 bp, Homo sapiens
gcccgtggacggtgtgaggccgg

SEQ ID NO: 41076 - DNA, 24 bp, Homo sapiens
gcccgtggacggtgtgaggccggt

SEQ ID NO: 41077 - DNA, 30 bp, Homo sapiens
gcccgtggacggtgtgaggccggtagcggc

SEQ ID NO: 41078 - DNA, 16 bp, Homo sapiens
cccgtggacggtgtga

SEQ ID NO: 41079 - DNA, 19 bp, Homo sapiens
cccgtggacggtgtgaggc

SEQ ID NO: 41080 - DNA, 21 bp, Homo sapiens
cccgtggacggtgtgaggccg

SEQ ID NO: 41081 - DNA, 22 bp, Homo sapiens
cccgtggacggtgtgaggccgg

SEQ ID NO: 41082 - DNA, 23 bp, Homo sapiens
cccgtggacggtgtgaggccggt

SEQ ID NO: 41083 - DNA, 17 bp, Homo sapiens
ccgtggacggtgtgagg

SEQ ID NO: 41084 - DNA, 18 bp, Homo sapiens
ccgtggacggtgtgaggc

SEQ ID NO: 41085 - DNA, 19 bp, Homo sapiens
ccgtggacggtgtgaggcc

SEQ ID NO: 41086 - DNA, 21 bp, Homo sapiens
ccgtggacggtgtgaggccgg

SEQ ID NO: 41087 - DNA, 22 bp, Homo sapiens
ccgtggacggtgtgaggccggt

SEQ ID NO: 41088 - DNA, 17 bp, Homo sapiens
cgtggacggtgtgaggc

SEQ ID NO: 41089 - DNA, 20 bp, Homo sapiens
cgtggacggtgtgaggccgg

SEQ ID NO: 41090 - DNA, 21 bp, Homo sapiens
cgtggacggtgtgaggccggt

SEQ ID NO: 41091 - DNA, 16 bp, Homo sapiens
gtggacggtgtgaggc

SEQ ID NO: 41092 - DNA, 19 bp, Homo sapiens
gtggacggtgtgaggccgg

SEQ ID NO: 41093 - DNA, 20 bp, Homo sapiens
gtggacggtgtgaggccggt

SEQ ID NO: 41094 - DNA, 18 bp, Homo sapiens
tggacggtgtgaggccgg

SEQ ID NO: 41095 - DNA, 24 bp, Homo sapiens
gacggtgtgaggccggtagcggcc

SEQ ID NO: 41096 - DNA, 18 bp, Homo sapiens
ggtgtgaggccggtagcg

SEQ ID NO: 41097 - DNA, 19 bp, Homo sapiens
ggtgtgaggccggtagcgg

SEQ ID NO: 41098 - DNA, 18 bp, Homo sapiens
gtgtgaggccggtagcgg

SEQ ID NO: 41099 - DNA, 19 bp, Homo sapiens
ggccggtagcggcccccgg

SEQ ID NO: 41100 - DNA, 27 bp, Homo sapiens
ggccggtagcggcccccggcgcgccgg

SEQ ID NO: 41101 - DNA, 18 bp, Homo sapiens
gccggtagcggcccccgg

SEQ ID NO: 41102 - DNA, 18 bp, Homo sapiens
ccggtagcggcccccggc

SEQ ID NO: 41103 - DNA, 19 bp, Homo sapiens
ccggtagcggcccccggcg

SEQ ID NO: 41104 - DNA, 20 bp, Homo sapiens
ccggtagcggcccccggcgc

SEQ ID NO: 41105 - DNA, 21 bp, Homo sapiens
ccggtagcggcccccggcgcg

SEQ ID NO: 41106 - DNA, 22 bp, Homo sapiens
ccggtagcggcccccggcgcgc

SEQ ID NO: 41107 - DNA, 23 bp, Homo sapiens
ccggtagcggcccccggcgcgcc

SEQ ID NO: 41108 - DNA, 18 bp, Homo sapiens
cggtagcggcccccggcg

SEQ ID NO: 41109 - DNA, 19 bp, Homo sapiens
cggtagcggcccccggcgc

SEQ ID NO: 41110 - DNA, 20 bp, Homo sapiens
cggtagcggcccccggcgcg

SEQ ID NO: 41111 - DNA, 21 bp, Homo sapiens
cggtagcggcccccggcgcgc

SEQ ID NO: 41112 - DNA, 22 bp, Homo sapiens
cggtagcggcccccggcgcgcc

SEQ ID NO: 41113 - DNA, 16 bp, Homo sapiens
ggtagcggcccccggc

SEQ ID NO: 41114 - DNA, 17 bp, Homo sapiens
ggtagcggcccccggcg

SEQ ID NO: 41115 - DNA, 18 bp, Homo sapiens
ggtagcggcccccggcgc

SEQ ID NO: 41116 - DNA, 19 bp, Homo sapiens
ggtagcggcccccggcgcg

SEQ ID NO: 41117 - DNA, 20 bp, Homo sapiens
ggtagcggcccccggcgcgc

SEQ ID NO: 41118 - DNA, 21 bp, Homo sapiens
ggtagcggcccccggcgcgcc

SEQ ID NO: 41119 - DNA, 22 bp, Homo sapiens
ggtagcggcccccggcgcgccg

SEQ ID NO: 41120 - DNA, 16 bp, Homo sapiens
gtagcggcccccggcg

SEQ ID NO: 41121 - DNA, 18 bp, Homo sapiens
gtagcggcccccggcgcg

SEQ ID NO: 41122 - DNA, 19 bp, Homo sapiens
gtagcggcccccggcgcgc

SEQ ID NO: 41123 - DNA, 20 bp, Homo sapiens
gtagcggcccccggcgcgcc

SEQ ID NO: 41124 - DNA, 21 bp, Homo sapiens
gtagcggcccccggcgcgccg

SEQ ID NO: 41125 - DNA, 18 bp, Homo sapiens
gcggcccccggcgcgccg

SEQ ID NO: 41126 - DNA, 22 bp, Homo sapiens
gcggcccccggcgcgccgggcc

SEQ ID NO: 41127 - DNA, 19 bp, Homo sapiens
cggcccccggcgcgccggg

SEQ ID NO: 41128 - DNA, 17 bp, Homo sapiens
ggcccccggcgcgccgg

SEQ ID NO: 41129 - DNA, 18 bp, Homo sapiens
ggcccccggcgcgccggg

SEQ ID NO: 41130 - DNA, 19 bp, Homo sapiens
ggcccccggcgcgccgggc

SEQ ID NO: 41131 - DNA, 20 bp, Homo sapiens
ggcccccggcgcgccgggcc

SEQ ID NO: 41132 - DNA, 24 bp, Homo sapiens
ggcccccggcgcgccgggcccggg

SEQ ID NO: 41133 - DNA, 30 bp, Homo sapiens
ggcccccggcgcgccgggcccgggtcttcc

SEQ ID NO: 41134 - DNA, 23 bp, Homo sapiens
gcccccggcgcgccgggcccggg

SEQ ID NO: 41135 - DNA, 21 bp, Homo sapiens
cccccggcgcgccgggcccgg

SEQ ID NO: 41136 - DNA, 22 bp, Homo sapiens
cccccggcgcgccgggcccggg

SEQ ID NO: 41137 - DNA, 20 bp, Homo sapiens
ccccggcgcgccgggcccgg

SEQ ID NO: 41138 - DNA, 21 bp, Homo sapiens
ccccggcgcgccgggcccggg

SEQ ID NO: 41139 - DNA, 19 bp, Homo sapiens
cccggcgcgccgggcccgg

SEQ ID NO: 41140 - DNA, 20 bp, Homo sapiens
cccggcgcgccgggcccggg

SEQ ID NO: 41141 - DNA, 18 bp, Homo sapiens
ccggcgcgccgggcccgg

SEQ ID NO: 41142 - DNA, 19 bp, Homo sapiens
ccggcgcgccgggcccggg

SEQ ID NO: 41143 - DNA, 18 bp, Homo sapiens
cggcgcgccgggcccggg

SEQ ID NO: 41144 - DNA, 17 bp, Homo sapiens
ggcgcgccgggcccggg

SEQ ID NO: 41145 - DNA, 19 bp, Homo sapiens
ggcgcgccgggcccgggtc

SEQ ID NO: 41146 - DNA, 23 bp, Homo sapiens
ggcgcgccgggcccgggtcttcc

SEQ ID NO: 41147 - DNA, 21 bp, Homo sapiens
cgcgccgggcccgggtcttcc

SEQ ID NO: 41148 - DNA, 22 bp, Homo sapiens
cgcgccgggcccgggtcttccc

SEQ ID NO: 41149 - DNA, 23 bp, Homo sapiens
cgcgccgggcccgggtcttcccg

SEQ ID NO: 41150 - DNA, 20 bp, Homo sapiens
gcgccgggcccgggtcttcc

SEQ ID NO: 41151 - DNA, 21 bp, Homo sapiens
gcgccgggcccgggtcttccc

SEQ ID NO: 41152 - DNA, 22 bp, Homo sapiens
gcgccgggcccgggtcttcccg

SEQ ID NO: 41153 - DNA, 18 bp, Homo sapiens
cgccgggcccgggtcttc

SEQ ID NO: 41154 - DNA, 19 bp, Homo sapiens
cgccgggcccgggtcttcc

SEQ ID NO: 41155 - DNA, 20 bp, Homo sapiens
cgccgggcccgggtcttccc

SEQ ID NO: 41156 - DNA, 21 bp, Homo sapiens
cgccgggcccgggtcttcccg

SEQ ID NO: 41157 - DNA, 18 bp, Homo sapiens
gccgggcccgggtcttcc

SEQ ID NO: 41158 - DNA, 19 bp, Homo sapiens
gccgggcccgggtcttccc

SEQ ID NO: 41159 - DNA, 20 bp, Homo sapiens
gccgggcccgggtcttcccg

SEQ ID NO: 41160 - DNA, 18 bp, Homo sapiens
ccgggcccgggtcttccc

SEQ ID NO: 41161 - DNA, 19 bp, Homo sapiens
ccgggcccgggtcttcccg

SEQ ID NO: 41162 - DNA, 24 bp, Homo sapiens
gggcccgggtcttcccggagtcgg

SEQ ID NO: 41163 - DNA, 21 bp, Homo sapiens
cccgggtcttcccggagtcgg

SEQ ID NO: 41164 - DNA, 19 bp, Homo sapiens
cgggtcttcccggagtcgg

SEQ ID NO: 41165 - DNA, 22 bp, Homo sapiens
cgggtcttcccggagtcgggtt

SEQ ID NO: 41166 - DNA, 18 bp, Homo sapiens
gggtcttcccggagtcgg

SEQ ID NO: 41167 - DNA, 21 bp, Homo sapiens
gggtcttcccggagtcgggtt

SEQ ID NO: 41168 - DNA, 17 bp, Homo sapiens
ggtcttcccggagtcgg

SEQ ID NO: 41169 - DNA, 20 bp, Homo sapiens
ggtcttcccggagtcgggtt

SEQ ID NO: 41170 - DNA, 16 bp, Homo sapiens
gtcttcccggagtcgg

SEQ ID NO: 41171 - DNA, 19 bp, Homo sapiens
gtcttcccggagtcgggtt

SEQ ID NO: 41172 - DNA, 27 bp, Homo sapiens
gtcttcccggagtcgggttgcttggga

SEQ ID NO: 41173 - DNA, 18 bp, Homo sapiens
tcttcccggagtcgggtt

SEQ ID NO: 41174 - DNA, 19 bp, Homo sapiens
tcttcccggagtcgggttg

SEQ ID NO: 41175 - DNA, 25 bp, Homo sapiens
tcttcccggagtcgggttgcttggg

SEQ ID NO: 41176 - DNA, 26 bp, Homo sapiens
tcttcccggagtcgggttgcttggga

SEQ ID NO: 41177 - DNA, 27 bp, Homo sapiens
tcttcccggagtcgggttgcttgggaa

SEQ ID NO: 41178 - DNA, 30 bp, Homo sapiens
tcttcccggagtcgggttgcttgggaatgc

SEQ ID NO: 41179 - DNA, 17 bp, Homo sapiens
cttcccggagtcgggtt

SEQ ID NO: 41180 - DNA, 18 bp, Homo sapiens
cttcccggagtcgggttg

SEQ ID NO: 41181 - DNA, 19 bp, Homo sapiens
cttcccggagtcgggttgc

SEQ ID NO: 41182 - DNA, 24 bp, Homo sapiens
cttcccggagtcgggttgcttggg

SEQ ID NO: 41183 - DNA, 25 bp, Homo sapiens
cttcccggagtcgggttgcttggga

SEQ ID NO: 41184 - DNA, 26 bp, Homo sapiens
cttcccggagtcgggttgcttgggaa

SEQ ID NO: 41185 - DNA, 27 bp, Homo sapiens
cttcccggagtcgggttgcttgggaat

SEQ ID NO: 41186 - DNA, 28 bp, Homo sapiens
cttcccggagtcgggttgcttgggaatg

SEQ ID NO: 41187 - DNA, 29 bp, Homo sapiens
cttcccggagtcgggttgcttgggaatgc

SEQ ID NO: 41188 - DNA, 16 bp, Homo sapiens
ttcccggagtcgggtt

SEQ ID NO: 41189 - DNA, 17 bp, Homo sapiens
ttcccggagtcgggttg

SEQ ID NO: 41190 - DNA, 18 bp, Homo sapiens
ttcccggagtcgggttgc

SEQ ID NO: 41191 - DNA, 19 bp, Homo sapiens
ttcccggagtcgggttgct

SEQ ID NO: 41192 - DNA, 20 bp, Homo sapiens
ttcccggagtcgggttgctt

SEQ ID NO: 41193 - DNA, 21 bp, Homo sapiens
ttcccggagtcgggttgcttg

SEQ ID NO: 41194 - DNA, 22 bp, Homo sapiens
ttcccggagtcgggttgcttgg

SEQ ID NO: 41195 - DNA, 23 bp, Homo sapiens
ttcccggagtcgggttgcttggg

SEQ ID NO: 41196 - DNA, 24 bp, Homo sapiens
ttcccggagtcgggttgcttggga

SEQ ID NO: 41197 - DNA, 25 bp, Homo sapiens
ttcccggagtcgggttgcttgggaa

SEQ ID NO: 41198 - DNA, 26 bp, Homo sapiens
ttcccggagtcgggttgcttgggaat

SEQ ID NO: 41199 - DNA, 27 bp, Homo sapiens
ttcccggagtcgggttgcttgggaatg

SEQ ID NO: 41200 - DNA, 28 bp, Homo sapiens
ttcccggagtcgggttgcttgggaatgc

SEQ ID NO: 41201 - DNA, 30 bp, Homo sapiens
ttcccggagtcgggttgcttgggaatgcag

SEQ ID NO: 41202 - DNA, 20 bp, Homo sapiens
tcccggagtcgggttgcttg

SEQ ID NO: 41203 - DNA, 21 bp, Homo sapiens
tcccggagtcgggttgcttgg

SEQ ID NO: 41204 - DNA, 22 bp, Homo sapiens
tcccggagtcgggttgcttggg

SEQ ID NO: 41205 - DNA, 23 bp, Homo sapiens
tcccggagtcgggttgcttggga

SEQ ID NO: 41206 - DNA, 24 bp, Homo sapiens
tcccggagtcgggttgcttgggaa

SEQ ID NO: 41207 - DNA, 25 bp, Homo sapiens
tcccggagtcgggttgcttgggaat

SEQ ID NO: 41208 - DNA, 26 bp, Homo sapiens
tcccggagtcgggttgcttgggaatg

SEQ ID NO: 41209 - DNA, 27 bp, Homo sapiens
tcccggagtcgggttgcttgggaatgc

SEQ ID NO: 41210 - DNA, 16 bp, Homo sapiens
cccggagtcgggttgc

SEQ ID NO: 41211 - DNA, 19 bp, Homo sapiens
cccggagtcgggttgcttg

SEQ ID NO: 41212 - DNA, 20 bp, Homo sapiens
cccggagtcgggttgcttgg

SEQ ID NO: 41213 - DNA, 21 bp, Homo sapiens
cccggagtcgggttgcttggg

SEQ ID NO: 41214 - DNA, 22 bp, Homo sapiens
cccggagtcgggttgcttggga

SEQ ID NO: 41215 - DNA, 26 bp, Homo sapiens
cccggagtcgggttgcttgggaatgc

SEQ ID NO: 41216 - DNA, 18 bp, Homo sapiens
ccggagtcgggttgcttg

SEQ ID NO: 41217 - DNA, 19 bp, Homo sapiens
ccggagtcgggttgcttgg

SEQ ID NO: 41218 - DNA, 20 bp, Homo sapiens
ccggagtcgggttgcttggg

SEQ ID NO: 41219 - DNA, 21 bp, Homo sapiens
ccggagtcgggttgcttggga

SEQ ID NO: 41220 - DNA, 24 bp, Homo sapiens
ccggagtcgggttgcttgggaatg

SEQ ID NO: 41221 - DNA, 25 bp, Homo sapiens
ccggagtcgggttgcttgggaatgc

SEQ ID NO: 41222 - DNA, 17 bp, Homo sapiens
cggagtcgggttgcttg

SEQ ID NO: 41223 - DNA, 18 bp, Homo sapiens
cggagtcgggttgcttgg

SEQ ID NO: 41224 - DNA, 19 bp, Homo sapiens
cggagtcgggttgcttggg

SEQ ID NO: 41225 - DNA, 20 bp, Homo sapiens
cggagtcgggttgcttggga

SEQ ID NO: 41226 - DNA, 21 bp, Homo sapiens
cggagtcgggttgcttgggaa

SEQ ID NO: 41227 - DNA, 22 bp, Homo sapiens
cggagtcgggttgcttgggaat

SEQ ID NO: 41228 - DNA, 23 bp, Homo sapiens
cggagtcgggttgcttgggaatg

SEQ ID NO: 41229 - DNA, 24 bp, Homo sapiens
cggagtcgggttgcttgggaatgc

SEQ ID NO: 41230 - DNA, 17 bp, Homo sapiens
ggagtcgggttgcttgg

SEQ ID NO: 41231 - DNA, 18 bp, Homo sapiens
ggagtcgggttgcttggg

SEQ ID NO: 41232 - DNA, 19 bp, Homo sapiens
ggagtcgggttgcttggga

SEQ ID NO: 41233 - DNA, 21 bp, Homo sapiens
ggagtcgggttgcttgggaat

SEQ ID NO: 41234 - DNA, 22 bp, Homo sapiens
ggagtcgggttgcttgggaatg

SEQ ID NO: 41235 - DNA, 23 bp, Homo sapiens
ggagtcgggttgcttgggaatgc

SEQ ID NO: 41236 - DNA, 16 bp, Homo sapiens
gagtcgggttgcttgg

SEQ ID NO: 41237 - DNA, 17 bp, Homo sapiens
gagtcgggttgcttggg

SEQ ID NO: 41238 - DNA, 18 bp, Homo sapiens
gagtcgggttgcttggga

SEQ ID NO: 41239 - DNA, 19 bp, Homo sapiens
gagtcgggttgcttgggaa

SEQ ID NO: 41240 - DNA, 20 bp, Homo sapiens
gagtcgggttgcttgggaat

SEQ ID NO: 41241 - DNA, 21 bp, Homo sapiens
gagtcgggttgcttgggaatg

SEQ ID NO: 41242 - DNA, 22 bp, Homo sapiens
gagtcgggttgcttgggaatgc

SEQ ID NO: 41243 - DNA, 24 bp, Homo sapiens
gagtcgggttgcttgggaatgcag

SEQ ID NO: 41244 - DNA, 16 bp, Homo sapiens
agtcgggttgcttggg

SEQ ID NO: 41245 - DNA, 17 bp, Homo sapiens
agtcgggttgcttggga

SEQ ID NO: 41246 - DNA, 18 bp, Homo sapiens
agtcgggttgcttgggaa

SEQ ID NO: 41247 - DNA, 19 bp, Homo sapiens
agtcgggttgcttgggaat

SEQ ID NO: 41248 - DNA, 20 bp, Homo sapiens
agtcgggttgcttgggaatg

SEQ ID NO: 41249 - DNA, 21 bp, Homo sapiens
agtcgggttgcttgggaatgc

SEQ ID NO: 41250 - DNA, 23 bp, Homo sapiens
agtcgggttgcttgggaatgcag

SEQ ID NO: 41251 - DNA, 16 bp, Homo sapiens
gtcgggttgcttggga

SEQ ID NO: 41252 - DNA, 19 bp, Homo sapiens
gtcgggttgcttgggaatg

SEQ ID NO: 41253 - DNA, 22 bp, Homo sapiens
gtcgggttgcttgggaatgcag

SEQ ID NO: 41254 - DNA, 18 bp, Homo sapiens
tcgggttgcttgggaatg

SEQ ID NO: 41255 - DNA, 21 bp, Homo sapiens
tcgggttgcttgggaatgcag

SEQ ID NO: 41256 - DNA, 20 bp, Homo sapiens
cgggttgcttgggaatgcag

SEQ ID NO: 41257 - DNA, 16 bp, Homo sapiens
ggttgcttgggaatgc

SEQ ID NO: 41258 - DNA, 18 bp, Homo sapiens
ggttgcttgggaatgcag

SEQ ID NO: 41259 - DNA, 19 bp, Homo sapiens
ggttgcttgggaatgcagc

SEQ ID NO: 41260 - DNA, 19 bp, Homo sapiens
gcagcccaaagcgggtggt

SEQ ID NO: 41261 - DNA, 20 bp, Homo sapiens
gcagcccaaagcgggtggta

SEQ ID NO: 41262 - DNA, 30 bp, Homo sapiens
ggtggtaaactccatctaaggctaaatacc

SEQ ID NO: 41263 - DNA, 26 bp, Homo sapiens
aactccatctaaggctaaataccggc

SEQ ID NO: 41264 - DNA, 24 bp, Homo sapiens
actccatctaaggctaaataccgg

SEQ ID NO: 41265 - DNA, 25 bp, Homo sapiens
actccatctaaggctaaataccggc

SEQ ID NO: 41266 - DNA, 26 bp, Homo sapiens
actccatctaaggctaaataccggca

SEQ ID NO: 41267 - DNA, 22 bp, Homo sapiens
tccatctaaggctaaataccgg

SEQ ID NO: 41268 - DNA, 23 bp, Homo sapiens
tccatctaaggctaaataccggc

SEQ ID NO: 41269 - DNA, 21 bp, Homo sapiens
ccatctaaggctaaataccgg

SEQ ID NO: 41270 - DNA, 22 bp, Homo sapiens
ccatctaaggctaaataccggc

SEQ ID NO: 41271 - DNA, 23 bp, Homo sapiens
ccatctaaggctaaataccggca

SEQ ID NO: 41272 - DNA, 24 bp, Homo sapiens
ccatctaaggctaaataccggcac

SEQ ID NO: 41273 - DNA, 25 bp, Homo sapiens
ccatctaaggctaaataccggcacg

SEQ ID NO: 41274 - DNA, 26 bp, Homo sapiens
ccatctaaggctaaataccggcacga

SEQ ID NO: 41275 - DNA, 27 bp, Homo sapiens
ccatctaaggctaaataccggcacgag

SEQ ID NO: 41276 - DNA, 28 bp, Homo sapiens
ccatctaaggctaaataccggcacgaga

SEQ ID NO: 41277 - DNA, 29 bp, Homo sapiens
ccatctaaggctaaataccggcacgagac

SEQ ID NO: 41278 - DNA, 30 bp, Homo sapiens
ccatctaaggctaaataccggcacgagacc

SEQ ID NO: 41279 - DNA, 20 bp, Homo sapiens
catctaaggctaaataccgg

SEQ ID NO: 41280 - DNA, 21 bp, Homo sapiens
catctaaggctaaataccggc

SEQ ID NO: 41281 - DNA, 22 bp, Homo sapiens
catctaaggctaaataccggca

SEQ ID NO: 41282 - DNA, 20 bp, Homo sapiens
atctaaggctaaataccggc

SEQ ID NO: 41283 - DNA, 16 bp, Homo sapiens
aaggctaaataccggc

SEQ ID NO: 41284 - DNA, 17 bp, Homo sapiens
aaggctaaataccggca

SEQ ID NO: 41285 - DNA, 18 bp, Homo sapiens
aaggctaaataccggcac

SEQ ID NO: 41286 - DNA, 19 bp, Homo sapiens
aaggctaaataccggcacg

SEQ ID NO: 41287 - DNA, 20 bp, Homo sapiens
aaggctaaataccggcacga

SEQ ID NO: 41288 - DNA, 21 bp, Homo sapiens
aaggctaaataccggcacgag

SEQ ID NO: 41289 - DNA, 23 bp, Homo sapiens
aaggctaaataccggcacgagac

SEQ ID NO: 41290 - DNA, 26 bp, Homo sapiens
aaggctaaataccggcacgagaccga

SEQ ID NO: 41291 - DNA, 27 bp, Homo sapiens
aaggctaaataccggcacgagaccgat

SEQ ID NO: 41292 - DNA, 20 bp, Homo sapiens
gctaaataccggcacgagac

SEQ ID NO: 41293 - DNA, 21 bp, Homo sapiens
gctaaataccggcacgagacc

SEQ ID NO: 41294 - DNA, 22 bp, Homo sapiens
gctaaataccggcacgagaccg

SEQ ID NO: 41295 - DNA, 23 bp, Homo sapiens
gctaaataccggcacgagaccga

SEQ ID NO: 41296 - DNA, 24 bp, Homo sapiens
gctaaataccggcacgagaccgat

SEQ ID NO: 41297 - DNA, 25 bp, Homo sapiens
gctaaataccggcacgagaccgata

SEQ ID NO: 41298 - DNA, 22 bp, Homo sapiens
ctaaataccggcacgagaccga

SEQ ID NO: 41299 - DNA, 23 bp, Homo sapiens
ctaaataccggcacgagaccgat

SEQ ID NO: 41300 - DNA, 24 bp, Homo sapiens
ctaaataccggcacgagaccgata

SEQ ID NO: 41301 - DNA, 17 bp, Homo sapiens
ggcacgagaccgatagt

SEQ ID NO: 41302 - DNA, 19 bp, Homo sapiens
ggcacgagaccgatagtca

SEQ ID NO: 41303 - DNA, 20 bp, Homo sapiens
ggcacgagaccgatagtcaa

SEQ ID NO: 41304 - DNA, 22 bp, Homo sapiens
ggcacgagaccgatagtcaaca

SEQ ID NO: 41305 - DNA, 19 bp, Homo sapiens
cacgagaccgatagtcaac

SEQ ID NO: 41306 - DNA, 20 bp, Homo sapiens
cacgagaccgatagtcaaca

SEQ ID NO: 41307 - DNA, 21 bp, Homo sapiens
cacgagaccgatagtcaacaa

SEQ ID NO: 41308 - DNA, 22 bp, Homo sapiens
cacgagaccgatagtcaacaag

SEQ ID NO: 41309 - DNA, 23 bp, Homo sapiens
cacgagaccgatagtcaacaagt

SEQ ID NO: 41310 - DNA, 24 bp, Homo sapiens
cacgagaccgatagtcaacaagta

SEQ ID NO: 41311 - DNA, 25 bp, Homo sapiens
cacgagaccgatagtcaacaagtac

SEQ ID NO: 41312 - DNA, 29 bp, Homo sapiens
cacgagaccgatagtcaacaagtaccgta

SEQ ID NO: 41313 - DNA, 21 bp, Homo sapiens
cgagaccgatagtcaacaagt

SEQ ID NO: 41314 - DNA, 30 bp, Homo sapiens; identical to SEQ ID NO: 19196

SEQ ID NO: 41315 - DNA, 16 bp, Homo sapiens
accgatagtcaacaag

SEQ ID NO: 41316 - DNA, 20 bp, Homo sapiens
ccgatagtcaacaagtaccg

SEQ ID NO: 41317 - DNA, 30 bp, Homo sapiens
ccgatagtcaacaagtaccgtaagggaaag

SEQ ID NO: 41318 - DNA, 30 bp, Homo sapiens
gatagtcaacaagtaccgtaagggaaagtt

SEQ ID NO: 41319 - DNA, 25 bp, Homo sapiens
gtcaacaagtaccgtaagggaaagt

SEQ ID NO: 41320 - DNA, 26 bp, Homo sapiens
tcaacaagtaccgtaagggaaagttg

SEQ ID NO: 41321 - DNA, 23 bp, Homo sapiens
caacaagtaccgtaagggaaagt

SEQ ID NO: 41322 - DNA, 25 bp, Homo sapiens
caacaagtaccgtaagggaaagttg

SEQ ID NO: 41323 - DNA, 19 bp, Homo sapiens
caagtaccgtaagggaaag

SEQ ID NO: 41324 - DNA, 20 bp, Homo sapiens
caagtaccgtaagggaaagt

SEQ ID NO: 41325 - DNA, 22 bp, Homo sapiens
caagtaccgtaagggaaagttg

SEQ ID NO: 41326 - DNA, 27 bp, Homo sapiens
caagtaccgtaagggaaagttgaaaag

SEQ ID NO: 41327 - DNA, 30 bp, Homo sapiens
caagtaccgtaagggaaagttgaaaagaac

SEQ ID NO: 41328 - DNA, 20 bp, Homo sapiens
gtaccgtaagggaaagttga

SEQ ID NO: 41329 - DNA, 30 bp, Homo sapiens
taccgtaagggaaagttgaaaagaactttg

SEQ ID NO: 41330 - DNA, 29 bp, Homo sapiens
accgtaagggaaagttgaaaagaactttg

SEQ ID NO: 41331 - DNA, 20 bp, Homo sapiens
ccgtaagggaaagttgaaaa

SEQ ID NO: 41332 - DNA, 21 bp, Homo sapiens
ccgtaagggaaagttgaaaag

SEQ ID NO: 41333 - DNA, 29 bp, Homo sapiens
ccgtaagggaaagttgaaaagaactttga

SEQ ID NO: 41334 - DNA, 16 bp, Homo sapiens
cgtaagggaaagttga

SEQ ID NO: 41335 - DNA, 18 bp, Homo sapiens
cgtaagggaaagttgaaa

SEQ ID NO: 41336 - DNA, 20 bp, Homo sapiens
cgtaagggaaagttgaaaag

SEQ ID NO: 41337 - DNA, 21 bp, Homo sapiens
cgtaagggaaagttgaaaaga

SEQ ID NO: 41338 - DNA, 22 bp, Homo sapiens
cgtaagggaaagttgaaaagaa

SEQ ID NO: 41339 - DNA, 23 bp, Homo sapiens
cgtaagggaaagttgaaaagaac

SEQ ID NO: 41340 - DNA, 24 bp, Homo sapiens
cgtaagggaaagttgaaaagaact

SEQ ID NO: 41341 - DNA, 29 bp, Homo sapiens
cgtaagggaaagttgaaaagaactttgaa

SEQ ID NO: 41342 - DNA, 30 bp, Homo sapiens
cgtaagggaaagttgaaaagaactttgaag

SEQ ID NO: 41343 - DNA, 16 bp, Homo sapiens
gtaagggaaagttgaa

SEQ ID NO: 41344 - DNA, 17 bp, Homo sapiens
gtaagggaaagttgaaa

SEQ ID NO: 41345 - DNA, 18 bp, Homo sapiens
gtaagggaaagttgaaaa

SEQ ID NO: 41346 - DNA, 19 bp, Homo sapiens
gtaagggaaagttgaaaag

SEQ ID NO: 41347 - DNA, 28 bp, Homo sapiens
gtaagggaaagttgaaaagaactttgaa

SEQ ID NO: 41348 - DNA, 29 bp, Homo sapiens
gtaagggaaagttgaaaagaactttgaag

SEQ ID NO: 41349 - DNA, 26 bp, Homo sapiens
taagggaaagttgaaaagaactttga

SEQ ID NO: 41350 - DNA, 27 bp, Homo sapiens
taagggaaagttgaaaagaactttgaa

SEQ ID NO: 41351 - DNA, 28 bp, Homo sapiens
taagggaaagttgaaaagaactttgaag

SEQ ID NO: 41352 - DNA, 30 bp, Homo sapiens
taagggaaagttgaaaagaactttgaagag

SEQ ID NO: 41353 - DNA, 17 bp, Homo sapiens
aagggaaagttgaaaag

SEQ ID NO: 41354 - DNA, 25 bp, Homo sapiens
aagggaaagttgaaaagaactttga

SEQ ID NO: 41355 - DNA, 26 bp, Homo sapiens
aagggaaagttgaaaagaactttgaa

SEQ ID NO: 41356 - DNA, 27 bp, Homo sapiens
aagggaaagttgaaaagaactttgaag

SEQ ID NO: 41357 - DNA, 29 bp, Homo sapiens
aagggaaagttgaaaagaactttgaagag

SEQ ID NO: 41358 - DNA, 30 bp, Homo sapiens
aagggaaagttgaaaagaactttgaagaga

SEQ ID NO: 41359 - DNA, 19 bp, Homo sapiens
agggaaagttgaaaagaac

SEQ ID NO: 41360 - DNA, 23 bp, Homo sapiens
agggaaagttgaaaagaactttg

SEQ ID NO: 41361 - DNA, 24 bp, Homo sapiens
agggaaagttgaaaagaactttga

SEQ ID NO: 41362 - DNA, 25 bp, Homo sapiens
agggaaagttgaaaagaactttgaa

SEQ ID NO: 41363 - DNA, 26 bp, Homo sapiens
agggaaagttgaaaagaactttgaag

SEQ ID NO: 41364 - DNA, 28 bp, Homo sapiens
agggaaagttgaaaagaactttgaagag

SEQ ID NO: 41365 - DNA, 29 bp, Homo sapiens
agggaaagttgaaaagaactttgaagaga

SEQ ID NO: 41366 - DNA, 30 bp, Homo sapiens
agggaaagttgaaaagaactttgaagagag

SEQ ID NO: 41367 - DNA, 16 bp, Homo sapiens
gggaaagttgaaaaga

SEQ ID NO: 41368 - DNA, 17 bp, Homo sapiens
gggaaagttgaaaagaa

SEQ ID NO: 41369 - DNA, 18 bp, Homo sapiens
gggaaagttgaaaagaac

SEQ ID NO: 41370 - DNA, 19 bp, Homo sapiens
gggaaagttgaaaagaact

SEQ ID NO: 41371 - DNA, 20 bp, Homo sapiens
gggaaagttgaaaagaactt

SEQ ID NO: 41372 - DNA, 21 bp, Homo sapiens
gggaaagttgaaaagaacttt

SEQ ID NO: 41373 - DNA, 22 bp, Homo sapiens
gggaaagttgaaaagaactttg

SEQ ID NO: 41374 - DNA, 23 bp, Homo sapiens
gggaaagttgaaaagaactttga

SEQ ID NO: 41375 - DNA, 24 bp, Homo sapiens
gggaaagttgaaaagaactttgaa

SEQ ID NO: 41376 - DNA, 25 bp, Homo sapiens
gggaaagttgaaaagaactttgaag

SEQ ID NO: 41377 - DNA, 27 bp, Homo sapiens
gggaaagttgaaaagaactttgaagag

SEQ ID NO: 41378 - DNA, 29 bp, Homo sapiens
gggaaagttgaaaagaactttgaagagag

SEQ ID NO: 41379 - DNA, 30 bp, Homo sapiens; identical to SEQ ID NO: 19233

SEQ ID NO: 41380 - DNA, 24 bp, Homo sapiens
ggaaagttgaaaagaactttgaag

SEQ ID NO: 41381 - DNA, 28 bp, Homo sapiens
gaaagttgaaaagaactttgaagagaga

SEQ ID NO: 41382 - DNA, 20 bp, Homo sapiens
aaagttgaaaagaactttga

SEQ ID NO: 41383 - DNA, 22 bp, Homo sapiens
aaagttgaaaagaactttgaag

SEQ ID NO: 41384 - DNA, 27 bp, Homo sapiens
aaagttgaaaagaactttgaagagaga

SEQ ID NO: 41385 - DNA, 28 bp, Homo sapiens
aaagttgaaaagaactttgaagagagag

SEQ ID NO: 41386 - DNA, 19 bp, Homo sapiens
aagttgaaaagaactttga

SEQ ID NO: 41387 - DNA, 21 bp, Homo sapiens
aagttgaaaagaactttgaag

SEQ ID NO: 41388 - DNA, 23 bp, Homo sapiens
aagttgaaaagaactttgaagag

SEQ ID NO: 41389 - DNA, 25 bp, Homo sapiens
aagttgaaaagaactttgaagagag

SEQ ID NO: 41390 - DNA, 26 bp, Homo sapiens
aagttgaaaagaactttgaagagaga

SEQ ID NO: 41391 - DNA, 27 bp, Homo sapiens
aagttgaaaagaactttgaagagagag

SEQ ID NO: 41392 - DNA, 28 bp, Homo sapiens
aagttgaaaagaactttgaagagagagt

SEQ ID NO: 41393 - DNA, 17 bp, Homo sapiens
agttgaaaagaactttg

SEQ ID NO: 41394 - DNA, 18 bp, Homo sapiens
agttgaaaagaactttga

SEQ ID NO: 41395 - DNA, 20 bp, Homo sapiens
agttgaaaagaactttgaag

SEQ ID NO: 41396 - DNA, 22 bp, Homo sapiens
agttgaaaagaactttgaagag

SEQ ID NO: 41397 - DNA, 23 bp, Homo sapiens
agttgaaaagaactttgaagaga

SEQ ID NO: 41398 - DNA, 24 bp, Homo sapiens
agttgaaaagaactttgaagagag

SEQ ID NO: 41399 - DNA, 25 bp, Homo sapiens
agttgaaaagaactttgaagagaga

SEQ ID NO: 41400 - DNA, 26 bp, Homo sapiens
agttgaaaagaactttgaagagagag

SEQ ID NO: 41401 - DNA, 27 bp, Homo sapiens
agttgaaaagaactttgaagagagagt

SEQ ID NO: 41402 - DNA, 28 bp, Homo sapiens
agttgaaaagaactttgaagagagagtt

SEQ ID NO: 41403 - DNA, 29 bp, Homo sapiens
agttgaaaagaactttgaagagagagttc

SEQ ID NO: 41404 - DNA, 16 bp, Homo sapiens
gttgaaaagaactttg

SEQ ID NO: 41405 - DNA, 17 bp, Homo sapiens
gttgaaaagaactttga

SEQ ID NO: 41406 - DNA, 18 bp, Homo sapiens
gttgaaaagaactttgaa

SEQ ID NO: 41407 - DNA, 19 bp, Homo sapiens
gttgaaaagaactttgaag

SEQ ID NO: 41408 - DNA, 21 bp, Homo sapiens
gttgaaaagaactttgaagag

SEQ ID NO: 41409 - DNA, 22 bp, Homo sapiens
gttgaaaagaactttgaagaga

SEQ ID NO: 41410 - DNA, 23 bp, Homo sapiens
gttgaaaagaactttgaagagag

SEQ ID NO: 41411 - DNA, 24 bp, Homo sapiens
gttgaaaagaactttgaagagaga

SEQ ID NO: 41412 - DNA, 25 bp, Homo sapiens
gttgaaaagaactttgaagagagag

SEQ ID NO: 41413 - DNA, 26 bp, Homo sapiens
gttgaaaagaactttgaagagagagt

SEQ ID NO: 41414 - DNA, 27 bp, Homo sapiens
gttgaaaagaactttgaagagagagtt

SEQ ID NO: 41415 - DNA, 28 bp, Homo sapiens
gttgaaaagaactttgaagagagagttc

SEQ ID NO: 41416 - DNA, 16 bp, Homo sapiens
ttgaaaagaactttga

SEQ ID NO: 41417 - DNA, 17 bp, Homo sapiens
ttgaaaagaactttgaa

SEQ ID NO: 41418 - DNA, 18 bp, Homo sapiens
ttgaaaagaactttgaag

SEQ ID NO: 41419 - DNA, 19 bp, Homo sapiens
ttgaaaagaactttgaaga

SEQ ID NO: 41420 - DNA, 20 bp, Homo sapiens
ttgaaaagaactttgaagag

SEQ ID NO: 41421 - DNA, 21 bp, Homo sapiens
ttgaaaagaactttgaagaga

SEQ ID NO: 41422 - DNA, 22 bp, Homo sapiens
ttgaaaagaactttgaagagag

SEQ ID NO: 41423 - DNA, 23 bp, Homo sapiens
ttgaaaagaactttgaagagaga

SEQ ID NO: 41424 - DNA, 24 bp, Homo sapiens
ttgaaaagaactttgaagagagag

SEQ ID NO: 41425 - DNA, 25 bp, Homo sapiens
ttgaaaagaactttgaagagagagt

SEQ ID NO: 41426 - DNA, 26 bp, Homo sapiens
ttgaaaagaactttgaagagagagtt

SEQ ID NO: 41427 - DNA, 27 bp, Homo sapiens
ttgaaaagaactttgaagagagagttc

SEQ ID NO: 41428 - DNA, 30 bp, Homo sapiens
ttgaaaagaactttgaagagagagttcaag

SEQ ID NO: 41429 - DNA, 16 bp, Homo sapiens
tgaaaagaactttgaa

SEQ ID NO: 41430 - DNA, 17 bp, Homo sapiens
tgaaaagaactttgaag

SEQ ID NO: 41431 - DNA, 18 bp, Homo sapiens
tgaaaagaactttgaaga

SEQ ID NO: 41432 - DNA, 19 bp, Homo sapiens
tgaaaagaactttgaagag

SEQ ID NO: 41433 - DNA, 20 bp, Homo sapiens
tgaaaagaactttgaagaga

SEQ ID NO: 41434 - DNA, 21 bp, Homo sapiens
tgaaaagaactttgaagagag

SEQ ID NO: 41435 - DNA, 22 bp, Homo sapiens
tgaaaagaactttgaagagaga

SEQ ID NO: 41436 - DNA, 23 bp, Homo sapiens
tgaaaagaactttgaagagagag

SEQ ID NO: 41437 - DNA, 24 bp, Homo sapiens
tgaaaagaactttgaagagagagt

SEQ ID NO: 41438 - DNA, 25 bp, Homo sapiens
tgaaaagaactttgaagagagagtt

SEQ ID NO: 41439 - DNA, 26 bp, Homo sapiens
tgaaaagaactttgaagagagagttc

SEQ ID NO: 41440 - DNA, 27 bp, Homo sapiens
tgaaaagaactttgaagagagagttca

SEQ ID NO: 41441 - DNA, 29 bp, Homo sapiens
tgaaaagaactttgaagagagagttcaag

SEQ ID NO: 41442 - DNA, 30 bp, Homo sapiens; identical to SEQ ID NO: 19254

SEQ ID NO: 41443 - DNA, 16 bp, Homo sapiens
gaaaagaactttgaag

SEQ ID NO: 41444 - DNA, 18 bp, Homo sapiens
gaaaagaactttgaagag

SEQ ID NO: 41445 - DNA, 19 bp, Homo sapiens
gaaaagaactttgaagaga

SEQ ID NO: 41446 - DNA, 20 bp, Homo sapiens
gaaaagaactttgaagagag

SEQ ID NO: 41447 - DNA, 21 bp, Homo sapiens
gaaaagaactttgaagagaga

SEQ ID NO: 41448 - DNA, 22 bp, Homo sapiens
gaaaagaactttgaagagagag

SEQ ID NO: 41449 - DNA, 23 bp, Homo sapiens
gaaaagaactttgaagagagagt

SEQ ID NO: 41450 - DNA, 24 bp, Homo sapiens
gaaaagaactttgaagagagagtt

SEQ ID NO: 41451 - DNA, 25 bp, Homo sapiens
gaaaagaactttgaagagagagttc

SEQ ID NO: 41452 - DNA, 17 bp, Homo sapiens
aaaagaactttgaagag

SEQ ID NO: 41453 - DNA, 18 bp, Homo sapiens
aaaagaactttgaagaga

SEQ ID NO: 41454 - DNA, 19 bp, Homo sapiens
aaaagaactttgaagagag

SEQ ID NO: 41455 - DNA, 20 bp, Homo sapiens
aaaagaactttgaagagaga

SEQ ID NO: 41456 - DNA, 21 bp, Homo sapiens
aaaagaactttgaagagagag

SEQ ID NO: 41457 - DNA, 22 bp, Homo sapiens
aaaagaactttgaagagagagt

SEQ ID NO: 41458 - DNA, 23 bp, Homo sapiens
aaaagaactttgaagagagagtt

SEQ ID NO: 41459 - DNA, 24 bp, Homo sapiens
aaaagaactttgaagagagagttc

SEQ ID NO: 41460 - DNA, 27 bp, Homo sapiens
aaaagaactttgaagagagagttcaag

SEQ ID NO: 41461 - DNA, 30 bp, Homo sapiens
aaaagaactttgaagagagagttcaagagg

SEQ ID NO: 41462 - DNA, 16 bp, Homo sapiens
aaagaactttgaagag

SEQ ID NO: 41463 - DNA, 17 bp, Homo sapiens
aaagaactttgaagaga

SEQ ID NO: 41464 - DNA, 18 bp, Homo sapiens
aaagaactttgaagagag

SEQ ID NO: 41465 - DNA, 19 bp, Homo sapiens
aaagaactttgaagagaga

SEQ ID NO: 41466 - DNA, 20 bp, Homo sapiens
aaagaactttgaagagagag

SEQ ID NO: 41467 - DNA, 21 bp, Homo sapiens
aaagaactttgaagagagagt

SEQ ID NO: 41468 - DNA, 22 bp, Homo sapiens
aaagaactttgaagagagagtt

SEQ ID NO: 41469 - DNA, 23 bp, Homo sapiens
aaagaactttgaagagagagttc

SEQ ID NO: 41470 - DNA, 24 bp, Homo sapiens
aaagaactttgaagagagagttca

SEQ ID NO: 41471 - DNA, 26 bp, Homo sapiens
aaagaactttgaagagagagttcaag

SEQ ID NO: 41472 - DNA, 16 bp, Homo sapiens
aagaactttgaagaga

SEQ ID NO: 41473 - DNA, 17 bp, Homo sapiens
aagaactttgaagagag

SEQ ID NO: 41474 - DNA, 18 bp, Homo sapiens
aagaactttgaagagaga

SEQ ID NO: 41475 - DNA, 19 bp, Homo sapiens
aagaactttgaagagagag

SEQ ID NO: 41476 - DNA, 20 bp, Homo sapiens
aagaactttgaagagagagt

SEQ ID NO: 41477 - DNA, 21 bp, Homo sapiens
aagaactttgaagagagagtt

SEQ ID NO: 41478 - DNA, 22 bp, Homo sapiens
aagaactttgaagagagagttc

SEQ ID NO: 41479 - DNA, 23 bp, Homo sapiens
aagaactttgaagagagagttca

SEQ ID NO: 41480 - DNA, 25 bp, Homo sapiens
aagaactttgaagagagagttcaag

SEQ ID NO: 41481 - DNA, 27 bp, Homo sapiens
aagaactttgaagagagagttcaagag

SEQ ID NO: 41482 - DNA, 16 bp, Homo sapiens
agaactttgaagagag

SEQ ID NO: 41483 - DNA, 17 bp, Homo sapiens
agaactttgaagagaga

SEQ ID NO: 41484 - DNA, 18 bp, Homo sapiens
agaactttgaagagagag

SEQ ID NO: 41485 - DNA, 19 bp, Homo sapiens
agaactttgaagagagagt

SEQ ID NO: 41486 - DNA, 20 bp, Homo sapiens
agaactttgaagagagagtt

SEQ ID NO: 41487 - DNA, 21 bp, Homo sapiens
agaactttgaagagagagttc

SEQ ID NO: 41488 - DNA, 16 bp, Homo sapiens
gaactttgaagagaga

SEQ ID NO: 41489 - DNA, 17 bp, Homo sapiens
gaactttgaagagagag

SEQ ID NO: 41490 - DNA, 18 bp, Homo sapiens
gaactttgaagagagagt

SEQ ID NO: 41491 - DNA, 19 bp, Homo sapiens
gaactttgaagagagagtt

SEQ ID NO: 41492 - DNA, 20 bp, Homo sapiens
gaactttgaagagagagttc

SEQ ID NO: 41493 - DNA, 21 bp, Homo sapiens
gaactttgaagagagagttca

SEQ ID NO: 41494 - DNA, 16 bp, Homo sapiens
ctttgaagagagagtt

SEQ ID NO: 41495 - DNA, 17 bp, Homo sapiens
ctttgaagagagagttc

SEQ ID NO: 41496 - DNA, 20 bp, Homo sapiens
ctttgaagagagagttcaag

SEQ ID NO: 41497 - DNA, 22 bp, Homo sapiens
ctttgaagagagagttcaagag

SEQ ID NO: 41498 - DNA, 23 bp, Homo sapiens
ctttgaagagagagttcaagagg

SEQ ID NO: 41499 - DNA, 24 bp, Homo sapiens
ctttgaagagagagttcaagaggg

SEQ ID NO: 41500 - DNA, 25 bp, Homo sapiens
ctttgaagagagagttcaagagggc

SEQ ID NO: 41501 - DNA, 27 bp, Homo sapiens
ctttgaagagagagttcaagagggcgt

SEQ ID NO: 41502 - DNA, 28 bp, Homo sapiens
ctttgaagagagagttcaagagggcgtg

SEQ ID NO: 41503 - DNA, 18 bp, Homo sapiens
ttgaagagagagttcaag

SEQ ID NO: 41504 - DNA, 23 bp, Homo sapiens
ttgaagagagagttcaagagggc

SEQ ID NO: 41505 - DNA, 21 bp, Homo sapiens
gaagagagagttcaagagggc

SEQ ID NO: 41506 - DNA, 23 bp, Homo sapiens
gaagagagagttcaagagggcgt

SEQ ID NO: 41507 - DNA, 21 bp, Homo sapiens
aagagagagttcaagagggcg

SEQ ID NO: 41508 - DNA, 22 bp, Homo sapiens
aagagagagttcaagagggcgt

SEQ ID NO: 41509 - DNA, 20 bp, Homo sapiens
caagagggcgtgaaaccgtt

SEQ ID NO: 41510 - DNA, 26 bp, Homo sapiens
aagagggcgtgaaaccgttaagaggt

SEQ ID NO: 41511 - DNA, 21 bp, Homo sapiens
agagggcgtgaaaccgttaag

SEQ ID NO: 41512 - DNA, 22 bp, Homo sapiens
agagggcgtgaaaccgttaaga

SEQ ID NO: 41513 - DNA, 23 bp, Homo sapiens
agagggcgtgaaaccgttaagag

SEQ ID NO: 41514 - DNA, 24 bp, Homo sapiens
agagggcgtgaaaccgttaagagg

SEQ ID NO: 41515 - DNA, 25 bp, Homo sapiens
agagggcgtgaaaccgttaagaggt

SEQ ID NO: 41516 - DNA, 21 bp, Homo sapiens
gagggcgtgaaaccgttaaga

SEQ ID NO: 41517 - DNA, 22 bp, Homo sapiens
gagggcgtgaaaccgttaagag

SEQ ID NO: 41518 - DNA, 23 bp, Homo sapiens
gagggcgtgaaaccgttaagagg

SEQ ID NO: 41519 - DNA, 24 bp, Homo sapiens
gagggcgtgaaaccgttaagaggt

SEQ ID NO: 41520 - DNA, 19 bp, Homo sapiens
agggcgtgaaaccgttaag

SEQ ID NO: 41521 - DNA, 20 bp, Homo sapiens
agggcgtgaaaccgttaaga

SEQ ID NO: 41522 - DNA, 21 bp, Homo sapiens
agggcgtgaaaccgttaagag

SEQ ID NO: 41523 - DNA, 22 bp, Homo sapiens
agggcgtgaaaccgttaagagg

SEQ ID NO: 41524 - DNA, 23 bp, Homo sapiens
agggcgtgaaaccgttaagaggt

SEQ ID NO: 41525 - DNA, 20 bp, Homo sapiens
gggcgtgaaaccgttaagag

SEQ ID NO: 41526 - DNA, 21 bp, Homo sapiens
gggcgtgaaaccgttaagagg

SEQ ID NO: 41527 - DNA, 22 bp, Homo sapiens
gggcgtgaaaccgttaagaggt

SEQ ID NO: 41528 - DNA, 23 bp, Homo sapiens
gggcgtgaaaccgttaagaggta

SEQ ID NO: 41529 - DNA, 17 bp, Homo sapiens
ggcgtgaaaccgttaag

SEQ ID NO: 41530 - DNA, 18 bp, Homo sapiens
ggcgtgaaaccgttaaga

SEQ ID NO: 41531 - DNA, 19 bp, Homo sapiens
ggcgtgaaaccgttaagag

SEQ ID NO: 41532 - DNA, 20 bp, Homo sapiens
ggcgtgaaaccgttaagagg

SEQ ID NO: 41533 - DNA, 21 bp, Homo sapiens
ggcgtgaaaccgttaagaggt

SEQ ID NO: 41534 - DNA, 22 bp, Homo sapiens
ggcgtgaaaccgttaagaggta

SEQ ID NO: 41535 - DNA, 18 bp, Homo sapiens
gcgtgaaaccgttaagag

SEQ ID NO: 41536 - DNA, 19 bp, Homo sapiens
gcgtgaaaccgttaagagg

SEQ ID NO: 41537 - DNA, 20 bp, Homo sapiens
gcgtgaaaccgttaagaggt

SEQ ID NO: 41538 - DNA, 21 bp, Homo sapiens
gcgtgaaaccgttaagaggta

SEQ ID NO: 41539 - DNA, 17 bp, Homo sapiens
cgtgaaaccgttaagag

SEQ ID NO: 41540 - DNA, 18 bp, Homo sapiens
cgtgaaaccgttaagagg

SEQ ID NO: 41541 - DNA, 19 bp, Homo sapiens
cgtgaaaccgttaagaggt

SEQ ID NO: 41542 - DNA, 20 bp, Homo sapiens
cgtgaaaccgttaagaggta

SEQ ID NO: 41543 - DNA, 16 bp, Homo sapiens
gtgaaaccgttaagag

SEQ ID NO: 41544 - DNA, 17 bp, Homo sapiens
gtgaaaccgttaagagg

SEQ ID NO: 41545 - DNA, 18 bp, Homo sapiens
gtgaaaccgttaagaggt

SEQ ID NO: 41546 - DNA, 16 bp, Homo sapiens
tgaaaccgttaagagg

SEQ ID NO: 41547 - DNA, 17 bp, Homo sapiens
tgaaaccgttaagaggt

SEQ ID NO: 41548 - DNA, 16 bp, Homo sapiens
gaaaccgttaagaggt

SEQ ID NO: 41549 - DNA, 19 bp, Homo sapiens
aacgggtggggtccgcgca

SEQ ID NO: 41550 - DNA, 20 bp, Homo sapiens
aacgggtggggtccgcgcag

SEQ ID NO: 41551 - DNA, 22 bp, Homo sapiens
aacgggtggggtccgcgcagtc

SEQ ID NO: 41552 - DNA, 23 bp, Homo sapiens
aacgggtggggtccgcgcagtcc

SEQ ID NO: 41553 - DNA, 24 bp, Homo sapiens
aacgggtggggtccgcgcagtccg

SEQ ID NO: 41554 - DNA, 25 bp, Homo sapiens
aacgggtggggtccgcgcagtccgc

SEQ ID NO: 41555 - DNA, 24 bp, Homo sapiens
cgggtggggtccgcgcagtccgcc

SEQ ID NO: 41556 - DNA, 17 bp, Homo sapiens
ggtggggtccgcgcagt

SEQ ID NO: 41557 - DNA, 18 bp, Homo sapiens
ggtggggtccgcgcagtc

SEQ ID NO: 41558 - DNA, 19 bp, Homo sapiens
ggtggggtccgcgcagtcc

SEQ ID NO: 41559 - DNA, 21 bp, Homo sapiens
ggtggggtccgcgcagtccgc

SEQ ID NO: 41560 - DNA, 16 bp, Homo sapiens
gtggggtccgcgcagt

SEQ ID NO: 41561 - DNA, 17 bp, Homo sapiens
gtggggtccgcgcagtc

SEQ ID NO: 41562 - DNA, 18 bp, Homo sapiens
gtggggtccgcgcagtcc

SEQ ID NO: 41563 - DNA, 20 bp, Homo sapiens
gtggggtccgcgcagtccgc

SEQ ID NO: 41564 - DNA, 21 bp, Homo sapiens
gtggggtccgcgcagtccgcc

SEQ ID NO: 41565 - DNA, 19 bp, Homo sapiens
tggggtccgcgcagtccgc

SEQ ID NO: 41566 - DNA, 20 bp, Homo sapiens
tggggtccgcgcagtccgcc

SEQ ID NO: 41567 - DNA, 16 bp, Homo sapiens
ggtccgcgcagtccgc

SEQ ID NO: 41568 - DNA, 17 bp, Homo sapiens
ggtccgcgcagtccgcc

SEQ ID NO: 41569 - DNA, 20 bp, Homo sapiens
ggtccgcgcagtccgcccgg

SEQ ID NO: 41570 - DNA, 23 bp, Homo sapiens
ggtccgcgcagtccgcccggagg

SEQ ID NO: 41571 - DNA, 19 bp, Homo sapiens
cgcgcagtccgcccggagg

SEQ ID NO: 41572 - DNA, 20 bp, Homo sapiens
cgcgcagtccgcccggagga

SEQ ID NO: 41573 - DNA, 16 bp, Homo sapiens
gcgcagtccgcccgga

SEQ ID NO: 41574 - DNA, 17 bp, Homo sapiens
gcgcagtccgcccggag

SEQ ID NO: 41575 - DNA, 18 bp, Homo sapiens
gcgcagtccgcccggagg

SEQ ID NO: 41576 - DNA, 19 bp, Homo sapiens
gcgcagtccgcccggagga

SEQ ID NO: 41577 - DNA, 21 bp, Homo sapiens
gcgcagtccgcccggaggatt

SEQ ID NO: 41578 - DNA, 22 bp, Homo sapiens
gcgcagtccgcccggaggattc

SEQ ID NO: 41579 - DNA, 17 bp, Homo sapiens
cgcagtccgcccggagg

SEQ ID NO: 41580 - DNA, 18 bp, Homo sapiens
cgcagtccgcccggagga

SEQ ID NO: 41581 - DNA, 20 bp, Homo sapiens
cgcagtccgcccggaggatt

SEQ ID NO: 41582 - DNA, 16 bp, Homo sapiens
gcagtccgcccggagg

SEQ ID NO: 41583 - DNA, 17 bp, Homo sapiens
gcagtccgcccggagga

SEQ ID NO: 41584 - DNA, 19 bp, Homo sapiens
gcagtccgcccggaggatt

SEQ ID NO: 41585 - DNA, 30 bp, Homo sapiens
gcagtccgcccggaggattcaacccggcgg

SEQ ID NO: 41586 - DNA, 23 bp, Homo sapiens
gaggattcaacccggcggcgggt

SEQ ID NO: 41587 - DNA, 22 bp, Homo sapiens
aggattcaacccggcggcgggt

SEQ ID NO: 41588 - DNA, 21 bp, Homo sapiens
ggattcaacccggcggcgggt

SEQ ID NO: 41589 - DNA, 18 bp, Homo sapiens
gattcaacccggcggcgg

SEQ ID NO: 41590 - DNA, 20 bp, Homo sapiens
gattcaacccggcggcgggt

SEQ ID NO: 41591 - DNA, 22 bp, Homo sapiens
gattcaacccggcggcgggtcc

SEQ ID NO: 41592 - DNA, 30 bp, Homo sapiens
gattcaacccggcggcgggtccggccgtgt

SEQ ID NO: 41593 - DNA, 17 bp, Homo sapiens
attcaacccggcggcgg

SEQ ID NO: 41594 - DNA, 19 bp, Homo sapiens
aacccggcggcgggtccgg

SEQ ID NO: 41595 - DNA, 19 bp, Homo sapiens
cccggcggcgggtccggcc

SEQ ID NO: 41596 - DNA, 20 bp, Homo sapiens
cccggcggcgggtccggccg

SEQ ID NO: 41597 - DNA, 21 bp, Homo sapiens
cccggcggcgggtccggccgt

SEQ ID NO: 41598 - DNA, 22 bp, Homo sapiens
cccggcggcgggtccggccgtg

SEQ ID NO: 41599 - DNA, 26 bp, Homo sapiens
cccggcggcgggtccggccgtgtcgg

SEQ ID NO: 41600 - DNA, 28 bp, Homo sapiens
cccggcggcgggtccggccgtgtcggcg

SEQ ID NO: 41601 - DNA, 29 bp, Homo sapiens
cccggcggcgggtccggccgtgtcggcgg

SEQ ID NO: 41602 - DNA, 30 bp, Homo sapiens
cccggcggcgggtccggccgtgtcggcggc

SEQ ID NO: 41603 - DNA, 26 bp, Homo sapiens
ggcggcgggtccggccgtgtcggcgg

SEQ ID NO: 41604 - DNA, 17 bp, Homo sapiens
cggcgggtccggccgtg

SEQ ID NO: 41605 - DNA, 19 bp, Homo sapiens
ggcgggtccggccgtgtcg

SEQ ID NO: 41606 - DNA, 20 bp, Homo sapiens
ggcgggtccggccgtgtcgg

SEQ ID NO: 41607 - DNA, 21 bp, Homo sapiens
ggcgggtccggccgtgtcggc

SEQ ID NO: 41608 - DNA, 23 bp, Homo sapiens
ggcgggtccggccgtgtcggcgg

SEQ ID NO: 41609 - DNA, 24 bp, Homo sapiens
ggcgggtccggccgtgtcggcggc

SEQ ID NO: 41610 - DNA, 18 bp, Homo sapiens
gcgggtccggccgtgtcg

SEQ ID NO: 41611 - DNA, 21 bp, Homo sapiens
gcgggtccggccgtgtcggcg

SEQ ID NO: 41612 - DNA, 23 bp, Homo sapiens
gcgggtccggccgtgtcggcggc

SEQ ID NO: 41613 - DNA, 28 bp, Homo sapiens
gcgggtccggccgtgtcggcggcccggc

SEQ ID NO: 41614 - DNA, 17 bp, Homo sapiens
cgggtccggccgtgtcg

SEQ ID NO: 41615 - DNA, 20 bp, Homo sapiens
cgggtccggccgtgtcggcg

SEQ ID NO: 41616 - DNA, 18 bp, Homo sapiens
gggtccggccgtgtcggc

SEQ ID NO: 41617 - DNA, 19 bp, Homo sapiens
gggtccggccgtgtcggcg

SEQ ID NO: 41618 - DNA, 20 bp, Homo sapiens
gggtccggccgtgtcggcgg

SEQ ID NO: 41619 - DNA, 21 bp, Homo sapiens
gggtccggccgtgtcggcggc

SEQ ID NO: 41620 - DNA, 17 bp, Homo sapiens
ggtccggccgtgtcggc

SEQ ID NO: 41621 - DNA, 18 bp, Homo sapiens
ggtccggccgtgtcggcg

SEQ ID NO: 41622 - DNA, 19 bp, Homo sapiens
ggtccggccgtgtcggcgg

SEQ ID NO: 41623 - DNA, 20 bp, Homo sapiens
ggtccggccgtgtcggcggc

SEQ ID NO: 41624 - DNA, 21 bp, Homo sapiens
ggtccggccgtgtcggcggcc

SEQ ID NO: 41625 - DNA, 16 bp, Homo sapiens
gtccggccgtgtcggc

SEQ ID NO: 41626 - DNA, 17 bp, Homo sapiens
gtccggccgtgtcggcg

SEQ ID NO: 41627 - DNA, 18 bp, Homo sapiens
gtccggccgtgtcggcgg

SEQ ID NO: 41628 - DNA, 19 bp, Homo sapiens
gtccggccgtgtcggcggc

SEQ ID NO: 41629 - DNA, 20 bp, Homo sapiens
gtccggccgtgtcggcggcc

SEQ ID NO: 41630 - DNA, 16 bp, Homo sapiens
tccggccgtgtcggcg

SEQ ID NO: 41631 - DNA, 17 bp, Homo sapiens
tccggccgtgtcggcgg

SEQ ID NO: 41632 - DNA, 18 bp, Homo sapiens
tccggccgtgtcggcggc

SEQ ID NO: 41633 - DNA, 19 bp, Homo sapiens
tccggccgtgtcggcggcc

SEQ ID NO: 41634 - DNA, 16 bp, Homo sapiens
ccggccgtgtcggcgg

SEQ ID NO: 41635 - DNA, 17 bp, Homo sapiens
ccggccgtgtcggcggc

SEQ ID NO: 41636 - DNA, 18 bp, Homo sapiens
ccgtgtcggcggcccggc

SEQ ID NO: 41637 - DNA, 19 bp, Homo sapiens
ccgtgtcggcggcccggcg

SEQ ID NO: 41638 - DNA, 16 bp, Homo sapiens
cgtgtcggcggcccgg

SEQ ID NO: 41639 - DNA, 17 bp, Homo sapiens
cgtgtcggcggcccggc

SEQ ID NO: 41640 - DNA, 18 bp, Homo sapiens
cgtgtcggcggcccggcg

SEQ ID NO: 41641 - DNA, 19 bp, Homo sapiens
cgtgtcggcggcccggcgg

SEQ ID NO: 41642 - DNA, 20 bp, Homo sapiens
cgtgtcggcggcccggcgga

SEQ ID NO: 41643 - DNA, 16 bp, Homo sapiens
gtgtcggcggcccggc

SEQ ID NO: 41644 - DNA, 17 bp, Homo sapiens
gtgtcggcggcccggcg

SEQ ID NO: 41645 - DNA, 18 bp, Homo sapiens
gtgtcggcggcccggcgg

SEQ ID NO: 41646 - DNA, 19 bp, Homo sapiens
gtgtcggcggcccggcgga

SEQ ID NO: 41647 - DNA, 20 bp, Homo sapiens
gtgtcggcggcccggcggat

SEQ ID NO: 41648 - DNA, 21 bp, Homo sapiens
gtgtcggcggcccggcggatc

SEQ ID NO: 41649 - DNA, 18 bp, Homo sapiens
tgtcggcggcccggcgga

SEQ ID NO: 41650 - DNA, 17 bp, Homo sapiens
gtcggcggcccggcgga

SEQ ID NO: 41651 - DNA, 20 bp, Homo sapiens
gtcggcggcccggcggatct

SEQ ID NO: 41652 - DNA, 18 bp, Homo sapiens
cggcggcccggcggatct

SEQ ID NO: 41653 - DNA, 25 bp, Homo sapiens
cccggcggatctttcccgccccccg

SEQ ID NO: 41654 - DNA, 26 bp, Homo sapiens
cccggcggatctttcccgccccccgt

SEQ ID NO: 41655 - DNA, 24 bp, Homo sapiens
ccggcggatctttcccgccccccg

SEQ ID NO: 41656 - DNA, 25 bp, Homo sapiens
ccggcggatctttcccgccccccgt

SEQ ID NO: 41657 - DNA, 23 bp, Homo sapiens
cggcggatctttcccgccccccg

SEQ ID NO: 41658 - DNA, 24 bp, Homo sapiens
cggcggatctttcccgccccccgt

SEQ ID NO: 41659 - DNA, 22 bp, Homo sapiens
ggcggatctttcccgccccccg

SEQ ID NO: 41660 - DNA, 21 bp, Homo sapiens
gcggatctttcccgccccccg

SEQ ID NO: 41661 - DNA, 20 bp, Homo sapiens
cggatctttcccgccccccg

SEQ ID NO: 41662 - DNA, 21 bp, Homo sapiens
cggatctttcccgccccccgt

SEQ ID NO: 41663 - DNA, 22 bp, Homo sapiens
cggatctttcccgccccccgtt

SEQ ID NO: 41664 - DNA, 18 bp, Homo sapiens
ggatctttcccgcccccc

SEQ ID NO: 41665 - DNA, 19 bp, Homo sapiens
ggatctttcccgccccccg

SEQ ID NO: 41666 - DNA, 20 bp, Homo sapiens
ggatctttcccgccccccgt

SEQ ID NO: 41667 - DNA, 18 bp, Homo sapiens
gatctttcccgccccccg

SEQ ID NO: 41668 - DNA, 19 bp, Homo sapiens
gatctttcccgccccccgt

SEQ ID NO: 41669 - DNA, 20 bp, Homo sapiens
gatctttcccgccccccgtt

SEQ ID NO: 41670 - DNA, 19 bp, Homo sapiens
atctttcccgccccccgtt

SEQ ID NO: 41671 - DNA, 18 bp, Homo sapiens
cgccccccgttcctcccg

SEQ ID NO: 41672 - DNA, 20 bp, Homo sapiens
cgccccccgttcctcccgac

SEQ ID NO: 41673 - DNA, 21 bp, Homo sapiens
cgccccccgttcctcccgacc

SEQ ID NO: 41674 - DNA, 20 bp, Homo sapiens
gccccccgttcctcccgacc

SEQ ID NO: 41675 - DNA, 17 bp, Homo sapiens
cccgttcctcccgaccc

SEQ ID NO: 41676 - DNA, 20 bp, Homo sapiens
cccgttcctcccgacccctc

SEQ ID NO: 41677 - DNA, 21 bp, Homo sapiens
cccgttcctcccgacccctcc

SEQ ID NO: 41678 - DNA, 16 bp, Homo sapiens
ccgttcctcccgaccc

SEQ ID NO: 41679 - DNA, 19 bp, Homo sapiens
ccgttcctcccgacccctc

SEQ ID NO: 41680 - DNA, 19 bp, Homo sapiens
cgttcctcccgacccctcc

SEQ ID NO: 41681 - DNA, 17 bp, Homo sapiens
gttcctcccgacccctc

SEQ ID NO: 41682 - DNA, 18 bp, Homo sapiens
gttcctcccgacccctcc

SEQ ID NO: 41683 - DNA, 19 bp, Homo sapiens
gttcctcccgacccctcca

SEQ ID NO: 41684 - DNA, 21 bp, Homo sapiens
gttcctcccgacccctccacc

SEQ ID NO: 41685 - DNA, 25 bp, Homo sapiens
gttcctcccgacccctccacccgcc

SEQ ID NO: 41686 - DNA, 27 bp, Homo sapiens
gttcctcccgacccctccacccgccct

SEQ ID NO: 41687 - DNA, 17 bp, Homo sapiens
ttcctcccgacccctcc

SEQ ID NO: 41688 - DNA, 18 bp, Homo sapiens
ttcctcccgacccctcca

SEQ ID NO: 41689 - DNA, 20 bp, Homo sapiens
ttcctcccgacccctccacc

SEQ ID NO: 41690 - DNA, 23 bp, Homo sapiens
ttcctcccgacccctccacccgc

SEQ ID NO: 41691 - DNA, 16 bp, Homo sapiens
tcctcccgacccctcc

SEQ ID NO: 41692 - DNA, 16 bp, Homo sapiens
cctcccgacccctcca

SEQ ID NO: 41693 - DNA, 18 bp, Homo sapiens
cctcccgacccctccacc

SEQ ID NO: 41694 - DNA, 20 bp, Homo sapiens
cctcccgacccctccacccg

SEQ ID NO: 41695 - DNA, 21 bp, Homo sapiens
cctcccgacccctccacccgc

SEQ ID NO: 41696 - DNA, 22 bp, Homo sapiens
cctcccgacccctccacccgcc

SEQ ID NO: 41697 - DNA, 23 bp, Homo sapiens
cctcccgacccctccacccgccc

SEQ ID NO: 41698 - DNA, 24 bp, Homo sapiens
cctcccgacccctccacccgccct

SEQ ID NO: 41699 - DNA, 26 bp, Homo sapiens
cctcccgacccctccacccgccctcc

SEQ ID NO: 41700 - DNA, 27 bp, Homo sapiens
cctcccgacccctccacccgccctccc

SEQ ID NO: 41701 - DNA, 28 bp, Homo sapiens
cctcccgacccctccacccgccctccct

SEQ ID NO: 41702 - DNA, 16 bp, Homo sapiens
ctcccgacccctccac

SEQ ID NO: 41703 - DNA, 17 bp, Homo sapiens
ctcccgacccctccacc

SEQ ID NO: 41704 - DNA, 18 bp, Homo sapiens
ctcccgacccctccaccc

SEQ ID NO: 41705 - DNA, 19 bp, Homo sapiens
ctcccgacccctccacccg

SEQ ID NO: 41706 - DNA, 20 bp, Homo sapiens
ctcccgacccctccacccgc

SEQ ID NO: 41707 - DNA, 21 bp, Homo sapiens
ctcccgacccctccacccgcc

SEQ ID NO: 41708 - DNA, 22 bp, Homo sapiens
ctcccgacccctccacccgccc

SEQ ID NO: 41709 - DNA, 23 bp, Homo sapiens
ctcccgacccctccacccgccct

SEQ ID NO: 41710 - DNA, 24 bp, Homo sapiens
ctcccgacccctccacccgccctc

SEQ ID NO: 41711 - DNA, 25 bp, Homo sapiens
ctcccgacccctccacccgccctcc

SEQ ID NO: 41712 - DNA, 26 bp, Homo sapiens
ctcccgacccctccacccgccctccc

SEQ ID NO: 41713 - DNA, 19 bp, Homo sapiens
tcccgacccctccacccgc

SEQ ID NO: 41714 - DNA, 20 bp, Homo sapiens
tcccgacccctccacccgcc

SEQ ID NO: 41715 - DNA, 21 bp, Homo sapiens
tcccgacccctccacccgccc

SEQ ID NO: 41716 - DNA, 22 bp, Homo sapiens
tcccgacccctccacccgccct

SEQ ID NO: 41717 - DNA, 23 bp, Homo sapiens
tcccgacccctccacccgccctc

SEQ ID NO: 41718 - DNA, 24 bp, Homo sapiens
tcccgacccctccacccgccctcc

SEQ ID NO: 41719 - DNA, 16 bp, Homo sapiens
cccgacccctccaccc

SEQ ID NO: 41720 - DNA, 17 bp, Homo sapiens
cccgacccctccacccg

SEQ ID NO: 41721 - DNA, 18 bp, Homo sapiens
cccgacccctccacccgc

SEQ ID NO: 41722 - DNA, 19 bp, Homo sapiens
cccgacccctccacccgcc

SEQ ID NO: 41723 - DNA, 20 bp, Homo sapiens
cccgacccctccacccgccc

SEQ ID NO: 41724 - DNA, 21 bp, Homo sapiens
cccgacccctccacccgccct

SEQ ID NO: 41725 - DNA, 22 bp, Homo sapiens
cccgacccctccacccgccctc

SEQ ID NO: 41726 - DNA, 23 bp, Homo sapiens
cccgacccctccacccgccctcc

SEQ ID NO: 41727 - DNA, 24 bp, Homo sapiens
cccgacccctccacccgccctccc

SEQ ID NO: 41728 - DNA, 17 bp, Homo sapiens
ccgacccctccacccgc

SEQ ID NO: 41729 - DNA, 18 bp, Homo sapiens
ccgacccctccacccgcc

SEQ ID NO: 41730 - DNA, 19 bp, Homo sapiens
ccgacccctccacccgccc

SEQ ID NO: 41731 - DNA, 21 bp, Homo sapiens
ccgacccctccacccgccctc

SEQ ID NO: 41732 - DNA, 22 bp, Homo sapiens
ccgacccctccacccgccctcc

SEQ ID NO: 41733 - DNA, 23 bp, Homo sapiens
ccgacccctccacccgccctccc

SEQ ID NO: 41734 - DNA, 17 bp, Homo sapiens
cgacccctccacccgcc

SEQ ID NO: 41735 - DNA, 18 bp, Homo sapiens
cgacccctccacccgccc

SEQ ID NO: 41736 - DNA, 19 bp, Homo sapiens
cgacccctccacccgccct

SEQ ID NO: 41737 - DNA, 20 bp, Homo sapiens
cgacccctccacccgccctc

SEQ ID NO: 41738 - DNA, 21 bp, Homo sapiens
cgacccctccacccgccctcc

SEQ ID NO: 41739 - DNA, 22 bp, Homo sapiens
cgacccctccacccgccctccc

SEQ ID NO: 41740 - DNA, 23 bp, Homo sapiens
cgacccctccacccgccctccct

SEQ ID NO: 41741 - DNA, 18 bp, Homo sapiens
gacccctccacccgccct

SEQ ID NO: 41742 - DNA, 17 bp, Homo sapiens
cctccacccgccctccc

SEQ ID NO: 41743 - DNA, 21 bp, Homo sapiens
cctccacccgccctcccttcc

SEQ ID NO: 41744 - DNA, 23 bp, Homo sapiens
cctccacccgccctcccttcccc

SEQ ID NO: 41745 - DNA, 26 bp, Homo sapiens
ccacccgccctcccttcccccgccgc

SEQ ID NO: 41746 - DNA, 22 bp, Homo sapiens
cacccgccctcccttcccccgc

SEQ ID NO: 41747 - DNA, 23 bp, Homo sapiens
cacccgccctcccttcccccgcc

SEQ ID NO: 41748 - DNA, 24 bp, Homo sapiens
cacccgccctcccttcccccgccg

SEQ ID NO: 41749 - DNA, 21 bp, Homo sapiens
acccgccctcccttcccccgc

SEQ ID NO: 41750 - DNA, 22 bp, Homo sapiens
acccgccctcccttcccccgcc

SEQ ID NO: 41751 - DNA, 24 bp, Homo sapiens
acccgccctcccttcccccgccgc

SEQ ID NO: 41752 - DNA, 16 bp, Homo sapiens
cccgccctcccttccc

SEQ ID NO: 41753 - DNA, 17 bp, Homo sapiens
cccgccctcccttcccc

SEQ ID NO: 41754 - DNA, 18 bp, Homo sapiens
cccgccctcccttccccc

SEQ ID NO: 41755 - DNA, 19 bp, Homo sapiens
cccgccctcccttcccccg

SEQ ID NO: 41756 - DNA, 20 bp, Homo sapiens
cccgccctcccttcccccgc

SEQ ID NO: 41757 - DNA, 21 bp, Homo sapiens
cccgccctcccttcccccgcc

SEQ ID NO: 41758 - DNA, 22 bp, Homo sapiens
cccgccctcccttcccccgccg

SEQ ID NO: 41759 - DNA, 23 bp, Homo sapiens
cccgccctcccttcccccgccgc

SEQ ID NO: 41760 - DNA, 24 bp, Homo sapiens
cccgccctcccttcccccgccgcc

SEQ ID NO: 41761 - DNA, 16 bp, Homo sapiens
ccgccctcccttcccc

SEQ ID NO: 41762 - DNA, 17 bp, Homo sapiens
ccgccctcccttccccc

SEQ ID NO: 41763 - DNA, 18 bp, Homo sapiens
ccgccctcccttcccccg

SEQ ID NO: 41764 - DNA, 19 bp, Homo sapiens
ccgccctcccttcccccgc

SEQ ID NO: 41765 - DNA, 20 bp, Homo sapiens
ccgccctcccttcccccgcc

SEQ ID NO: 41766 - DNA, 21 bp, Homo sapiens
ccgccctcccttcccccgccg

SEQ ID NO: 41767 - DNA, 22 bp, Homo sapiens
ccgccctcccttcccccgccgc

SEQ ID NO: 41768 - DNA, 23 bp, Homo sapiens
ccgccctcccttcccccgccgcc

SEQ ID NO: 41769 - DNA, 24 bp, Homo sapiens
ccgccctcccttcccccgccgccc

SEQ ID NO: 41770 - DNA, 25 bp, Homo sapiens
ccgccctcccttcccccgccgcccc

SEQ ID NO: 41771 - DNA, 16 bp, Homo sapiens
cgccctcccttccccc

SEQ ID NO: 41772 - DNA, 17 bp, Homo sapiens
cgccctcccttcccccg

SEQ ID NO: 41773 - DNA, 18 bp, Homo sapiens
cgccctcccttcccccgc

SEQ ID NO: 41774 - DNA, 19 bp, Homo sapiens
cgccctcccttcccccgcc

SEQ ID NO: 41775 - DNA, 20 bp, Homo sapiens
cgccctcccttcccccgccg

SEQ ID NO: 41776 - DNA, 21 bp, Homo sapiens
cgccctcccttcccccgccgc

SEQ ID NO: 41777 - DNA, 22 bp, Homo sapiens
cgccctcccttcccccgccgcc

SEQ ID NO: 41778 - DNA, 23 bp, Homo sapiens
cgccctcccttcccccgccgccc

SEQ ID NO: 41779 - DNA, 24 bp, Homo sapiens
cgccctcccttcccccgccgcccc

SEQ ID NO: 41780 - DNA, 17 bp, Homo sapiens
gccctcccttcccccgc

SEQ ID NO: 41781 - DNA, 18 bp, Homo sapiens
gccctcccttcccccgcc

SEQ ID NO: 41782 - DNA, 19 bp, Homo sapiens
gccctcccttcccccgccg

SEQ ID NO: 41783 - DNA, 20 bp, Homo sapiens
gccctcccttcccccgccgc

SEQ ID NO: 41784 - DNA, 21 bp, Homo sapiens
gccctcccttcccccgccgcc

SEQ ID NO: 41785 - DNA, 22 bp, Homo sapiens
gccctcccttcccccgccgccc

SEQ ID NO: 41786 - DNA, 20 bp, Homo sapiens
ccctcccttcccccgccgcc

SEQ ID NO: 41787 - DNA, 18 bp, Homo sapiens
ctcccttcccccgccgcc

SEQ ID NO: 41788 - DNA, 21 bp, Homo sapiens
ctcccttcccccgccgcccct

SEQ ID NO: 41789 - DNA, 23 bp, Homo sapiens
ctcccttcccccgccgcccctcc

SEQ ID NO: 41790 - DNA, 24 bp, Homo sapiens
ctcccttcccccgccgcccctcct

SEQ ID NO: 41791 - DNA, 25 bp, Homo sapiens
ctcccttcccccgccgcccctcctc

SEQ ID NO: 41792 - DNA, 16 bp, Homo sapiens
cccttcccccgccgcc

SEQ ID NO: 41793 - DNA, 18 bp, Homo sapiens
cccttcccccgccgcccc

SEQ ID NO: 41794 - DNA, 19 bp, Homo sapiens
cccttcccccgccgcccct

SEQ ID NO: 41795 - DNA, 20 bp, Homo sapiens
cccttcccccgccgcccctc

SEQ ID NO: 41796 - DNA, 21 bp, Homo sapiens
cccttcccccgccgcccctcc

SEQ ID NO: 41797 - DNA, 22 bp, Homo sapiens
cccttcccccgccgcccctcct

SEQ ID NO: 41798 - DNA, 23 bp, Homo sapiens
cccttcccccgccgcccctcctc

SEQ ID NO: 41799 - DNA, 24 bp, Homo sapiens
cccttcccccgccgcccctcctcc

SEQ ID NO: 41800 - DNA, 25 bp, Homo sapiens
cccttcccccgccgcccctcctcct

SEQ ID NO: 41801 - DNA, 26 bp, Homo sapiens
cccttcccccgccgcccctcctcctc

SEQ ID NO: 41802 - DNA, 27 bp, Homo sapiens
cccttcccccgccgcccctcctcctcc

SEQ ID NO: 41803 - DNA, 28 bp, Homo sapiens
cccttcccccgccgcccctcctcctcct

SEQ ID NO: 41804 - DNA, 29 bp, Homo sapiens
cccttcccccgccgcccctcctcctcctc

SEQ ID NO: 41805 - DNA, 30 bp, Homo sapiens
cccttcccccgccgcccctcctcctcctcc

SEQ ID NO: 41806 - DNA, 17 bp, Homo sapiens
ccttcccccgccgcccc

SEQ ID NO: 41807 - DNA, 18 bp, Homo sapiens
ccttcccccgccgcccct

SEQ ID NO: 41808 - DNA, 19 bp, Homo sapiens
ccttcccccgccgcccctc

SEQ ID NO: 41809 - DNA, 20 bp, Homo sapiens
ccttcccccgccgcccctcc

SEQ ID NO: 41810 - DNA, 21 bp, Homo sapiens
ccttcccccgccgcccctcct

SEQ ID NO: 41811 - DNA, 22 bp, Homo sapiens
ccttcccccgccgcccctcctc

SEQ ID NO: 41812 - DNA, 23 bp, Homo sapiens
ccttcccccgccgcccctcctcc

SEQ ID NO: 41813 - DNA, 24 bp, Homo sapiens
ccttcccccgccgcccctcctcct

SEQ ID NO: 41814 - DNA, 25 bp, Homo sapiens
ccttcccccgccgcccctcctcctc

SEQ ID NO: 41815 - DNA, 26 bp, Homo sapiens
ccttcccccgccgcccctcctcctcc

SEQ ID NO: 41816 - DNA, 27 bp, Homo sapiens
ccttcccccgccgcccctcctcctcct

SEQ ID NO: 41817 - DNA, 28 bp, Homo sapiens
ccttcccccgccgcccctcctcctcctc

SEQ ID NO: 41818 - DNA, 29 bp, Homo sapiens
ccttcccccgccgcccctcctcctcctcc

SEQ ID NO: 41819 - DNA, 30 bp, Homo sapiens
ccttcccccgccgcccctcctcctcctccc

SEQ ID NO: 41820 - DNA, 17 bp, Homo sapiens
cttcccccgccgcccct

SEQ ID NO: 41821 - DNA, 18 bp, Homo sapiens
cttcccccgccgcccctc

SEQ ID NO: 41822 - DNA, 19 bp, Homo sapiens
cttcccccgccgcccctcc

SEQ ID NO: 41823 - DNA, 20 bp, Homo sapiens
cttcccccgccgcccctcct

SEQ ID NO: 41824 - DNA, 21 bp, Homo sapiens
cttcccccgccgcccctcctc

SEQ ID NO: 41825 - DNA, 22 bp, Homo sapiens
cttcccccgccgcccctcctcc

SEQ ID NO: 41826 - DNA, 23 bp, Homo sapiens
cttcccccgccgcccctcctcct

SEQ ID NO: 41827 - DNA, 24 bp, Homo sapiens
cttcccccgccgcccctcctcctc

SEQ ID NO: 41828 - DNA, 25 bp, Homo sapiens
cttcccccgccgcccctcctcctcc

SEQ ID NO: 41829 - DNA, 26 bp, Homo sapiens
cttcccccgccgcccctcctcctcct

SEQ ID NO: 41830 - DNA, 27 bp, Homo sapiens
cttcccccgccgcccctcctcctcctc

SEQ ID NO: 41831 - DNA, 28 bp, Homo sapiens
cttcccccgccgcccctcctcctcctcc

SEQ ID NO: 41832 - DNA, 17 bp, Homo sapiens
ttcccccgccgcccctc

SEQ ID NO: 41833 - DNA, 18 bp, Homo sapiens
ttcccccgccgcccctcc

SEQ ID NO: 41834 - DNA, 19 bp, Homo sapiens
ttcccccgccgcccctcct

SEQ ID NO: 41835 - DNA, 20 bp, Homo sapiens
ttcccccgccgcccctcctc

SEQ ID NO: 41836 - DNA, 21 bp, Homo sapiens
ttcccccgccgcccctcctcc

SEQ ID NO: 41837 - DNA, 22 bp, Homo sapiens
ttcccccgccgcccctcctcct

SEQ ID NO: 41838 - DNA, 24 bp, Homo sapiens
ttcccccgccgcccctcctcctcc

SEQ ID NO: 41839 - DNA, 25 bp, Homo sapiens
ttcccccgccgcccctcctcctcct

SEQ ID NO: 41840 - DNA, 26 bp, Homo sapiens
ttcccccgccgcccctcctcctcctc

SEQ ID NO: 41841 - DNA, 27 bp, Homo sapiens
ttcccccgccgcccctcctcctcctcc

SEQ ID NO: 41842 - DNA, 18 bp, Homo sapiens
tcccccgccgcccctcct

SEQ ID NO: 41843 - DNA, 19 bp, Homo sapiens
tcccccgccgcccctcctc

SEQ ID NO: 41844 - DNA, 20 bp, Homo sapiens
tcccccgccgcccctcctcc

SEQ ID NO: 41845 - DNA, 23 bp, Homo sapiens
tcccccgccgcccctcctcctcc

SEQ ID NO: 41846 - DNA, 17 bp, Homo sapiens
cccccgccgcccctcct

SEQ ID NO: 41847 - DNA, 18 bp, Homo sapiens
cccccgccgcccctcctc

SEQ ID NO: 41848 - DNA, 19 bp, Homo sapiens
cccccgccgcccctcctcc

SEQ ID NO: 41849 - DNA, 20 bp, Homo sapiens
cccccgccgcccctcctcct

SEQ ID NO: 41850 - DNA, 21 bp, Homo sapiens
cccccgccgcccctcctcctc

SEQ ID NO: 41851 - DNA, 22 bp, Homo sapiens
cccccgccgcccctcctcctcc

SEQ ID NO: 41852 - DNA, 23 bp, Homo sapiens
cccccgccgcccctcctcctcct

SEQ ID NO: 41853 - DNA, 24 bp, Homo sapiens
cccccgccgcccctcctcctcctc

SEQ ID NO: 41854 - DNA, 25 bp, Homo sapiens
cccccgccgcccctcctcctcctcc

SEQ ID NO: 41855 - DNA, 17 bp, Homo sapiens
ccccgccgcccctcctc

SEQ ID NO: 41856 - DNA, 18 bp, Homo sapiens
ccccgccgcccctcctcc

SEQ ID NO: 41857 - DNA, 19 bp, Homo sapiens
ccccgccgcccctcctcct

SEQ ID NO: 41858 - DNA, 20 bp, Homo sapiens
ccccgccgcccctcctcctc

SEQ ID NO: 41859 - DNA, 21 bp, Homo sapiens
ccccgccgcccctcctcctcc

SEQ ID NO: 41860 - DNA, 22 bp, Homo sapiens
ccccgccgcccctcctcctcct

SEQ ID NO: 41861 - DNA, 23 bp, Homo sapiens
ccccgccgcccctcctcctcctc

SEQ ID NO: 41862 - DNA, 24 bp, Homo sapiens
ccccgccgcccctcctcctcctcc

SEQ ID NO: 41863 - DNA, 25 bp, Homo sapiens
ccccgccgcccctcctcctcctccc

SEQ ID NO: 41864 - DNA, 26 bp, Homo sapiens
ccccgccgcccctcctcctcctcccc

SEQ ID NO: 41865 - DNA, 16 bp, Homo sapiens
cccgccgcccctcctc

SEQ ID NO: 41866 - DNA, 17 bp, Homo sapiens
cccgccgcccctcctcc

SEQ ID NO: 41867 - DNA, 18 bp, Homo sapiens
cccgccgcccctcctcct

SEQ ID NO: 41868 - DNA, 19 bp, Homo sapiens
cccgccgcccctcctcctc

SEQ ID NO: 41869 - DNA, 20 bp, Homo sapiens
cccgccgcccctcctcctcc

SEQ ID NO: 41870 - DNA, 21 bp, Homo sapiens
cccgccgcccctcctcctcct

SEQ ID NO: 41871 - DNA, 22 bp, Homo sapiens
cccgccgcccctcctcctcctc

SEQ ID NO: 41872 - DNA, 23 bp, Homo sapiens
cccgccgcccctcctcctcctcc

SEQ ID NO: 41873 - DNA, 24 bp, Homo sapiens
cccgccgcccctcctcctcctccc

SEQ ID NO: 41874 - DNA, 25 bp, Homo sapiens
cccgccgcccctcctcctcctcccc

SEQ ID NO: 41875 - DNA, 16 bp, Homo sapiens
ccgccgcccctcctcc

SEQ ID NO: 41876 - DNA, 17 bp, Homo sapiens
ccgccgcccctcctcct

SEQ ID NO: 41877 - DNA, 18 bp, Homo sapiens
ccgccgcccctcctcctc

SEQ ID NO: 41878 - DNA, 19 bp, Homo sapiens
ccgccgcccctcctcctcc

SEQ ID NO: 41879 - DNA, 20 bp, Homo sapiens
ccgccgcccctcctcctcct

SEQ ID NO: 41880 - DNA, 21 bp, Homo sapiens
ccgccgcccctcctcctcctc

SEQ ID NO: 41881 - DNA, 22 bp, Homo sapiens
ccgccgcccctcctcctcctcc

SEQ ID NO: 41882 - DNA, 23 bp, Homo sapiens
ccgccgcccctcctcctcctccc

SEQ ID NO: 41883 - DNA, 16 bp, Homo sapiens
cgccgcccctcctcct

SEQ ID NO: 41884 - DNA, 18 bp, Homo sapiens
cgccgcccctcctcctcc

SEQ ID NO: 41885 - DNA, 19 bp, Homo sapiens
cgccgcccctcctcctcct

SEQ ID NO: 41886 - DNA, 20 bp, Homo sapiens
cgccgcccctcctcctcctc

SEQ ID NO: 41887 - DNA, 21 bp, Homo sapiens
cgccgcccctcctcctcctcc

SEQ ID NO: 41888 - DNA, 17 bp, Homo sapiens
cctcctcctcctccccg

SEQ ID NO: 41889 - DNA, 20 bp, Homo sapiens
cggagggggcgggctccggc

SEQ ID NO: 41890 - DNA, 22 bp, Homo sapiens
cggagggggcgggctccggcgg

SEQ ID NO: 41891 - DNA, 23 bp, Homo sapiens
cggagggggcgggctccggcggg

SEQ ID NO: 41892 - DNA, 24 bp, Homo sapiens
cggagggggcgggctccggcgggt

SEQ ID NO: 41893 - DNA, 25 bp, Homo sapiens
cggagggggcgggctccggcgggtg

SEQ ID NO: 41894 - DNA, 26 bp, Homo sapiens
cggagggggcgggctccggcgggtgc

SEQ ID NO: 41895 - DNA, 16 bp, Homo sapiens
ggagggggcgggctcc

SEQ ID NO: 41896 - DNA, 17 bp, Homo sapiens
ggagggggcgggctccg

SEQ ID NO: 41897 - DNA, 18 bp, Homo sapiens
ggagggggcgggctccgg

SEQ ID NO: 41898 - DNA, 19 bp, Homo sapiens
ggagggggcgggctccggc

SEQ ID NO: 41899 - DNA, 20 bp, Homo sapiens
ggagggggcgggctccggcg

SEQ ID NO: 41900 - DNA, 21 bp, Homo sapiens
ggagggggcgggctccggcgg

SEQ ID NO: 41901 - DNA, 22 bp, Homo sapiens
ggagggggcgggctccggcggg

SEQ ID NO: 41902 - DNA, 23 bp, Homo sapiens
ggagggggcgggctccggcgggt

SEQ ID NO: 41903 - DNA, 24 bp, Homo sapiens
ggagggggcgggctccggcgggtg

SEQ ID NO: 41904 - DNA, 25 bp, Homo sapiens
ggagggggcgggctccggcgggtgc

SEQ ID NO: 41905 - DNA, 26 bp, Homo sapiens
ggagggggcgggctccggcgggtgcg

SEQ ID NO: 41906 - DNA, 27 bp, Homo sapiens
ggagggggcgggctccggcgggtgcgg

SEQ ID NO: 41907 - DNA, 30 bp, Homo sapiens
ggagggggcgggctccggcgggtgcggggg

SEQ ID NO: 41908 - DNA, 17 bp, Homo sapiens
gagggggcgggctccgg

SEQ ID NO: 41909 - DNA, 18 bp, Homo sapiens
gagggggcgggctccggc

SEQ ID NO: 41910 - DNA, 19 bp, Homo sapiens
gagggggcgggctccggcg

SEQ ID NO: 41911 - DNA, 20 bp, Homo sapiens
gagggggcgggctccggcgg

SEQ ID NO: 41912 - DNA, 21 bp, Homo sapiens
gagggggcgggctccggcggg

SEQ ID NO: 41913 - DNA, 22 bp, Homo sapiens
gagggggcgggctccggcgggt

SEQ ID NO: 41914 - DNA, 23 bp, Homo sapiens
gagggggcgggctccggcgggtg

SEQ ID NO: 41915 - DNA, 24 bp, Homo sapiens
gagggggcgggctccggcgggtgc

SEQ ID NO: 41916 - DNA, 25 bp, Homo sapiens
gagggggcgggctccggcgggtgcg

SEQ ID NO: 41917 - DNA, 26 bp, Homo sapiens
gagggggcgggctccggcgggtgcgg

SEQ ID NO: 41918 - DNA, 30 bp, Homo sapiens; identical to SEQ ID NO: 19429

SEQ ID NO: 41919 - DNA, 19 bp, Homo sapiens
agggggcgggctccggcgg

SEQ ID NO: 41920 - DNA, 20 bp, Homo sapiens
agggggcgggctccggcggg

SEQ ID NO: 41921 - DNA, 19 bp, Homo sapiens
gggggcgggctccggcggg

SEQ ID NO: 41922 - DNA, 20 bp, Homo sapiens
gggggcgggctccggcgggt

SEQ ID NO: 41923 - DNA, 17 bp, Homo sapiens
ggggcgggctccggcgg

SEQ ID NO: 41924 - DNA, 18 bp, Homo sapiens
ggggcgggctccggcggg

SEQ ID NO: 41925 - DNA, 19 bp, Homo sapiens
ggggcgggctccggcgggt

SEQ ID NO: 41926 - DNA, 21 bp, Homo sapiens
ggggcgggctccggcgggtgc

SEQ ID NO: 41927 - DNA, 18 bp, Homo sapiens
gcgggctccggcgggtgc

SEQ ID NO: 41928 - DNA, 20 bp, Homo sapiens
gcgggctccggcgggtgcgg

SEQ ID NO: 41929 - DNA, 16 bp, Homo sapiens
gggctccggcgggtgc

SEQ ID NO: 41930 - DNA, 18 bp, Homo sapiens
gggctccggcgggtgcgg

SEQ ID NO: 41931 - DNA, 19 bp, Homo sapiens
gggctccggcgggtgcggg

SEQ ID NO: 41932 - DNA, 20 bp, Homo sapiens
gggctccggcgggtgcgggg

SEQ ID NO: 41933 - DNA, 24 bp, Homo sapiens
gggctccggcgggtgcgggggtgg

SEQ ID NO: 41934 - DNA, 26 bp, Homo sapiens
gggctccggcgggtgcgggggtgggc

SEQ ID NO: 41935 - DNA, 22 bp, Homo sapiens
ggctccggcgggtgcgggggtg

SEQ ID NO: 41936 - DNA, 18 bp, Homo sapiens
ccggcgggtgcgggggtg

SEQ ID NO: 41937 - DNA, 22 bp, Homo sapiens
ccggcgggtgcgggggtgggcg

SEQ ID NO: 41938 - DNA, 23 bp, Homo sapiens
ccggcgggtgcgggggtgggcgg

SEQ ID NO: 41939 - DNA, 20 bp, Homo sapiens
cggcgggtgcgggggtgggc

SEQ ID NO: 41940 - DNA, 22 bp, Homo sapiens
cggcgggtgcgggggtgggcgg

SEQ ID NO: 41941 - DNA, 16 bp, Homo sapiens
ggcgggtgcgggggtg

SEQ ID NO: 41942 - DNA, 17 bp, Homo sapiens
ggcgggtgcgggggtgg

SEQ ID NO: 41943 - DNA, 18 bp, Homo sapiens
ggcgggtgcgggggtggg

SEQ ID NO: 41944 - DNA, 19 bp, Homo sapiens
ggcgggtgcgggggtgggc

SEQ ID NO: 41945 - DNA, 20 bp, Homo sapiens
ggcgggtgcgggggtgggcg

SEQ ID NO: 41946 - DNA, 21 bp, Homo sapiens
ggcgggtgcgggggtgggcgg

SEQ ID NO: 41947 - DNA, 16 bp, Homo sapiens
gcgggtgcgggggtgg

SEQ ID NO: 41948 - DNA, 17 bp, Homo sapiens
gcgggtgcgggggtggg

SEQ ID NO: 41949 - DNA, 18 bp, Homo sapiens
gcgggtgcgggggtgggc

SEQ ID NO: 41950 - DNA, 19 bp, Homo sapiens
gcgggtgcgggggtgggcg

SEQ ID NO: 41951 - DNA, 16 bp, Homo sapiens
gggtgcgggggtgggc

SEQ ID NO: 41952 - DNA, 17 bp, Homo sapiens
gggtgcgggggtgggcg

SEQ ID NO: 41953 - DNA, 18 bp, Homo sapiens
gggtgcgggggtgggcgg

SEQ ID NO: 41954 - DNA, 17 bp, Homo sapiens
ggtgcgggggtgggcgg

SEQ ID NO: 41955 - DNA, 16 bp, Homo sapiens
gtgcgggggtgggcgg

SEQ ID NO: 41956 - DNA, 18 bp, Homo sapiens
gtgcgggggtgggcgggc

SEQ ID NO: 41957 - DNA, 19 bp, Homo sapiens
gtgcgggggtgggcgggcg

SEQ ID NO: 41958 - DNA, 17 bp, Homo sapiens
cgggggtgggcgggcgg

SEQ ID NO: 41959 - DNA, 17 bp, Homo sapiens
ggtgggcgggcggggcc

SEQ ID NO: 41960 - DNA, 19 bp, Homo sapiens
ggtgggcgggcggggccgg

SEQ ID NO: 41961 - DNA, 17 bp, Homo sapiens
ggcgggcggggccgggg

SEQ ID NO: 41962 - DNA, 18 bp, Homo sapiens
ggcgggcggggccggggg

SEQ ID NO: 41963 - DNA, 19 bp, Homo sapiens
ggcgggcggggccgggggt

SEQ ID NO: 41964 - DNA, 20 bp, Homo sapiens
ggcgggcggggccgggggtg

SEQ ID NO: 41965 - DNA, 21 bp, Homo sapiens
ggcgggcggggccgggggtgg

SEQ ID NO: 41966 - DNA, 17 bp, Homo sapiens
gcgggcggggccggggg

SEQ ID NO: 41967 - DNA, 18 bp, Homo sapiens
gcgggcggggccgggggt

SEQ ID NO: 41968 - DNA, 16 bp, Homo sapiens
gggcggggccgggggt

SEQ ID NO: 41969 - DNA, 17 bp, Homo sapiens
ggcggggccgggggtgg

SEQ ID NO: 41970 - DNA, 18 bp, Homo sapiens
ggcggggccgggggtggg

SEQ ID NO: 41971 - DNA, 19 bp, Homo sapiens
ggcggggccgggggtgggg

SEQ ID NO: 41972 - DNA, 20 bp, Homo sapiens
ggcggggccgggggtggggt

SEQ ID NO: 41973 - DNA, 21 bp, Homo sapiens
ggcggggccgggggtggggtc

SEQ ID NO: 41974 - DNA, 16 bp, Homo sapiens
gcggggccgggggtgg

SEQ ID NO: 41975 - DNA, 17 bp, Homo sapiens
gcggggccgggggtggg

SEQ ID NO: 41976 - DNA, 21 bp, Homo sapiens
gccgggggtggggtcggcggg

SEQ ID NO: 41977 - DNA, 18 bp, Homo sapiens
cgggggtggggtcggcgg

SEQ ID NO: 41978 - DNA, 19 bp, Homo sapiens
cgggggtggggtcggcggg

SEQ ID NO: 41979 - DNA, 20 bp, Homo sapiens
cgggggtggggtcggcgggg

SEQ ID NO: 41980 - DNA, 17 bp, Homo sapiens
gggggtggggtcggcgg

SEQ ID NO: 41981 - DNA, 18 bp, Homo sapiens
gggggtggggtcggcggg

SEQ ID NO: 41982 - DNA, 19 bp, Homo sapiens
gggggtggggtcggcgggg

SEQ ID NO: 41983 - DNA, 16 bp, Homo sapiens
ggggtggggtcggcgg

SEQ ID NO: 41984 - DNA, 17 bp, Homo sapiens
ggggtggggtcggcggg

SEQ ID NO: 41985 - DNA, 18 bp, Homo sapiens
ggggtggggtcggcgggg

SEQ ID NO: 41986 - DNA, 20 bp, Homo sapiens
ggggtggggtcggcggggga

SEQ ID NO: 41987 - DNA, 21 bp, Homo sapiens
ggggtggggtcggcgggggac

SEQ ID NO: 41988 - DNA, 16 bp, Homo sapiens
ggtggggtcggcgggg

SEQ ID NO: 41989 - DNA, 18 bp, Homo sapiens
ggtggggtcggcggggga

SEQ ID NO: 41990 - DNA, 17 bp, Homo sapiens
gtggggtcggcggggga

SEQ ID NO: 41991 - DNA, 22 bp, Homo sapiens
ggtcggcgggggaccgtccccc

SEQ ID NO: 41992 - DNA, 23 bp, Homo sapiens
ggtcggcgggggaccgtcccccg

SEQ ID NO: 41993 - DNA, 24 bp, Homo sapiens
ggtcggcgggggaccgtcccccga

SEQ ID NO: 41994 - DNA, 22 bp, Homo sapiens
cgggggaccgtcccccgaccgg

SEQ ID NO: 41995 - DNA, 21 bp, Homo sapiens
gggggaccgtcccccgaccgg

SEQ ID NO: 41996 - DNA, 20 bp, Homo sapiens
ggggaccgtcccccgaccgg

SEQ ID NO: 41997 - DNA, 27 bp, Homo sapiens
ggggaccgtcccccgaccggcgaccgg

SEQ ID NO: 41998 - DNA, 19 bp, Homo sapiens
gggaccgtcccccgaccgg

SEQ ID NO: 41999 - DNA, 16 bp, Homo sapiens
ggaccgtcccccgacc

SEQ ID NO: 42000 - DNA, 17 bp, Homo sapiens
ggaccgtcccccgaccg

SEQ ID NO: 42001 - DNA, 18 bp, Homo sapiens
ggaccgtcccccgaccgg

SEQ ID NO: 42002 - DNA, 19 bp, Homo sapiens
ggaccgtcccccgaccggc

SEQ ID NO: 42003 - DNA, 20 bp, Homo sapiens
ggaccgtcccccgaccggcg

SEQ ID NO: 42004 - DNA, 22 bp, Homo sapiens
ggaccgtcccccgaccggcgac

SEQ ID NO: 42005 - DNA, 23 bp, Homo sapiens
ggaccgtcccccgaccggcgacc

SEQ ID NO: 42006 - DNA, 25 bp, Homo sapiens
ggaccgtcccccgaccggcgaccgg

SEQ ID NO: 42007 - DNA, 18 bp, Homo sapiens
gaccgtcccccgaccggc

SEQ ID NO: 42008 - DNA, 22 bp, Homo sapiens
gaccgtcccccgaccggcgacc

SEQ ID NO: 42009 - DNA, 24 bp, Homo sapiens
gaccgtcccccgaccggcgaccgg

SEQ ID NO: 42010 - DNA, 23 bp, Homo sapiens
accgtcccccgaccggcgaccgg

SEQ ID NO: 42011 - DNA, 22 bp, Homo sapiens
ccgtcccccgaccggcgaccgg

SEQ ID NO: 42012 - DNA, 16 bp, Homo sapiens
cgtcccccgaccggcg

SEQ ID NO: 42013 - DNA, 21 bp, Homo sapiens
cgtcccccgaccggcgaccgg

SEQ ID NO: 42014 - DNA, 20 bp, Homo sapiens
gtcccccgaccggcgaccgg

SEQ ID NO: 42015 - DNA, 30 bp, Homo sapiens
gtcccccgaccggcgaccggccgccgccgg

SEQ ID NO: 42016 - DNA, 19 bp, Homo sapiens
tcccccgaccggcgaccgg

SEQ ID NO: 42017 - DNA, 18 bp, Homo sapiens
cccccgaccggcgaccgg

SEQ ID NO: 42018 - DNA, 26 bp, Homo sapiens
cccccgaccggcgaccggccgccgcc

SEQ ID NO: 42019 - DNA, 27 bp, Homo sapiens
cccccgaccggcgaccggccgccgccg

SEQ ID NO: 42020 - DNA, 28 bp, Homo sapiens
cccccgaccggcgaccggccgccgccgg

SEQ ID NO: 42021 - DNA, 17 bp, Homo sapiens
ccccgaccggcgaccgg

SEQ ID NO: 42022 - DNA, 22 bp, Homo sapiens
ccccgaccggcgaccggccgcc

SEQ ID NO: 42023 - DNA, 23 bp, Homo sapiens
ccccgaccggcgaccggccgccg

SEQ ID NO: 42024 - DNA, 24 bp, Homo sapiens
ccccgaccggcgaccggccgccgc

SEQ ID NO: 42025 - DNA, 25 bp, Homo sapiens
ccccgaccggcgaccggccgccgcc

SEQ ID NO: 42026 - DNA, 27 bp, Homo sapiens
ccccgaccggcgaccggccgccgccgg

SEQ ID NO: 42027 - DNA, 21 bp, Homo sapiens
cccgaccggcgaccggccgcc

SEQ ID NO: 42028 - DNA, 22 bp, Homo sapiens
cccgaccggcgaccggccgccg

SEQ ID NO: 42029 - DNA, 24 bp, Homo sapiens
cccgaccggcgaccggccgccgcc

SEQ ID NO: 42030 - DNA, 22 bp, Homo sapiens
ccggcgaccggccgccgccggg

SEQ ID NO: 42031 - DNA, 20 bp, Homo sapiens
cggcgaccggccgccgccgg

SEQ ID NO: 42032 - DNA, 21 bp, Homo sapiens
cggcgaccggccgccgccggg

SEQ ID NO: 42033 - DNA, 19 bp, Homo sapiens
ggcgaccggccgccgccgg

SEQ ID NO: 42034 - DNA, 20 bp, Homo sapiens
ggcgaccggccgccgccggg

SEQ ID NO: 42035 - DNA, 21 bp, Homo sapiens
ggcgaccggccgccgccgggc

SEQ ID NO: 42036 - DNA, 22 bp, Homo sapiens
ggcgaccggccgccgccgggcg

SEQ ID NO: 42037 - DNA, 23 bp, Homo sapiens
ggcgaccggccgccgccgggcgc

SEQ ID NO: 42038 - DNA, 17 bp, Homo sapiens
gcgaccggccgccgccg

SEQ ID NO: 42039 - DNA, 19 bp, Homo sapiens
gcgaccggccgccgccggg

SEQ ID NO: 42040 - DNA, 20 bp, Homo sapiens
gcgaccggccgccgccgggc

SEQ ID NO: 42041 - DNA, 21 bp, Homo sapiens
gcgaccggccgccgccgggcg

SEQ ID NO: 42042 - DNA, 18 bp, Homo sapiens
cgaccggccgccgccggg

SEQ ID NO: 42043 - DNA, 19 bp, Homo sapiens
cgaccggccgccgccgggc

SEQ ID NO: 42044 - DNA, 20 bp, Homo sapiens
cgaccggccgccgccgggcg

SEQ ID NO: 42045 - DNA, 21 bp, Homo sapiens
cgaccggccgccgccgggcgc

SEQ ID NO: 42046 - DNA, 17 bp, Homo sapiens
gaccggccgccgccggg

SEQ ID NO: 42047 - DNA, 18 bp, Homo sapiens
ccggccgccgccgggcgc

SEQ ID NO: 42048 - DNA, 16 bp, Homo sapiens
ggccgccgccgggcgc

SEQ ID NO: 42049 - DNA, 17 bp, Homo sapiens
gcgcatttccaccgcgg

SEQ ID NO: 42050 - DNA, 21 bp, Homo sapiens
cgcatttccaccgcggcggtg

SEQ ID NO: 42051 - DNA, 21 bp, Homo sapiens
gcatttccaccgcggcggtgc

SEQ ID NO: 42052 - DNA, 17 bp, Homo sapiens
catttccaccgcggcgg

SEQ ID NO: 42053 - DNA, 21 bp, Homo sapiens
tttccaccgcggcggtgcgcc

SEQ ID NO: 42054 - DNA, 20 bp, Homo sapiens
ttccaccgcggcggtgcgcc

SEQ ID NO: 42055 - DNA, 23 bp, Homo sapiens
ccgcggcggtgcgccgcgaccgg

SEQ ID NO: 42056 - DNA, 22 bp, Homo sapiens
cgcggcggtgcgccgcgaccgg

SEQ ID NO: 42057 - DNA, 20 bp, Homo sapiens
gcggcggtgcgccgcgaccg

SEQ ID NO: 42058 - DNA, 21 bp, Homo sapiens
gcggcggtgcgccgcgaccgg

SEQ ID NO: 42059 - DNA, 27 bp, Homo sapiens
gcggcggtgcgccgcgaccggctccgg

SEQ ID NO: 42060 - DNA, 30 bp, Homo sapiens; identical to SEQ ID NO: 19476

SEQ ID NO: 42061 - DNA, 20 bp, Homo sapiens
cggcggtgcgccgcgaccgg

SEQ ID NO: 42062 - DNA, 26 bp, Homo sapiens
cggcggtgcgccgcgaccggctccgg

SEQ ID NO: 42063 - DNA, 19 bp, Homo sapiens
ggcggtgcgccgcgaccgg

SEQ ID NO: 42064 - DNA, 25 bp, Homo sapiens
ggcggtgcgccgcgaccggctccgg

SEQ ID NO: 42065 - DNA, 30 bp, Homo sapiens
ggcggtgcgccgcgaccggctccgggacgg

SEQ ID NO: 42066 - DNA, 18 bp, Homo sapiens
gcggtgcgccgcgaccgg

SEQ ID NO: 42067 - DNA, 24 bp, Homo sapiens
gcggtgcgccgcgaccggctccgg

SEQ ID NO: 42068 - DNA, 24 bp, Homo sapiens
cggtgcgccgcgaccggctccggg

SEQ ID NO: 42069 - DNA, 30 bp, Homo sapiens
cggtgcgccgcgaccggctccgggacggct

SEQ ID NO: 42070 - DNA, 17 bp, Homo sapiens
ggtgcgccgcgaccggc

SEQ ID NO: 42071 - DNA, 18 bp, Homo sapiens
ggtgcgccgcgaccggct

SEQ ID NO: 42072 - DNA, 20 bp, Homo sapiens
ggtgcgccgcgaccggctcc

SEQ ID NO: 42073 - DNA, 21 bp, Homo sapiens
ggtgcgccgcgaccggctccg

SEQ ID NO: 42074 - DNA, 22 bp, Homo sapiens
ggtgcgccgcgaccggctccgg

SEQ ID NO: 42075 - DNA, 23 bp, Homo sapiens
ggtgcgccgcgaccggctccggg

SEQ ID NO: 42076 - DNA, 24 bp, Homo sapiens
ggtgcgccgcgaccggctccggga

SEQ ID NO: 42077 - DNA, 25 bp, Homo sapiens
ggtgcgccgcgaccggctccgggac

SEQ ID NO: 42078 - DNA, 26 bp, Homo sapiens
ggtgcgccgcgaccggctccgggacg

SEQ ID NO: 42079 - DNA, 27 bp, Homo sapiens
ggtgcgccgcgaccggctccgggacgg

SEQ ID NO: 42080 - DNA, 28 bp, Homo sapiens
ggtgcgccgcgaccggctccgggacggc

SEQ ID NO: 42081 - DNA, 29 bp, Homo sapiens
ggtgcgccgcgaccggctccgggacggct

SEQ ID NO: 42082 - DNA, 30 bp, Homo sapiens
ggtgcgccgcgaccggctccgggacggctg

SEQ ID NO: 42083 - DNA, 21 bp, Homo sapiens
gtgcgccgcgaccggctccgg

SEQ ID NO: 42084 - DNA, 25 bp, Homo sapiens
gtgcgccgcgaccggctccgggacg

SEQ ID NO: 42085 - DNA, 20 bp, Homo sapiens
tgcgccgcgaccggctccgg

SEQ ID NO: 42086 - DNA, 22 bp, Homo sapiens
tgcgccgcgaccggctccggga

SEQ ID NO: 42087 - DNA, 23 bp, Homo sapiens
tgcgccgcgaccggctccgggac

SEQ ID NO: 42088 - DNA, 30 bp, Homo sapiens
tgcgccgcgaccggctccgggacggctggg

SEQ ID NO: 42089 - DNA, 19 bp, Homo sapiens
gcgccgcgaccggctccgg

SEQ ID NO: 42090 - DNA, 20 bp, Homo sapiens
gcgccgcgaccggctccggg

SEQ ID NO: 42091 - DNA, 22 bp, Homo sapiens
gcgccgcgaccggctccgggac

SEQ ID NO: 42092 - DNA, 18 bp, Homo sapiens
cgccgcgaccggctccgg

SEQ ID NO: 42093 - DNA, 19 bp, Homo sapiens
cgccgcgaccggctccggg

SEQ ID NO: 42094 - DNA, 20 bp, Homo sapiens
cgccgcgaccggctccggga

SEQ ID NO: 42095 - DNA, 21 bp, Homo sapiens
cgccgcgaccggctccgggac

SEQ ID NO: 42096 - DNA, 22 bp, Homo sapiens
cgccgcgaccggctccgggacg

SEQ ID NO: 42097 - DNA, 23 bp, Homo sapiens
cgccgcgaccggctccgggacgg

SEQ ID NO: 42098 - DNA, 29 bp, Homo sapiens
cgccgcgaccggctccgggacggctggga

SEQ ID NO: 42099 - DNA, 17 bp, Homo sapiens
gccgcgaccggctccgg

SEQ ID NO: 42100 - DNA, 18 bp, Homo sapiens
gccgcgaccggctccggg

SEQ ID NO: 42101 - DNA, 19 bp, Homo sapiens
gccgcgaccggctccggga

SEQ ID NO: 42102 - DNA, 20 bp, Homo sapiens
gccgcgaccggctccgggac

SEQ ID NO: 42103 - DNA, 21 bp, Homo sapiens
gccgcgaccggctccgggacg

SEQ ID NO: 42104 - DNA, 22 bp, Homo sapiens
gccgcgaccggctccgggacgg

SEQ ID NO: 42105 - DNA, 16 bp, Homo sapiens
ccgcgaccggctccgg

SEQ ID NO: 42106 - DNA, 17 bp, Homo sapiens
ccgcgaccggctccggg

SEQ ID NO: 42107 - DNA, 18 bp, Homo sapiens
ccgcgaccggctccggga

SEQ ID NO: 42108 - DNA, 19 bp, Homo sapiens
ccgcgaccggctccgggac

SEQ ID NO: 42109 - DNA, 20 bp, Homo sapiens
ccgcgaccggctccgggacg

SEQ ID NO: 42110 - DNA, 21 bp, Homo sapiens
ccgcgaccggctccgggacgg

SEQ ID NO: 42111 - DNA, 22 bp, Homo sapiens
ccgcgaccggctccgggacggc

SEQ ID NO: 42112 - DNA, 23 bp, Homo sapiens
ccgcgaccggctccgggacggct

SEQ ID NO: 42113 - DNA, 26 bp, Homo sapiens
ccgcgaccggctccgggacggctggg

SEQ ID NO: 42114 - DNA, 27 bp, Homo sapiens
ccgcgaccggctccgggacggctggga

SEQ ID NO: 42115 - DNA, 28 bp, Homo sapiens
ccgcgaccggctccgggacggctgggaa

SEQ ID NO: 42116 - DNA, 16 bp, Homo sapiens
cgcgaccggctccggg

SEQ ID NO: 42117 - DNA, 21 bp, Homo sapiens
cgcgaccggctccgggacggc

SEQ ID NO: 42118 - DNA, 25 bp, Homo sapiens
cgcgaccggctccgggacggctggg

SEQ ID NO: 42119 - DNA, 26 bp, Homo sapiens
cgcgaccggctccgggacggctggga

SEQ ID NO: 42120 - DNA, 19 bp, Homo sapiens
gcgaccggctccgggacgg

SEQ ID NO: 42121 - DNA, 20 bp, Homo sapiens
gcgaccggctccgggacggc

SEQ ID NO: 42122 - DNA, 21 bp, Homo sapiens
gcgaccggctccgggacggct

SEQ ID NO: 42123 - DNA, 22 bp, Homo sapiens
gcgaccggctccgggacggctg

SEQ ID NO: 42124 - DNA, 24 bp, Homo sapiens
gcgaccggctccgggacggctggg

SEQ ID NO: 42125 - DNA, 25 bp, Homo sapiens
gcgaccggctccgggacggctggga

SEQ ID NO: 42126 - DNA, 29 bp, Homo sapiens
gcgaccggctccgggacggctgggaaggc

SEQ ID NO: 42127 - DNA, 30 bp, Homo sapiens
gcgaccggctccgggacggctgggaaggcc

SEQ ID NO: 42128 - DNA, 23 bp, Homo sapiens
cgaccggctccgggacggctggg

SEQ ID NO: 42129 - DNA, 24 bp, Homo sapiens
cgaccggctccgggacggctggga

SEQ ID NO: 42130 - DNA, 21 bp, Homo sapiens
ccggctccgggacggctggga

SEQ ID NO: 42131 - DNA, 19 bp, Homo sapiens
cggctccgggacggctggg

SEQ ID NO: 42132 - DNA, 20 bp, Homo sapiens
cggctccgggacggctggga

SEQ ID NO: 42133 - DNA, 21 bp, Homo sapiens
cggctccgggacggctgggaa

SEQ ID NO: 42134 - DNA, 18 bp, Homo sapiens
ggctccgggacggctggg

SEQ ID NO: 42135 - DNA, 19 bp, Homo sapiens
ggctccgggacggctggga

SEQ ID NO: 42136 - DNA, 20 bp, Homo sapiens
ggctccgggacggctgggaa

SEQ ID NO: 42137 - DNA, 22 bp, Homo sapiens
ggctccgggacggctgggaagg

SEQ ID NO: 42138 - DNA, 23 bp, Homo sapiens
ggctccgggacggctgggaaggc

SEQ ID NO: 42139 - DNA, 17 bp, Homo sapiens
gctccgggacggctggg

SEQ ID NO: 42140 - DNA, 18 bp, Homo sapiens
gctccgggacggctggga

SEQ ID NO: 42141 - DNA, 19 bp, Homo sapiens
gctccgggacggctgggaa

SEQ ID NO: 42142 - DNA, 21 bp, Homo sapiens
gctccgggacggctgggaagg

SEQ ID NO: 42143 - DNA, 22 bp, Homo sapiens
gctccgggacggctgggaaggc

SEQ ID NO: 42144 - DNA, 17 bp, Homo sapiens
ctccgggacggctggga

SEQ ID NO: 42145 - DNA, 18 bp, Homo sapiens
ctccgggacggctgggaa

SEQ ID NO: 42146 - DNA, 21 bp, Homo sapiens
ctccgggacggctgggaaggc

SEQ ID NO: 42147 - DNA, 21 bp, Homo sapiens
ggacggctgggaaggcccggc

SEQ ID NO: 42148 - DNA, 20 bp, Homo sapiens
gacggctgggaaggcccggc

SEQ ID NO: 42149 - DNA, 19 bp, Homo sapiens
acggctgggaaggcccggc

SEQ ID NO: 42150 - DNA, 21 bp, Homo sapiens
cggctgggaaggcccggcggg

SEQ ID NO: 42151 - DNA, 20 bp, Homo sapiens
ggctgggaaggcccggcggg

SEQ ID NO: 42152 - DNA, 19 bp, Homo sapiens
ctgggaaggcccggcgggg

SEQ ID NO: 42153 - DNA, 20 bp, Homo sapiens
ctgggaaggcccggcgggga

SEQ ID NO: 42154 - DNA, 24 bp, Homo sapiens
ctgggaaggcccggcggggaaggt

SEQ ID NO: 42155 - DNA, 16 bp, Homo sapiens
tgggaaggcccggcgg

SEQ ID NO: 42156 - DNA, 17 bp, Homo sapiens
tgggaaggcccggcggg

SEQ ID NO: 42157 - DNA, 23 bp, Homo sapiens
tgggaaggcccggcggggaaggt

SEQ ID NO: 42158 - DNA, 20 bp, Homo sapiens
gggaaggcccggcggggaag

SEQ ID NO: 42159 - DNA, 21 bp, Homo sapiens
gggaaggcccggcggggaagg

SEQ ID NO: 42160 - DNA, 22 bp, Homo sapiens
gggaaggcccggcggggaaggt

SEQ ID NO: 42161 - DNA, 21 bp, Homo sapiens
ggaaggcccggcggggaaggt

SEQ ID NO: 42162 - DNA, 19 bp, Homo sapiens
gaaggcccggcggggaagg

SEQ ID NO: 42163 - DNA, 20 bp, Homo sapiens
gaaggcccggcggggaaggt

SEQ ID NO: 42164 - DNA, 17 bp, Homo sapiens
aaggcccggcggggaag

SEQ ID NO: 42165 - DNA, 18 bp, Homo sapiens
aaggcccggcggggaagg

SEQ ID NO: 42166 - DNA, 19 bp, Homo sapiens
aaggcccggcggggaaggt

SEQ ID NO: 42167 - DNA, 20 bp, Homo sapiens
aaggcccggcggggaaggtg

SEQ ID NO: 42168 - DNA, 21 bp, Homo sapiens
aaggcccggcggggaaggtgg

SEQ ID NO: 42169 - DNA, 22 bp, Homo sapiens
aaggcccggcggggaaggtggc

SEQ ID NO: 42170 - DNA, 17 bp, Homo sapiens
aggcccggcggggaagg

SEQ ID NO: 42171 - DNA, 18 bp, Homo sapiens
aggcccggcggggaaggt

SEQ ID NO: 42172 - DNA, 17 bp, Homo sapiens
ggcccggcggggaaggt

SEQ ID NO: 42173 - DNA, 22 bp, Homo sapiens
gcccggcggggaaggtggctcg

SEQ ID NO: 42174 - DNA, 23 bp, Homo sapiens
ggcggggaaggtggctcgggggg

SEQ ID NO: 42175 - DNA, 24 bp, Homo sapiens
ggcggggaaggtggctcggggggc

SEQ ID NO: 42176 - DNA, 21 bp, Homo sapiens
ggggaaggtggctcggggggc

SEQ ID NO: 42177 - DNA, 19 bp, Homo sapiens
gggaaggtggctcgggggg

SEQ ID NO: 42178 - DNA, 20 bp, Homo sapiens
gggaaggtggctcggggggc

SEQ ID NO: 42179 - DNA, 21 bp, Homo sapiens
gggaaggtggctcggggggcc

SEQ ID NO: 42180 - DNA, 22 bp, Homo sapiens
gggaaggtggctcggggggccc

SEQ ID NO: 42181 - DNA, 18 bp, Homo sapiens
ggaaggtggctcgggggg

SEQ ID NO: 42182 - DNA, 19 bp, Homo sapiens
ggaaggtggctcggggggc

SEQ ID NO: 42183 - DNA, 20 bp, Homo sapiens
ggaaggtggctcggggggcc

SEQ ID NO: 42184 - DNA, 21 bp, Homo sapiens
ggaaggtggctcggggggccc

SEQ ID NO: 42185 - DNA, 18 bp, Homo sapiens
gaaggtggctcggggggc

SEQ ID NO: 42186 - DNA, 18 bp, Homo sapiens
cggggggccccgtccgtc

SEQ ID NO: 42187 - DNA, 19 bp, Homo sapiens
cggggggccccgtccgtcc

SEQ ID NO: 42188 - DNA, 20 bp, Homo sapiens
cggggggccccgtccgtccg

SEQ ID NO: 42189 - DNA, 22 bp, Homo sapiens
cggggggccccgtccgtccgtc

SEQ ID NO: 42190 - DNA, 24 bp, Homo sapiens
cggggggccccgtccgtccgtccg

SEQ ID NO: 42191 - DNA, 28 bp, Homo sapiens
cggggggccccgtccgtccgtccgtccg

SEQ ID NO: 42192 - DNA, 22 bp, Homo sapiens
gggccccgtccgtccgtccgtc

SEQ ID NO: 42193 - DNA, 21 bp, Homo sapiens
ggccccgtccgtccgtccgtc

SEQ ID NO: 42194 - DNA, 22 bp, Homo sapiens
ggccccgtccgtccgtccgtcc

SEQ ID NO: 42195 - DNA, 25 bp, Homo sapiens
ggccccgtccgtccgtccgtccgtc

SEQ ID NO: 42196 - DNA, 20 bp, Homo sapiens
gccccgtccgtccgtccgtc

SEQ ID NO: 42197 - DNA, 24 bp, Homo sapiens
gccccgtccgtccgtccgtccgtc

SEQ ID NO: 42198 - DNA, 18 bp, Homo sapiens
cccgtccgtccgtccgtc

SEQ ID NO: 42199 - DNA, 19 bp, Homo sapiens
cccgtccgtccgtccgtcc

SEQ ID NO: 42200 - DNA, 20 bp, Homo sapiens
cccgtccgtccgtccgtccg

SEQ ID NO: 42201 - DNA, 21 bp, Homo sapiens
cccgtccgtccgtccgtccgt

SEQ ID NO: 42202 - DNA, 22 bp, Homo sapiens
cccgtccgtccgtccgtccgtc

SEQ ID NO: 42203 - DNA, 23 bp, Homo sapiens
cccgtccgtccgtccgtccgtcc

SEQ ID NO: 42204 - DNA, 16 bp, Homo sapiens
ccgtccgtccgtccgt

SEQ ID NO: 42205 - DNA, 17 bp, Homo sapiens
ccgtccgtccgtccgtc

SEQ ID NO: 42206 - DNA, 18 bp, Homo sapiens
ccgtccgtccgtccgtcc

SEQ ID NO: 42207 - DNA, 19 bp, Homo sapiens
ccgtccgtccgtccgtccg

SEQ ID NO: 42208 - DNA, 20 bp, Homo sapiens
ccgtccgtccgtccgtccgt

SEQ ID NO: 42209 - DNA, 21 bp, Homo sapiens
ccgtccgtccgtccgtccgtc

SEQ ID NO: 42210 - DNA, 22 bp, Homo sapiens
ccgtccgtccgtccgtccgtcc

SEQ ID NO: 42211 - DNA, 23 bp, Homo sapiens
ccgtccgtccgtccgtccgtcct

SEQ ID NO: 42212 - DNA, 24 bp, Homo sapiens
ccgtccgtccgtccgtccgtcctc

SEQ ID NO: 42213 - DNA, 25 bp, Homo sapiens
ccgtccgtccgtccgtccgtcctcc

SEQ ID NO: 42214 - DNA, 16 bp, Homo sapiens
cgtccgtccgtccgtc

SEQ ID NO: 42215 - DNA, 17 bp, Homo sapiens
cgtccgtccgtccgtcc

SEQ ID NO: 42216 - DNA, 18 bp, Homo sapiens
cgtccgtccgtccgtccg

SEQ ID NO: 42217 - DNA, 19 bp, Homo sapiens
cgtccgtccgtccgtccgt

SEQ ID NO: 42218 - DNA, 20 bp, Homo sapiens
cgtccgtccgtccgtccgtc

SEQ ID NO: 42219 - DNA, 21 bp, Homo sapiens
cgtccgtccgtccgtccgtcc

SEQ ID NO: 42220 - DNA, 22 bp, Homo sapiens
cgtccgtccgtccgtccgtcct

SEQ ID NO: 42221 - DNA, 23 bp, Homo sapiens
cgtccgtccgtccgtccgtcctc

SEQ ID NO: 42222 - DNA, 24 bp, Homo sapiens
cgtccgtccgtccgtccgtcctcc

SEQ ID NO: 42223 - DNA, 25 bp, Homo sapiens
cgtccgtccgtccgtccgtcctcct

SEQ ID NO: 42224 - DNA, 26 bp, Homo sapiens
cgtccgtccgtccgtccgtcctcctc

SEQ ID NO: 42225 - DNA, 27 bp, Homo sapiens
cgtccgtccgtccgtccgtcctcctcc

SEQ ID NO: 42226 - DNA, 16 bp, Homo sapiens
gtccgtccgtccgtcc

SEQ ID NO: 42227 - DNA, 17 bp, Homo sapiens
gtccgtccgtccgtccg

SEQ ID NO: 42228 - DNA, 18 bp, Homo sapiens
gtccgtccgtccgtccgt

SEQ ID NO: 42229 - DNA, 19 bp, Homo sapiens
gtccgtccgtccgtccgtc

SEQ ID NO: 42230 - DNA, 20 bp, Homo sapiens
gtccgtccgtccgtccgtcc

SEQ ID NO: 42231 - DNA, 21 bp, Homo sapiens
gtccgtccgtccgtccgtcct

SEQ ID NO: 42232 - DNA, 22 bp, Homo sapiens
gtccgtccgtccgtccgtcctc

SEQ ID NO: 42233 - DNA, 23 bp, Homo sapiens
gtccgtccgtccgtccgtcctcc

SEQ ID NO: 42234 - DNA, 24 bp, Homo sapiens
gtccgtccgtccgtccgtcctcct

SEQ ID NO: 42235 - DNA, 25 bp, Homo sapiens
gtccgtccgtccgtccgtcctcctc

SEQ ID NO: 42236 - DNA, 26 bp, Homo sapiens
gtccgtccgtccgtccgtcctcctcc

SEQ ID NO: 42237 - DNA, 27 bp, Homo sapiens
gtccgtccgtccgtccgtcctcctcct

SEQ ID NO: 42238 - DNA, 28 bp, Homo sapiens
gtccgtccgtccgtccgtcctcctcctc

SEQ ID NO: 42239 - DNA, 29 bp, Homo sapiens
gtccgtccgtccgtccgtcctcctcctcc

SEQ ID NO: 42240 - DNA, 30 bp, Homo sapiens
gtccgtccgtccgtccgtcctcctcctccc

SEQ ID NO: 42241 - DNA, 16 bp, Homo sapiens
tccgtccgtccgtccg

SEQ ID NO: 42242 - DNA, 17 bp, Homo sapiens
tccgtccgtccgtccgt

SEQ ID NO: 42243 - DNA, 18 bp, Homo sapiens
tccgtccgtccgtccgtc

SEQ ID NO: 42244 - DNA, 19 bp, Homo sapiens
tccgtccgtccgtccgtcc

SEQ ID NO: 42245 - DNA, 20 bp, Homo sapiens
tccgtccgtccgtccgtcct

SEQ ID NO: 42246 - DNA, 21 bp, Homo sapiens
tccgtccgtccgtccgtcctc

SEQ ID NO: 42247 - DNA, 22 bp, Homo sapiens
tccgtccgtccgtccgtcctcc

SEQ ID NO: 42248 - DNA, 24 bp, Homo sapiens
tccgtccgtccgtccgtcctcctc

SEQ ID NO: 42249 - DNA, 25 bp, Homo sapiens
tccgtccgtccgtccgtcctcctcc

SEQ ID NO: 42250 - DNA, 16 bp, Homo sapiens
ccgtccgtccgtccgt

SEQ ID NO: 42251 - DNA, 17 bp, Homo sapiens
ccgtccgtccgtccgtc

SEQ ID NO: 42252 - DNA, 18 bp, Homo sapiens
ccgtccgtccgtccgtcc

SEQ ID NO: 42253 - DNA, 19 bp, Homo sapiens
ccgtccgtccgtccgtcct

SEQ ID NO: 42254 - DNA, 20 bp, Homo sapiens
ccgtccgtccgtccgtcctc

SEQ ID NO: 42255 - DNA, 21 bp, Homo sapiens
ccgtccgtccgtccgtcctcc

SEQ ID NO: 42256 - DNA, 16 bp, Homo sapiens
cgtccgtccgtccgtc

SEQ ID NO: 42257 - DNA, 17 bp, Homo sapiens
cgtccgtccgtccgtcc

SEQ ID NO: 42258 - DNA, 18 bp, Homo sapiens
cgtccgtccgtccgtcct

SEQ ID NO: 42259 - DNA, 19 bp, Homo sapiens
cgtccgtccgtccgtcctc

SEQ ID NO: 42260 - DNA, 20 bp, Homo sapiens
cgtccgtccgtccgtcctcc

SEQ ID NO: 42261 - DNA, 16 bp, Homo sapiens
gtccgtccgtccgtcc

SEQ ID NO: 42262 - DNA, 17 bp, Homo sapiens
gtccgtccgtccgtcct

SEQ ID NO: 42263 - DNA, 18 bp, Homo sapiens
gtccgtccgtccgtcctc

SEQ ID NO: 42264 - DNA, 19 bp, Homo sapiens
gtccgtccgtccgtcctcc

SEQ ID NO: 42265 - DNA, 20 bp, Homo sapiens
gtccgtccgtccgtcctcct

SEQ ID NO: 42266 - DNA, 21 bp, Homo sapiens
gtccgtccgtccgtcctcctc

SEQ ID NO: 42267 - DNA, 22 bp, Homo sapiens
gtccgtccgtccgtcctcctcc

SEQ ID NO: 42268 - DNA, 23 bp, Homo sapiens
gtccgtccgtccgtcctcctcct

SEQ ID NO: 42269 - DNA, 24 bp, Homo sapiens
gtccgtccgtccgtcctcctcctc

SEQ ID NO: 42270 - DNA, 25 bp, Homo sapiens
gtccgtccgtccgtcctcctcctcc

SEQ ID NO: 42271 - DNA, 26 bp, Homo sapiens
gtccgtccgtccgtcctcctcctccc

SEQ ID NO: 42272 - DNA, 27 bp, Homo sapiens
gtccgtccgtccgtcctcctcctcccc

SEQ ID NO: 42273 - DNA, 28 bp, Homo sapiens
gtccgtccgtccgtcctcctcctccccc

SEQ ID NO: 42274 - DNA, 30 bp, Homo sapiens
gtccgtccgtccgtcctcctcctcccccgt

SEQ ID NO: 42275 - DNA, 24 bp, Homo sapiens
tccgtccgtccgtcctcctcctcc

SEQ ID NO: 42276 - DNA, 18 bp, Homo sapiens
ccgtccgtccgtcctcct

SEQ ID NO: 42277 - DNA, 17 bp, Homo sapiens
cgtccgtccgtcctcct

SEQ ID NO: 42278 - DNA, 19 bp, Homo sapiens
cgtccgtccgtcctcctcc

SEQ ID NO: 42279 - DNA, 24 bp, Homo sapiens
cgtccgtccgtcctcctcctcccc

SEQ ID NO: 42280 - DNA, 16 bp, Homo sapiens
gtccgtccgtcctcct

SEQ ID NO: 42281 - DNA, 17 bp, Homo sapiens
gtccgtccgtcctcctc

SEQ ID NO: 42282 - DNA, 18 bp, Homo sapiens
gtccgtccgtcctcctcc

SEQ ID NO: 42283 - DNA, 19 bp, Homo sapiens
gtccgtccgtcctcctcct

SEQ ID NO: 42284 - DNA, 20 bp, Homo sapiens
gtccgtccgtcctcctcctc

SEQ ID NO: 42285 - DNA, 21 bp, Homo sapiens
gtccgtccgtcctcctcctcc

SEQ ID NO: 42286 - DNA, 22 bp, Homo sapiens
gtccgtccgtcctcctcctccc

SEQ ID NO: 42287 - DNA, 23 bp, Homo sapiens
gtccgtccgtcctcctcctcccc

SEQ ID NO: 42288 - DNA, 24 bp, Homo sapiens
gtccgtccgtcctcctcctccccc

SEQ ID NO: 42289 - DNA, 25 bp, Homo sapiens
gtccgtccgtcctcctcctcccccg

SEQ ID NO: 42290 - DNA, 27 bp, Homo sapiens
gtccgtccgtcctcctcctcccccgtc

SEQ ID NO: 42291 - DNA, 30 bp, Homo sapiens
gtccgtccgtcctcctcctcccccgtctcc

SEQ ID NO: 42292 - DNA, 22 bp, Homo sapiens
tccgtccgtcctcctcctcccc

SEQ ID NO: 42293 - DNA, 19 bp, Homo sapiens
gtccgtcctcctcctcccc

SEQ ID NO: 42294 - DNA, 20 bp, Homo sapiens
gtccgtcctcctcctccccc

SEQ ID NO: 42295 - DNA, 26 bp, Homo sapiens
gtccgtcctcctcctcccccgtctcc

SEQ ID NO: 42296 - DNA, 18 bp, Homo sapiens
ccgtcctcctcctccccc

SEQ ID NO: 42297 - DNA, 21 bp, Homo sapiens
ccgtcctcctcctcccccgtc

SEQ ID NO: 42298 - DNA, 27 bp, Homo sapiens
ccgtcctcctcctcccccgtctccgcc

SEQ ID NO: 42299 - DNA, 16 bp, Homo sapiens
cgtcctcctcctcccc

SEQ ID NO: 42300 - DNA, 17 bp, Homo sapiens
cgtcctcctcctccccc

SEQ ID NO: 42301 - DNA, 18 bp, Homo sapiens
cgtcctcctcctcccccg

SEQ ID NO: 42302 - DNA, 20 bp, Homo sapiens
cgtcctcctcctcccccgtc

SEQ ID NO: 42303 - DNA, 23 bp, Homo sapiens
cgtcctcctcctcccccgtctcc

SEQ ID NO: 42304 - DNA, 25 bp, Homo sapiens
cgtcctcctcctcccccgtctccgc

SEQ ID NO: 42305 - DNA, 26 bp, Homo sapiens
cgtcctcctcctcccccgtctccgcc

SEQ ID NO: 42306 - DNA, 27 bp, Homo sapiens
cgtcctcctcctcccccgtctccgccc

SEQ ID NO: 42307 - DNA, 16 bp, Homo sapiens
gtcctcctcctccccc

SEQ ID NO: 42308 - DNA, 19 bp, Homo sapiens
gtcctcctcctcccccgtc

SEQ ID NO: 42309 - DNA, 21 bp, Homo sapiens
gtcctcctcctcccccgtctc

SEQ ID NO: 42310 - DNA, 22 bp, Homo sapiens
gtcctcctcctcccccgtctcc

SEQ ID NO: 42311 - DNA, 22 bp, Homo sapiens
cctcctcctcccccgtctccgc

SEQ ID NO: 42312 - DNA, 23 bp, Homo sapiens
cctcctcctcccccgtctccgcc

SEQ ID NO: 42313 - DNA, 19 bp, Homo sapiens
ctcctcctcccccgtctcc

SEQ ID NO: 42314 - DNA, 21 bp, Homo sapiens
ctcctcctcccccgtctccgc

SEQ ID NO: 42315 - DNA, 22 bp, Homo sapiens
ctcctcctcccccgtctccgcc

SEQ ID NO: 42316 - DNA, 23 bp, Homo sapiens
ctcctcctcccccgtctccgccc

SEQ ID NO: 42317 - DNA, 20 bp, Homo sapiens
tcctcctcccccgtctccgc

SEQ ID NO: 42318 - DNA, 21 bp, Homo sapiens
tcctcctcccccgtctccgcc

SEQ ID NO: 42319 - DNA, 22 bp, Homo sapiens
tcctcctcccccgtctccgccc

SEQ ID NO: 42320 - DNA, 23 bp, Homo sapiens
tcctcctcccccgtctccgcccc

SEQ ID NO: 42321 - DNA, 28 bp, Homo sapiens
tcctcctcccccgtctccgccccccggc

SEQ ID NO: 42322 - DNA, 29 bp, Homo sapiens
tcctcctcccccgtctccgccccccggcc

SEQ ID NO: 42323 - DNA, 30 bp, Homo sapiens
tcctcctcccccgtctccgccccccggccc

SEQ ID NO: 42324 - DNA, 17 bp, Homo sapiens
cctcctcccccgtctcc

SEQ ID NO: 42325 - DNA, 19 bp, Homo sapiens
cctcctcccccgtctccgc

SEQ ID NO: 42326 - DNA, 20 bp, Homo sapiens
cctcctcccccgtctccgcc

SEQ ID NO: 42327 - DNA, 21 bp, Homo sapiens
cctcctcccccgtctccgccc

SEQ ID NO: 42328 - DNA, 22 bp, Homo sapiens
cctcctcccccgtctccgcccc

SEQ ID NO: 42329 - DNA, 26 bp, Homo sapiens
cctcctcccccgtctccgccccccgg

SEQ ID NO: 42330 - DNA, 27 bp, Homo sapiens
cctcctcccccgtctccgccccccggc

SEQ ID NO: 42331 - DNA, 28 bp, Homo sapiens
cctcctcccccgtctccgccccccggcc

SEQ ID NO: 42332 - DNA, 29 bp, Homo sapiens
cctcctcccccgtctccgccccccggccc

SEQ ID NO: 42333 - DNA, 30 bp, Homo sapiens
cctcctcccccgtctccgccccccggcccc

SEQ ID NO: 42334 - DNA, 16 bp, Homo sapiens
ctcctcccccgtctcc

SEQ ID NO: 42335 - DNA, 18 bp, Homo sapiens
ctcctcccccgtctccgc

SEQ ID NO: 42336 - DNA, 19 bp, Homo sapiens
ctcctcccccgtctccgcc

SEQ ID NO: 42337 - DNA, 20 bp, Homo sapiens
ctcctcccccgtctccgccc

SEQ ID NO: 42338 - DNA, 21 bp, Homo sapiens
ctcctcccccgtctccgcccc

SEQ ID NO: 42339 - DNA, 25 bp, Homo sapiens
ctcctcccccgtctccgccccccgg

SEQ ID NO: 42340 - DNA, 26 bp, Homo sapiens
ctcctcccccgtctccgccccccggc

SEQ ID NO: 42341 - DNA, 27 bp, Homo sapiens
ctcctcccccgtctccgccccccggcc

SEQ ID NO: 42342 - DNA, 28 bp, Homo sapiens
ctcctcccccgtctccgccccccggccc

SEQ ID NO: 42343 - DNA, 30 bp, Homo sapiens
ctcctcccccgtctccgccccccggccccg

SEQ ID NO: 42344 - DNA, 17 bp, Homo sapiens
tcctcccccgtctccgc

SEQ ID NO: 42345 - DNA, 18 bp, Homo sapiens
tcctcccccgtctccgcc

SEQ ID NO: 42346 - DNA, 19 bp, Homo sapiens
tcctcccccgtctccgccc

SEQ ID NO: 42347 - DNA, 20 bp, Homo sapiens
tcctcccccgtctccgcccc

SEQ ID NO: 42348 - DNA, 22 bp, Homo sapiens
tcctcccccgtctccgcccccc

SEQ ID NO: 42349 - DNA, 24 bp, Homo sapiens
tcctcccccgtctccgccccccgg

SEQ ID NO: 42350 - DNA, 25 bp, Homo sapiens
tcctcccccgtctccgccccccggc

SEQ ID NO: 42351 - DNA, 26 bp, Homo sapiens
tcctcccccgtctccgccccccggcc

SEQ ID NO: 42352 - DNA, 27 bp, Homo sapiens
tcctcccccgtctccgccccccggccc

SEQ ID NO: 42353 - DNA, 30 bp, Homo sapiens
tcctcccccgtctccgccccccggccccgc

SEQ ID NO: 42354 - DNA, 16 bp, Homo sapiens
cctcccccgtctccgc

SEQ ID NO: 42355 - DNA, 17 bp, Homo sapiens
cctcccccgtctccgcc

SEQ ID NO: 42356 - DNA, 18 bp, Homo sapiens
cctcccccgtctccgccc

SEQ ID NO: 42357 - DNA, 19 bp, Homo sapiens
cctcccccgtctccgcccc

SEQ ID NO: 42358 - DNA, 20 bp, Homo sapiens
cctcccccgtctccgccccc

SEQ ID NO: 42359 - DNA, 21 bp, Homo sapiens
cctcccccgtctccgcccccc

SEQ ID NO: 42360 - DNA, 22 bp, Homo sapiens
cctcccccgtctccgccccccg

SEQ ID NO: 42361 - DNA, 23 bp, Homo sapiens
cctcccccgtctccgccccccgg

SEQ ID NO: 42362 - DNA, 24 bp, Homo sapiens
cctcccccgtctccgccccccggc

SEQ ID NO: 42363 - DNA, 25 bp, Homo sapiens
cctcccccgtctccgccccccggcc

SEQ ID NO: 42364 - DNA, 26 bp, Homo sapiens
cctcccccgtctccgccccccggccc

SEQ ID NO: 42365 - DNA, 27 bp, Homo sapiens
cctcccccgtctccgccccccggcccc

SEQ ID NO: 42366 - DNA, 28 bp, Homo sapiens
cctcccccgtctccgccccccggccccg

SEQ ID NO: 42367 - DNA, 29 bp, Homo sapiens
cctcccccgtctccgccccccggccccgc

SEQ ID NO: 42368 - DNA, 30 bp, Homo sapiens; identical to SEQ ID NO: 19541

SEQ ID NO: 42369 - DNA, 16 bp, Homo sapiens
ctcccccgtctccgcc

SEQ ID NO: 42370 - DNA, 17 bp, Homo sapiens
ctcccccgtctccgccc

SEQ ID NO: 42371 - DNA, 18 bp, Homo sapiens
ctcccccgtctccgcccc

SEQ ID NO: 42372 - DNA, 19 bp, Homo sapiens
ctcccccgtctccgccccc

SEQ ID NO: 42373 - DNA, 20 bp, Homo sapiens
ctcccccgtctccgcccccc

SEQ ID NO: 42374 - DNA, 21 bp, Homo sapiens
ctcccccgtctccgccccccg

SEQ ID NO: 42375 - DNA, 22 bp, Homo sapiens
ctcccccgtctccgccccccgg

SEQ ID NO: 42376 - DNA, 23 bp, Homo sapiens
ctcccccgtctccgccccccggc

SEQ ID NO: 42377 - DNA, 24 bp, Homo sapiens
ctcccccgtctccgccccccggcc

SEQ ID NO: 42378 - DNA, 25 bp, Homo sapiens
ctcccccgtctccgccccccggccc

SEQ ID NO: 42379 - DNA, 26 bp, Homo sapiens
ctcccccgtctccgccccccggcccc

SEQ ID NO: 42380 - DNA, 27 bp, Homo sapiens
ctcccccgtctccgccccccggccccg

SEQ ID NO: 42381 - DNA, 28 bp, Homo sapiens
ctcccccgtctccgccccccggccccgc

SEQ ID NO: 42382 - DNA, 29 bp, Homo sapiens
ctcccccgtctccgccccccggccccgcg

SEQ ID NO: 42383 - DNA, 30 bp, Homo sapiens
ctcccccgtctccgccccccggccccgcgt

SEQ ID NO: 42384 - DNA, 17 bp, Homo sapiens
tcccccgtctccgcccc

SEQ ID NO: 42385 - DNA, 21 bp, Homo sapiens
tcccccgtctccgccccccgg

SEQ ID NO: 42386 - DNA, 22 bp, Homo sapiens
tcccccgtctccgccccccggc

SEQ ID NO: 42387 - DNA, 23 bp, Homo sapiens
tcccccgtctccgccccccggcc

SEQ ID NO: 42388 - DNA, 24 bp, Homo sapiens
tcccccgtctccgccccccggccc

SEQ ID NO: 42389 - DNA, 28 bp, Homo sapiens
tcccccgtctccgccccccggccccgcg

SEQ ID NO: 42390 - DNA, 30 bp, Homo sapiens; identical to SEQ ID NO: 19545

SEQ ID NO: 42391 - DNA, 19 bp, Homo sapiens
cccccgtctccgccccccg

SEQ ID NO: 42392 - DNA, 20 bp, Homo sapiens
cccccgtctccgccccccgg

SEQ ID NO: 42393 - DNA, 21 bp, Homo sapiens
cccccgtctccgccccccggc

SEQ ID NO: 42394 - DNA, 22 bp, Homo sapiens
cccccgtctccgccccccggcc

SEQ ID NO: 42395 - DNA, 23 bp, Homo sapiens
cccccgtctccgccccccggccc

SEQ ID NO: 42396 - DNA, 24 bp, Homo sapiens
cccccgtctccgccccccggcccc

SEQ ID NO: 42397 - DNA, 25 bp, Homo sapiens
cccccgtctccgccccccggccccg

SEQ ID NO: 42398 - DNA, 26 bp, Homo sapiens
cccccgtctccgccccccggccccgc

SEQ ID NO: 42399 - DNA, 27 bp, Homo sapiens
cccccgtctccgccccccggccccgcg

SEQ ID NO: 42400 - DNA, 28 bp, Homo sapiens
cccccgtctccgccccccggccccgcgt

SEQ ID NO: 42401 - DNA, 29 bp, Homo sapiens
cccccgtctccgccccccggccccgcgtc

SEQ ID NO: 42402 - DNA, 30 bp, Homo sapiens
cccccgtctccgccccccggccccgcgtcc

SEQ ID NO: 42403 - DNA, 19 bp, Homo sapiens
ccccgtctccgccccccgg

SEQ ID NO: 42404 - DNA, 20 bp, Homo sapiens
ccccgtctccgccccccggc

SEQ ID NO: 42405 - DNA, 21 bp, Homo sapiens
ccccgtctccgccccccggcc

SEQ ID NO: 42406 - DNA, 22 bp, Homo sapiens
ccccgtctccgccccccggccc

SEQ ID NO: 42407 - DNA, 23 bp, Homo sapiens
ccccgtctccgccccccggcccc

SEQ ID NO: 42408 - DNA, 25 bp, Homo sapiens
ccccgtctccgccccccggccccgc

SEQ ID NO: 42409 - DNA, 26 bp, Homo sapiens
ccccgtctccgccccccggccccgcg

SEQ ID NO: 42410 - DNA, 28 bp, Homo sapiens
ccccgtctccgccccccggccccgcgtc

SEQ ID NO: 42411 - DNA, 30 bp, Homo sapiens
ccccgtctccgccccccggccccgcgtcct

SEQ ID NO: 42412 - DNA, 17 bp, Homo sapiens
cccgtctccgccccccg

SEQ ID NO: 42413 - DNA, 18 bp, Homo sapiens
cccgtctccgccccccgg

SEQ ID NO: 42414 - DNA, 19 bp, Homo sapiens
cccgtctccgccccccggc

SEQ ID NO: 42415 - DNA, 20 bp, Homo sapiens
cccgtctccgccccccggcc

SEQ ID NO: 42416 - DNA, 21 bp, Homo sapiens
cccgtctccgccccccggccc

SEQ ID NO: 42417 - DNA, 22 bp, Homo sapiens
cccgtctccgccccccggcccc

SEQ ID NO: 42418 - DNA, 23 bp, Homo sapiens
cccgtctccgccccccggccccg

SEQ ID NO: 42419 - DNA, 24 bp, Homo sapiens
cccgtctccgccccccggccccgc

SEQ ID NO: 42420 - DNA, 25 bp, Homo sapiens
cccgtctccgccccccggccccgcg

SEQ ID NO: 42421 - DNA, 26 bp, Homo sapiens
cccgtctccgccccccggccccgcgt

SEQ ID NO: 42422 - DNA, 27 bp, Homo sapiens
cccgtctccgccccccggccccgcgtc

SEQ ID NO: 42423 - DNA, 28 bp, Homo sapiens
cccgtctccgccccccggccccgcgtcc

SEQ ID NO: 42424 - DNA, 29 bp, Homo sapiens
cccgtctccgccccccggccccgcgtcct

SEQ ID NO: 42425 - DNA, 30 bp, Homo sapiens
cccgtctccgccccccggccccgcgtcctc

SEQ ID NO: 42426 - DNA, 16 bp, Homo sapiens
ccgtctccgccccccg

SEQ ID NO: 42427 - DNA, 17 bp, Homo sapiens
ccgtctccgccccccgg

SEQ ID NO: 42428 - DNA, 18 bp, Homo sapiens
ccgtctccgccccccggc

SEQ ID NO: 42429 - DNA, 19 bp, Homo sapiens
ccgtctccgccccccggcc

SEQ ID NO: 42430 - DNA, 20 bp, Homo sapiens
ccgtctccgccccccggccc

SEQ ID NO: 42431 - DNA, 21 bp, Homo sapiens
ccgtctccgccccccggcccc

SEQ ID NO: 42432 - DNA, 22 bp, Homo sapiens
ccgtctccgccccccggccccg

SEQ ID NO: 42433 - DNA, 23 bp, Homo sapiens
ccgtctccgccccccggccccgc

SEQ ID NO: 42434 - DNA, 24 bp, Homo sapiens
ccgtctccgccccccggccccgcg

SEQ ID NO: 42435 - DNA, 25 bp, Homo sapiens
ccgtctccgccccccggccccgcgt

SEQ ID NO: 42436 - DNA, 26 bp, Homo sapiens
ccgtctccgccccccggccccgcgtc

SEQ ID NO: 42437 - DNA, 27 bp, Homo sapiens
ccgtctccgccccccggccccgcgtcc

SEQ ID NO: 42438 - DNA, 28 bp, Homo sapiens
ccgtctccgccccccggccccgcgtcct

SEQ ID NO: 42439 - DNA, 29 bp, Homo sapiens
ccgtctccgccccccggccccgcgtcctc

SEQ ID NO: 42440 - DNA, 30 bp, Homo sapiens; identical to SEQ ID NO: 4221

SEQ ID NO: 42441 - DNA, 16 bp, Homo sapiens
cgtctccgccccccgg

SEQ ID NO: 42442 - DNA, 17 bp, Homo sapiens
cgtctccgccccccggc

SEQ ID NO: 42443 - DNA, 18 bp, Homo sapiens
cgtctccgccccccggcc

SEQ ID NO: 42444 - DNA, 19 bp, Homo sapiens
cgtctccgccccccggccc

SEQ ID NO: 42445 - DNA, 20 bp, Homo sapiens
cgtctccgccccccggcccc

SEQ ID NO: 42446 - DNA, 21 bp, Homo sapiens
cgtctccgccccccggccccg

SEQ ID NO: 42447 - DNA, 22 bp, Homo sapiens
cgtctccgccccccggccccgc

SEQ ID NO: 42448 - DNA, 23 bp, Homo sapiens
cgtctccgccccccggccccgcg

SEQ ID NO: 42449 - DNA, 24 bp, Homo sapiens
cgtctccgccccccggccccgcgt

SEQ ID NO: 42450 - DNA, 25 bp, Homo sapiens
cgtctccgccccccggccccgcgtc

SEQ ID NO: 42451 - DNA, 26 bp, Homo sapiens
cgtctccgccccccggccccgcgtcc

SEQ ID NO: 42452 - DNA, 27 bp, Homo sapiens
cgtctccgccccccggccccgcgtcct

SEQ ID NO: 42453 - DNA, 28 bp, Homo sapiens
cgtctccgccccccggccccgcgtcctc

SEQ ID NO: 42454 - DNA, 29 bp, Homo sapiens
cgtctccgccccccggccccgcgtcctcc

SEQ ID NO: 42455 - DNA, 30 bp, Homo sapiens; identical to SEQ ID NO: 19567

SEQ ID NO: 42456 - DNA, 16 bp, Homo sapiens
gtctccgccccccggc

SEQ ID NO: 42457 - DNA, 17 bp, Homo sapiens
gtctccgccccccggcc

SEQ ID NO: 42458 - DNA, 18 bp, Homo sapiens
gtctccgccccccggccc

SEQ ID NO: 42459 - DNA, 19 bp, Homo sapiens
gtctccgccccccggcccc

SEQ ID NO: 42460 - DNA, 20 bp, Homo sapiens
gtctccgccccccggccccg

SEQ ID NO: 42461 - DNA, 21 bp, Homo sapiens
gtctccgccccccggccccgc

SEQ ID NO: 42462 - DNA, 22 bp, Homo sapiens
gtctccgccccccggccccgcg

SEQ ID NO: 42463 - DNA, 24 bp, Homo sapiens
gtctccgccccccggccccgcgtc

SEQ ID NO: 42464 - DNA, 25 bp, Homo sapiens
gtctccgccccccggccccgcgtcc

SEQ ID NO: 42465 - DNA, 17 bp, Homo sapiens
tctccgccccccggccc

SEQ ID NO: 42466 - DNA, 20 bp, Homo sapiens
tctccgccccccggccccgc

SEQ ID NO: 42467 - DNA, 21 bp, Homo sapiens
tctccgccccccggccccgcg

SEQ ID NO: 42468 - DNA, 23 bp, Homo sapiens
tctccgccccccggccccgcgtc

SEQ ID NO: 42469 - DNA, 20 bp, Homo sapiens
ctccgccccccggccccgcg

SEQ ID NO: 42470 - DNA, 22 bp, Homo sapiens
ctccgccccccggccccgcgtc

SEQ ID NO: 42471 - DNA, 23 bp, Homo sapiens
ctccgccccccggccccgcgtcc

SEQ ID NO: 42472 - DNA, 25 bp, Homo sapiens
ctccgccccccggccccgcgtcctc

SEQ ID NO: 42473 - DNA, 26 bp, Homo sapiens
ctccgccccccggccccgcgtcctcc

SEQ ID NO: 42474 - DNA, 18 bp, Homo sapiens
tccgccccccggccccgc

SEQ ID NO: 42475 - DNA, 19 bp, Homo sapiens
tccgccccccggccccgcg

SEQ ID NO: 42476 - DNA, 20 bp, Homo sapiens
tccgccccccggccccgcgt

SEQ ID NO: 42477 - DNA, 21 bp, Homo sapiens
tccgccccccggccccgcgtc

SEQ ID NO: 42478 - DNA, 22 bp, Homo sapiens
tccgccccccggccccgcgtcc

SEQ ID NO: 42479 - DNA, 23 bp, Homo sapiens
tccgccccccggccccgcgtcct

SEQ ID NO: 42480 - DNA, 24 bp, Homo sapiens
tccgccccccggccccgcgtcctc

SEQ ID NO: 42481 - DNA, 25 bp, Homo sapiens
tccgccccccggccccgcgtcctcc

SEQ ID NO: 42482 - DNA, 26 bp, Homo sapiens
tccgccccccggccccgcgtcctccc

SEQ ID NO: 42483 - DNA, 17 bp, Homo sapiens
ccgccccccggccccgc

SEQ ID NO: 42484 - DNA, 18 bp, Homo sapiens
ccgccccccggccccgcg

SEQ ID NO: 42485 - DNA, 19 bp, Homo sapiens
ccgccccccggccccgcgt

SEQ ID NO: 42486 - DNA, 20 bp, Homo sapiens
ccgccccccggccccgcgtc

SEQ ID NO: 42487 - DNA, 21 bp, Homo sapiens
ccgccccccggccccgcgtcc

SEQ ID NO: 42488 - DNA, 22 bp, Homo sapiens
ccgccccccggccccgcgtcct

SEQ ID NO: 42489 - DNA, 23 bp, Homo sapiens
ccgccccccggccccgcgtcctc

SEQ ID NO: 42490 - DNA, 24 bp, Homo sapiens
ccgccccccggccccgcgtcctcc

SEQ ID NO: 42491 - DNA, 25 bp, Homo sapiens
ccgccccccggccccgcgtcctccc

SEQ ID NO: 42492 - DNA, 26 bp, Homo sapiens
ccgccccccggccccgcgtcctccct

SEQ ID NO: 42493 - DNA, 16 bp, Homo sapiens
cgccccccggccccgc

SEQ ID NO: 42494 - DNA, 17 bp, Homo sapiens
cgccccccggccccgcg

SEQ ID NO: 42495 - DNA, 18 bp, Homo sapiens
cgccccccggccccgcgt

SEQ ID NO: 42496 - DNA, 19 bp, Homo sapiens
cgccccccggccccgcgtc

SEQ ID NO: 42497 - DNA, 20 bp, Homo sapiens
cgccccccggccccgcgtcc

SEQ ID NO: 42498 - DNA, 21 bp, Homo sapiens
cgccccccggccccgcgtcct

SEQ ID NO: 42499 - DNA, 22 bp, Homo sapiens
cgccccccggccccgcgtcctc

SEQ ID NO: 42500 - DNA, 23 bp, Homo sapiens
cgccccccggccccgcgtcctcc

SEQ ID NO: 42501 - DNA, 24 bp, Homo sapiens
cgccccccggccccgcgtcctccc

SEQ ID NO: 42502 - DNA, 25 bp, Homo sapiens
cgccccccggccccgcgtcctccct

SEQ ID NO: 42503 - DNA, 16 bp, Homo sapiens
gccccccggccccgcg

SEQ ID NO: 42504 - DNA, 18 bp, Homo sapiens
gccccccggccccgcgtc

SEQ ID NO: 42505 - DNA, 19 bp, Homo sapiens
gccccccggccccgcgtcc

SEQ ID NO: 42506 - DNA, 20 bp, Homo sapiens
gccccccggccccgcgtcct

SEQ ID NO: 42507 - DNA, 21 bp, Homo sapiens
gccccccggccccgcgtcctc

SEQ ID NO: 42508 - DNA, 22 bp, Homo sapiens
gccccccggccccgcgtcctcc

SEQ ID NO: 42509 - DNA, 23 bp, Homo sapiens
gccccccggccccgcgtcctccc

SEQ ID NO: 42510 - DNA, 24 bp, Homo sapiens
gccccccggccccgcgtcctccct

SEQ ID NO: 42511 - DNA, 17 bp, Homo sapiens
ccccccggccccgcgtc

SEQ ID NO: 42512 - DNA, 18 bp, Homo sapiens
ccccccggccccgcgtcc

SEQ ID NO: 42513 - DNA, 19 bp, Homo sapiens
ccccccggccccgcgtcct

SEQ ID NO: 42514 - DNA, 20 bp, Homo sapiens
ccccccggccccgcgtcctc

SEQ ID NO: 42515 - DNA, 21 bp, Homo sapiens
ccccccggccccgcgtcctcc

SEQ ID NO: 42516 - DNA, 22 bp, Homo sapiens
ccccccggccccgcgtcctccc

SEQ ID NO: 42517 - DNA, 23 bp, Homo sapiens
ccccccggccccgcgtcctccct

SEQ ID NO: 42518 - DNA, 16 bp, Homo sapiens
cccccggccccgcgtc

SEQ ID NO: 42519 - DNA, 17 bp, Homo sapiens
cccccggccccgcgtcc

SEQ ID NO: 42520 - DNA, 18 bp, Homo sapiens
cccccggccccgcgtcct

SEQ ID NO: 42521 - DNA, 19 bp, Homo sapiens
cccccggccccgcgtcctc

SEQ ID NO: 42522 - DNA, 20 bp, Homo sapiens
cccccggccccgcgtcctcc

SEQ ID NO: 42523 - DNA, 21 bp, Homo sapiens
cccccggccccgcgtcctccc

SEQ ID NO: 42524 - DNA, 17 bp, Homo sapiens
ccccggccccgcgtcct

SEQ ID NO: 42525 - DNA, 18 bp, Homo sapiens
ccccggccccgcgtcctc

SEQ ID NO: 42526 - DNA, 19 bp, Homo sapiens
ccccggccccgcgtcctcc

SEQ ID NO: 42527 - DNA, 20 bp, Homo sapiens
ccccggccccgcgtcctccc

SEQ ID NO: 42528 - DNA, 21 bp, Homo sapiens
ccccggccccgcgtcctccct

SEQ ID NO: 42529 - DNA, 22 bp, Homo sapiens
ccccggccccgcgtcctccctc

SEQ ID NO: 42530 - DNA, 17 bp, Homo sapiens
cccggccccgcgtcctc

SEQ ID NO: 42531 - DNA, 18 bp, Homo sapiens
cccggccccgcgtcctcc

SEQ ID NO: 42532 - DNA, 19 bp, Homo sapiens
cccggccccgcgtcctccc

SEQ ID NO: 42533 - DNA, 20 bp, Homo sapiens
cccggccccgcgtcctccct

SEQ ID NO: 42534 - DNA, 17 bp, Homo sapiens
ccggccccgcgtcctcc

SEQ ID NO: 42535 - DNA, 18 bp, Homo sapiens
ccggccccgcgtcctccc

SEQ ID NO: 42536 - DNA, 19 bp, Homo sapiens
ccggccccgcgtcctccct

SEQ ID NO: 42537 - DNA, 20 bp, Homo sapiens
ccggccccgcgtcctccctc

SEQ ID NO: 42538 - DNA, 23 bp, Homo sapiens
ccggccccgcgtcctccctcggg

SEQ ID NO: 42539 - DNA, 16 bp, Homo sapiens
cggccccgcgtcctcc

SEQ ID NO: 42540 - DNA, 17 bp, Homo sapiens
cggccccgcgtcctccc

SEQ ID NO: 42541 - DNA, 18 bp, Homo sapiens
cggccccgcgtcctccct

SEQ ID NO: 42542 - DNA, 22 bp, Homo sapiens
cggccccgcgtcctccctcggg

SEQ ID NO: 42543 - DNA, 16 bp, Homo sapiens
ggccccgcgtcctccc

SEQ ID NO: 42544 - DNA, 21 bp, Homo sapiens
ggccccgcgtcctccctcggg

SEQ ID NO: 42545 - DNA, 20 bp, Homo sapiens
gccccgcgtcctccctcggg

SEQ ID NO: 42546 - DNA, 21 bp, Homo sapiens
gccccgcgtcctccctcggga

SEQ ID NO: 42547 - DNA, 20 bp, Homo sapiens
gcgtcctccctcgggagggc

SEQ ID NO: 42548 - DNA, 18 bp, Homo sapiens
ctccctcgggagggcgcg

SEQ ID NO: 42549 - DNA, 19 bp, Homo sapiens
ctccctcgggagggcgcgc

SEQ ID NO: 42550 - DNA, 20 bp, Homo sapiens
ctccctcgggagggcgcgcg

SEQ ID NO: 42551 - DNA, 21 bp, Homo sapiens
ctccctcgggagggcgcgcgg

SEQ ID NO: 42552 - DNA, 22 bp, Homo sapiens
ctccctcgggagggcgcgcggg

SEQ ID NO: 42553 - DNA, 24 bp, Homo sapiens
ctccctcgggagggcgcgcgggtc

SEQ ID NO: 42554 - DNA, 25 bp, Homo sapiens
ctccctcgggagggcgcgcgggtcg

SEQ ID NO: 42555 - DNA, 26 bp, Homo sapiens
ctccctcgggagggcgcgcgggtcgg

SEQ ID NO: 42556 - DNA, 28 bp, Homo sapiens
ctccctcgggagggcgcgcgggtcgggg

SEQ ID NO: 42557 - DNA, 29 bp, Homo sapiens
ctccctcgggagggcgcgcgggtcggggc

SEQ ID NO: 42558 - DNA, 30 bp, Homo sapiens; identical to SEQ ID NO: 19625

SEQ ID NO: 42559 - DNA, 18 bp, Homo sapiens
tccctcgggagggcgcgc

SEQ ID NO: 42560 - DNA, 19 bp, Homo sapiens
tccctcgggagggcgcgcg

SEQ ID NO: 42561 - DNA, 20 bp, Homo sapiens
tccctcgggagggcgcgcgg

SEQ ID NO: 42562 - DNA, 21 bp, Homo sapiens
tccctcgggagggcgcgcggg

SEQ ID NO: 42563 - DNA, 23 bp, Homo sapiens
tccctcgggagggcgcgcgggtc

SEQ ID NO: 42564 - DNA, 25 bp, Homo sapiens
tccctcgggagggcgcgcgggtcgg

SEQ ID NO: 42565 - DNA, 28 bp, Homo sapiens
tccctcgggagggcgcgcgggtcggggc

SEQ ID NO: 42566 - DNA, 29 bp, Homo sapiens
tccctcgggagggcgcgcgggtcggggcg

SEQ ID NO: 42567 - DNA, 30 bp, Homo sapiens
tccctcgggagggcgcgcgggtcggggcgg

SEQ ID NO: 42568 - DNA, 18 bp, Homo sapiens
ccctcgggagggcgcgcg

SEQ ID NO: 42569 - DNA, 19 bp, Homo sapiens
ccctcgggagggcgcgcgg

SEQ ID NO: 42570 - DNA, 20 bp, Homo sapiens
ccctcgggagggcgcgcggg

SEQ ID NO: 42571 - DNA, 22 bp, Homo sapiens
ccctcgggagggcgcgcgggtc

SEQ ID NO: 42572 - DNA, 24 bp, Homo sapiens
ccctcgggagggcgcgcgggtcgg

SEQ ID NO: 42573 - DNA, 26 bp, Homo sapiens
ccctcgggagggcgcgcgggtcgggg

SEQ ID NO: 42574 - DNA, 27 bp, Homo sapiens
ccctcgggagggcgcgcgggtcggggc

SEQ ID NO: 42575 - DNA, 28 bp, Homo sapiens
ccctcgggagggcgcgcgggtcggggcg

SEQ ID NO: 42576 - DNA, 18 bp, Homo sapiens
cctcgggagggcgcgcgg

SEQ ID NO: 42577 - DNA, 19 bp, Homo sapiens
cctcgggagggcgcgcggg

SEQ ID NO: 42578 - DNA, 21 bp, Homo sapiens
cctcgggagggcgcgcgggtc

SEQ ID NO: 42579 - DNA, 22 bp, Homo sapiens
cctcgggagggcgcgcgggtcg

SEQ ID NO: 42580 - DNA, 23 bp, Homo sapiens
cctcgggagggcgcgcgggtcgg

SEQ ID NO: 42581 - DNA, 25 bp, Homo sapiens
cctcgggagggcgcgcgggtcgggg

SEQ ID NO: 42582 - DNA, 26 bp, Homo sapiens
cctcgggagggcgcgcgggtcggggc

SEQ ID NO: 42583 - DNA, 27 bp, Homo sapiens
cctcgggagggcgcgcgggtcggggcg

SEQ ID NO: 42584 - DNA, 28 bp, Homo sapiens
cctcgggagggcgcgcgggtcggggcgg

SEQ ID NO: 42585 - DNA, 16 bp, Homo sapiens
ctcgggagggcgcgcg

SEQ ID NO: 42586 - DNA, 17 bp, Homo sapiens
ctcgggagggcgcgcgg

SEQ ID NO: 42587 - DNA, 18 bp, Homo sapiens
ctcgggagggcgcgcggg

SEQ ID NO: 42588 - DNA, 20 bp, Homo sapiens
ctcgggagggcgcgcgggtc

SEQ ID NO: 42589 - DNA, 22 bp, Homo sapiens
ctcgggagggcgcgcgggtcgg

SEQ ID NO: 42590 - DNA, 25 bp, Homo sapiens
ctcgggagggcgcgcgggtcggggc

SEQ ID NO: 42591 - DNA, 26 bp, Homo sapiens
ctcgggagggcgcgcgggtcggggcg

SEQ ID NO: 42592 - DNA, 27 bp, Homo sapiens
ctcgggagggcgcgcgggtcggggcgg

SEQ ID NO: 42593 - DNA, 16 bp, Homo sapiens
tcgggagggcgcgcgg

SEQ ID NO: 42594 - DNA, 17 bp, Homo sapiens
tcgggagggcgcgcggg

SEQ ID NO: 42595 - DNA, 18 bp, Homo sapiens
tcgggagggcgcgcgggt

SEQ ID NO: 42596 - DNA, 21 bp, Homo sapiens
tcgggagggcgcgcgggtcgg

SEQ ID NO: 42597 - DNA, 25 bp, Homo sapiens
tcgggagggcgcgcgggtcggggcg

SEQ ID NO: 42598 - DNA, 16 bp, Homo sapiens
cgggagggcgcgcggg

SEQ ID NO: 42599 - DNA, 20 bp, Homo sapiens
cgggagggcgcgcgggtcgg

SEQ ID NO: 42600 - DNA, 21 bp, Homo sapiens
cgggagggcgcgcgggtcggg

SEQ ID NO: 42601 - DNA, 22 bp, Homo sapiens
cgggagggcgcgcgggtcgggg

SEQ ID NO: 42602 - DNA, 23 bp, Homo sapiens
cgggagggcgcgcgggtcggggc

SEQ ID NO: 42603 - DNA, 24 bp, Homo sapiens
cgggagggcgcgcgggtcggggcg

SEQ ID NO: 42604 - DNA, 25 bp, Homo sapiens
cgggagggcgcgcgggtcggggcgg

SEQ ID NO: 42605 - DNA, 26 bp, Homo sapiens
cgggagggcgcgcgggtcggggcggc

SEQ ID NO: 42606 - DNA, 28 bp, Homo sapiens
cgggagggcgcgcgggtcggggcggcgg

SEQ ID NO: 42607 - DNA, 29 bp, Homo sapiens
cgggagggcgcgcgggtcggggcggcggc

SEQ ID NO: 42608 - DNA, 19 bp, Homo sapiens
gggagggcgcgcgggtcgg

SEQ ID NO: 42609 - DNA, 20 bp, Homo sapiens
gggagggcgcgcgggtcggg

SEQ ID NO: 42610 - DNA, 21 bp, Homo sapiens
gggagggcgcgcgggtcgggg

SEQ ID NO: 42611 - DNA, 22 bp, Homo sapiens
gggagggcgcgcgggtcggggc

SEQ ID NO: 42612 - DNA, 23 bp, Homo sapiens
gggagggcgcgcgggtcggggcg

SEQ ID NO: 42613 - DNA, 24 bp, Homo sapiens
gggagggcgcgcgggtcggggcgg

SEQ ID NO: 42614 - DNA, 25 bp, Homo sapiens
gggagggcgcgcgggtcggggcggc

SEQ ID NO: 42615 - DNA, 26 bp, Homo sapiens
gggagggcgcgcgggtcggggcggcg

SEQ ID NO: 42616 - DNA, 27 bp, Homo sapiens
gggagggcgcgcgggtcggggcggcgg

SEQ ID NO: 42617 - DNA, 28 bp, Homo sapiens
gggagggcgcgcgggtcggggcggcggc

SEQ ID NO: 42618 - DNA, 29 bp, Homo sapiens
gggagggcgcgcgggtcggggcggcggcg

SEQ ID NO: 42619 - DNA, 30 bp, Homo sapiens
gggagggcgcgcgggtcggggcggcggcgg

SEQ ID NO: 42620 - DNA, 19 bp, Homo sapiens
ggagggcgcgcgggtcggg

SEQ ID NO: 42621 - DNA, 20 bp, Homo sapiens
ggagggcgcgcgggtcgggg

SEQ ID NO: 42622 - DNA, 21 bp, Homo sapiens
ggagggcgcgcgggtcggggc

SEQ ID NO: 42623 - DNA, 22 bp, Homo sapiens
ggagggcgcgcgggtcggggcg

SEQ ID NO: 42624 - DNA, 23 bp, Homo sapiens
ggagggcgcgcgggtcggggcgg

SEQ ID NO: 42625 - DNA, 24 bp, Homo sapiens
ggagggcgcgcgggtcggggcggc

SEQ ID NO: 42626 - DNA, 25 bp, Homo sapiens
ggagggcgcgcgggtcggggcggcg

SEQ ID NO: 42627 - DNA, 26 bp, Homo sapiens
ggagggcgcgcgggtcggggcggcgg

SEQ ID NO: 42628 - DNA, 27 bp, Homo sapiens
ggagggcgcgcgggtcggggcggcggc

SEQ ID NO: 42629 - DNA, 28 bp, Homo sapiens
ggagggcgcgcgggtcggggcggcggcg

SEQ ID NO: 42630 - DNA, 30 bp, Homo sapiens
ggagggcgcgcgggtcggggcggcggcggc

SEQ ID NO: 42631 - DNA, 18 bp, Homo sapiens
gagggcgcgcgggtcggg

SEQ ID NO: 42632 - DNA, 19 bp, Homo sapiens
gagggcgcgcgggtcgggg

SEQ ID NO: 42633 - DNA, 20 bp, Homo sapiens
gagggcgcgcgggtcggggc

SEQ ID NO: 42634 - DNA, 21 bp, Homo sapiens
gagggcgcgcgggtcggggcg

SEQ ID NO: 42635 - DNA, 22 bp, Homo sapiens
gagggcgcgcgggtcggggcgg

SEQ ID NO: 42636 - DNA, 23 bp, Homo sapiens
gagggcgcgcgggtcggggcggc

SEQ ID NO: 42637 - DNA, 24 bp, Homo sapiens
gagggcgcgcgggtcggggcggcg

SEQ ID NO: 42638 - DNA, 25 bp, Homo sapiens
gagggcgcgcgggtcggggcggcgg

SEQ ID NO: 42639 - DNA, 26 bp, Homo sapiens
gagggcgcgcgggtcggggcggcggc

SEQ ID NO: 42640 - DNA, 27 bp, Homo sapiens
gagggcgcgcgggtcggggcggcggcg

SEQ ID NO: 42641 - DNA, 30 bp, Homo sapiens
gagggcgcgcgggtcggggcggcggcggcg

SEQ ID NO: 42642 - DNA, 16 bp, Homo sapiens
agggcgcgcgggtcgg

SEQ ID NO: 42643 - DNA, 17 bp, Homo sapiens
agggcgcgcgggtcggg

SEQ ID NO: 42644 - DNA, 18 bp, Homo sapiens
agggcgcgcgggtcgggg

SEQ ID NO: 42645 - DNA, 19 bp, Homo sapiens
agggcgcgcgggtcggggc

SEQ ID NO: 42646 - DNA, 20 bp, Homo sapiens
agggcgcgcgggtcggggcg

SEQ ID NO: 42647 - DNA, 21 bp, Homo sapiens
agggcgcgcgggtcggggcgg

SEQ ID NO: 42648 - DNA, 22 bp, Homo sapiens
agggcgcgcgggtcggggcggc

SEQ ID NO: 42649 - DNA, 23 bp, Homo sapiens
agggcgcgcgggtcggggcggcg

SEQ ID NO: 42650 - DNA, 24 bp, Homo sapiens
agggcgcgcgggtcggggcggcgg

SEQ ID NO: 42651 - DNA, 25 bp, Homo sapiens
agggcgcgcgggtcggggcggcggc

SEQ ID NO: 42652 - DNA, 26 bp, Homo sapiens
agggcgcgcgggtcggggcggcggcg

SEQ ID NO: 42653 - DNA, 28 bp, Homo sapiens
agggcgcgcgggtcggggcggcggcggc

SEQ ID NO: 42654 - DNA, 29 bp, Homo sapiens
agggcgcgcgggtcggggcggcggcggcg

SEQ ID NO: 42655 - DNA, 30 bp, Homo sapiens
agggcgcgcgggtcggggcggcggcggcgg

SEQ ID NO: 42656 - DNA, 16 bp, Homo sapiens
gggcgcgcgggtcggg

SEQ ID NO: 42657 - DNA, 17 bp, Homo sapiens
gggcgcgcgggtcgggg

SEQ ID NO: 42658 - DNA, 18 bp, Homo sapiens
gggcgcgcgggtcggggc

SEQ ID NO: 42659 - DNA, 19 bp, Homo sapiens
gggcgcgcgggtcggggcg

SEQ ID NO: 42660 - DNA, 20 bp, Homo sapiens
gggcgcgcgggtcggggcgg

SEQ ID NO: 42661 - DNA, 21 bp, Homo sapiens
gggcgcgcgggtcggggcggc

SEQ ID NO: 42662 - DNA, 22 bp, Homo sapiens
gggcgcgcgggtcggggcggcg

SEQ ID NO: 42663 - DNA, 23 bp, Homo sapiens
gggcgcgcgggtcggggcggcgg

SEQ ID NO: 42664 - DNA, 24 bp, Homo sapiens
gggcgcgcgggtcggggcggcggc

SEQ ID NO: 42665 - DNA, 25 bp, Homo sapiens
gggcgcgcgggtcggggcggcggcg

SEQ ID NO: 42666 - DNA, 27 bp, Homo sapiens
gggcgcgcgggtcggggcggcggcggc

SEQ ID NO: 42667 - DNA, 28 bp, Homo sapiens
gggcgcgcgggtcggggcggcggcggcg

SEQ ID NO: 42668 - DNA, 29 bp, Homo sapiens
gggcgcgcgggtcggggcggcggcggcgg

SEQ ID NO: 42669 - DNA, 30 bp, Homo sapiens
gggcgcgcgggtcggggcggcggcggcggc

SEQ ID NO: 42670 - DNA, 16 bp, Homo sapiens
ggcgcgcgggtcgggg

SEQ ID NO: 42671 - DNA, 17 bp, Homo sapiens
ggcgcgcgggtcggggc

SEQ ID NO: 42672 - DNA, 18 bp, Homo sapiens
ggcgcgcgggtcggggcg

SEQ ID NO: 42673 - DNA, 19 bp, Homo sapiens
ggcgcgcgggtcggggcgg

SEQ ID NO: 42674 - DNA, 20 bp, Homo sapiens
ggcgcgcgggtcggggcggc

SEQ ID NO: 42675 - DNA, 21 bp, Homo sapiens
ggcgcgcgggtcggggcggcg

SEQ ID NO: 42676 - DNA, 22 bp, Homo sapiens
ggcgcgcgggtcggggcggcgg

SEQ ID NO: 42677 - DNA, 23 bp, Homo sapiens
ggcgcgcgggtcggggcggcggc

SEQ ID NO: 42678 - DNA, 24 bp, Homo sapiens
ggcgcgcgggtcggggcggcggcg

SEQ ID NO: 42679 - DNA, 25 bp, Homo sapiens
ggcgcgcgggtcggggcggcggcgg

SEQ ID NO: 42680 - DNA, 26 bp, Homo sapiens
ggcgcgcgggtcggggcggcggcggc

SEQ ID NO: 42681 - DNA, 27 bp, Homo sapiens
ggcgcgcgggtcggggcggcggcggcg

SEQ ID NO: 42682 - DNA, 28 bp, Homo sapiens
ggcgcgcgggtcggggcggcggcggcgg

SEQ ID NO: 42683 - DNA, 29 bp, Homo sapiens
ggcgcgcgggtcggggcggcggcggcggc

SEQ ID NO: 42684 - DNA, 30 bp, Homo sapiens
ggcgcgcgggtcggggcggcggcggcggcg

SEQ ID NO: 42685 - DNA, 16 bp, Homo sapiens
gcgcgcgggtcggggc

SEQ ID NO: 42686 - DNA, 17 bp, Homo sapiens
gcgcgcgggtcggggcg

SEQ ID NO: 42687 - DNA, 18 bp, Homo sapiens
gcgcgcgggtcggggcgg

SEQ ID NO: 42688 - DNA, 19 bp, Homo sapiens
gcgcgcgggtcggggcggc

SEQ ID NO: 42689 - DNA, 20 bp, Homo sapiens
gcgcgcgggtcggggcggcg

SEQ ID NO: 42690 - DNA, 21 bp, Homo sapiens
gcgcgcgggtcggggcggcgg

SEQ ID NO: 42691 - DNA, 22 bp, Homo sapiens
gcgcgcgggtcggggcggcggc

SEQ ID NO: 42692 - DNA, 23 bp, Homo sapiens
gcgcgcgggtcggggcggcggcg

SEQ ID NO: 42693 - DNA, 25 bp, Homo sapiens
gcgcgcgggtcggggcggcggcggc

SEQ ID NO: 42694 - DNA, 26 bp, Homo sapiens
gcgcgcgggtcggggcggcggcggcg

SEQ ID NO: 42695 - DNA, 27 bp, Homo sapiens
gcgcgcgggtcggggcggcggcggcgg

SEQ ID NO: 42696 - DNA, 28 bp, Homo sapiens
gcgcgcgggtcggggcggcggcggcggc

SEQ ID NO: 42697 - DNA, 29 bp, Homo sapiens
gcgcgcgggtcggggcggcggcggcggcg

SEQ ID NO: 42698 - DNA, 30 bp, Homo sapiens
gcgcgcgggtcggggcggcggcggcggcgg

SEQ ID NO: 42699 - DNA, 17 bp, Homo sapiens
cgcgcgggtcggggcgg

SEQ ID NO: 42700 - DNA, 19 bp, Homo sapiens
cgcgcgggtcggggcggcg

SEQ ID NO: 42701 - DNA, 20 bp, Homo sapiens
cgcgcgggtcggggcggcgg

SEQ ID NO: 42702 - DNA, 21 bp, Homo sapiens
cgcgcgggtcggggcggcggc

SEQ ID NO: 42703 - DNA, 22 bp, Homo sapiens
cgcgcgggtcggggcggcggcg

SEQ ID NO: 42704 - DNA, 25 bp, Homo sapiens
cgcgcgggtcggggcggcggcggcg

SEQ ID NO: 42705 - DNA, 26 bp, Homo sapiens
cgcgcgggtcggggcggcggcggcgg

SEQ ID NO: 42706 - DNA, 27 bp, Homo sapiens
cgcgcgggtcggggcggcggcggcggc

SEQ ID NO: 42707 - DNA, 16 bp, Homo sapiens
gcgcgggtcggggcgg

SEQ ID NO: 42708 - DNA, 17 bp, Homo sapiens
gcgcgggtcggggcggc

SEQ ID NO: 42709 - DNA, 18 bp, Homo sapiens
gcgcgggtcggggcggcg

SEQ ID NO: 42710 - DNA, 19 bp, Homo sapiens
gcgcgggtcggggcggcgg

SEQ ID NO: 42711 - DNA, 20 bp, Homo sapiens
gcgcgggtcggggcggcggc

SEQ ID NO: 42712 - DNA, 21 bp, Homo sapiens
gcgcgggtcggggcggcggcg

SEQ ID NO: 42713 - DNA, 23 bp, Homo sapiens
gcgcgggtcggggcggcggcggc

SEQ ID NO: 42714 - DNA, 24 bp, Homo sapiens
gcgcgggtcggggcggcggcggcg

SEQ ID NO: 42715 - DNA, 25 bp, Homo sapiens
gcgcgggtcggggcggcggcggcgg

SEQ ID NO: 42716 - DNA, 26 bp, Homo sapiens
gcgcgggtcggggcggcggcggcggc

SEQ ID NO: 42717 - DNA, 27 bp, Homo sapiens
gcgcgggtcggggcggcggcggcggcg

SEQ ID NO: 42718 - DNA, 28 bp, Homo sapiens
gcgcgggtcggggcggcggcggcggcgg

SEQ ID NO: 42719 - DNA, 29 bp, Homo sapiens
gcgcgggtcggggcggcggcggcggcggc

SEQ ID NO: 42720 - DNA, 30 bp, Homo sapiens
gcgcgggtcggggcggcggcggcggcggcg

SEQ ID NO: 42721 - DNA, 17 bp, Homo sapiens
cgcgggtcggggcggcg

SEQ ID NO: 42722 - DNA, 18 bp, Homo sapiens
cgcgggtcggggcggcgg

SEQ ID NO: 42723 - DNA, 19 bp, Homo sapiens
cgcgggtcggggcggcggc

SEQ ID NO: 42724 - DNA, 20 bp, Homo sapiens
cgcgggtcggggcggcggcg

SEQ ID NO: 42725 - DNA, 22 bp, Homo sapiens
cgcgggtcggggcggcggcggc

SEQ ID NO: 42726 - DNA, 23 bp, Homo sapiens
cgcgggtcggggcggcggcggcg

SEQ ID NO: 42727 - DNA, 24 bp, Homo sapiens
cgcgggtcggggcggcggcggcgg

SEQ ID NO: 42728 - DNA, 25 bp, Homo sapiens
cgcgggtcggggcggcggcggcggc

SEQ ID NO: 42729 - DNA, 26 bp, Homo sapiens
cgcgggtcggggcggcggcggcggcg

SEQ ID NO: 42730 - DNA, 27 bp, Homo sapiens
cgcgggtcggggcggcggcggcggcgg

SEQ ID NO: 42731 - DNA, 28 bp, Homo sapiens
cgcgggtcggggcggcggcggcggcggc

SEQ ID NO: 42732 - DNA, 18 bp, Homo sapiens
gcgggtcggggcggcggc

SEQ ID NO: 42733 - DNA, 19 bp, Homo sapiens
gcgggtcggggcggcggcg

SEQ ID NO: 42734 - DNA, 21 bp, Homo sapiens
gcgggtcggggcggcggcggc

SEQ ID NO: 42735 - DNA, 22 bp, Homo sapiens
gcgggtcggggcggcggcggcg

SEQ ID NO: 42736 - DNA, 23 bp, Homo sapiens
gcgggtcggggcggcggcggcgg

SEQ ID NO: 42737 - DNA, 24 bp, Homo sapiens
gcgggtcggggcggcggcggcggc

SEQ ID NO: 42738 - DNA, 25 bp, Homo sapiens
gcgggtcggggcggcggcggcggcg

SEQ ID NO: 42739 - DNA, 26 bp, Homo sapiens
gcgggtcggggcggcggcggcggcgg

SEQ ID NO: 42740 - DNA, 27 bp, Homo sapiens
gcgggtcggggcggcggcggcggcggc

SEQ ID NO: 42741 - DNA, 16 bp, Homo sapiens
cgggtcggggcggcgg

SEQ ID NO: 42742 - DNA, 17 bp, Homo sapiens
cgggtcggggcggcggc

SEQ ID NO: 42743 - DNA, 18 bp, Homo sapiens
cgggtcggggcggcggcg

SEQ ID NO: 42744 - DNA, 19 bp, Homo sapiens
cgggtcggggcggcggcgg

SEQ ID NO: 42745 - DNA, 20 bp, Homo sapiens
cgggtcggggcggcggcggc

SEQ ID NO: 42746 - DNA, 21 bp, Homo sapiens
cgggtcggggcggcggcggcg

SEQ ID NO: 42747 - DNA, 22 bp, Homo sapiens
cgggtcggggcggcggcggcgg

SEQ ID NO: 42748 - DNA, 23 bp, Homo sapiens
cgggtcggggcggcggcggcggc

SEQ ID NO: 42749 - DNA, 24 bp, Homo sapiens
cgggtcggggcggcggcggcggcg

SEQ ID NO: 42750 - DNA, 25 bp, Homo sapiens
cgggtcggggcggcggcggcggcgg

SEQ ID NO: 42751 - DNA, 26 bp, Homo sapiens
cgggtcggggcggcggcggcggcggc

SEQ ID NO: 42752 - DNA, 27 bp, Homo sapiens
cgggtcggggcggcggcggcggcggcg

SEQ ID NO: 42753 - DNA, 16 bp, Homo sapiens
gggtcggggcggcggc

SEQ ID NO: 42754 - DNA, 17 bp, Homo sapiens
gggtcggggcggcggcg

SEQ ID NO: 42755 - DNA, 19 bp, Homo sapiens
gggtcggggcggcggcggc

SEQ ID NO: 42756 - DNA, 20 bp, Homo sapiens
gggtcggggcggcggcggcg

SEQ ID NO: 42757 - DNA, 21 bp, Homo sapiens
gggtcggggcggcggcggcgg

SEQ ID NO: 42758 - DNA, 22 bp, Homo sapiens
gggtcggggcggcggcggcggc

SEQ ID NO: 42759 - DNA, 23 bp, Homo sapiens
gggtcggggcggcggcggcggcg

SEQ ID NO: 42760 - DNA, 24 bp, Homo sapiens
gggtcggggcggcggcggcggcgg

SEQ ID NO: 42761 - DNA, 25 bp, Homo sapiens
gggtcggggcggcggcggcggcggc

SEQ ID NO: 42762 - DNA, 16 bp, Homo sapiens
ggtcggggcggcggcg

SEQ ID NO: 42763 - DNA, 17 bp, Homo sapiens
ggtcggggcggcggcgg

SEQ ID NO: 42764 - DNA, 18 bp, Homo sapiens
ggtcggggcggcggcggc

SEQ ID NO: 42765 - DNA, 19 bp, Homo sapiens
ggtcggggcggcggcggcg

SEQ ID NO: 42766 - DNA, 20 bp, Homo sapiens
ggtcggggcggcggcggcgg

SEQ ID NO: 42767 - DNA, 21 bp, Homo sapiens
ggtcggggcggcggcggcggc

SEQ ID NO: 42768 - DNA, 22 bp, Homo sapiens
ggtcggggcggcggcggcggcg

SEQ ID NO: 42769 - DNA, 23 bp, Homo sapiens
ggtcggggcggcggcggcggcgg

SEQ ID NO: 42770 - DNA, 24 bp, Homo sapiens
ggtcggggcggcggcggcggcggc

SEQ ID NO: 42771 - DNA, 25 bp, Homo sapiens
ggtcggggcggcggcggcggcggcg

SEQ ID NO: 42772 - DNA, 26 bp, Homo sapiens
ggtcggggcggcggcggcggcggcgg

SEQ ID NO: 42773 - DNA, 28 bp, Homo sapiens
ggtcggggcggcggcggcggcggcggtg

SEQ ID NO: 42774 - DNA, 19 bp, Homo sapiens
gtcggggcggcggcggcgg

SEQ ID NO: 42775 - DNA, 20 bp, Homo sapiens
gtcggggcggcggcggcggc

SEQ ID NO: 42776 - DNA, 21 bp, Homo sapiens
gtcggggcggcggcggcggcg

SEQ ID NO: 42777 - DNA, 22 bp, Homo sapiens
gtcggggcggcggcggcggcgg

SEQ ID NO: 42778 - DNA, 23 bp, Homo sapiens
gtcggggcggcggcggcggcggc

SEQ ID NO: 42779 - DNA, 24 bp, Homo sapiens
gtcggggcggcggcggcggcggcg

SEQ ID NO: 42780 - DNA, 18 bp, Homo sapiens
tcggggcggcggcggcgg

SEQ ID NO: 42781 - DNA, 19 bp, Homo sapiens
tcggggcggcggcggcggc

SEQ ID NO: 42782 - DNA, 20 bp, Homo sapiens
tcggggcggcggcggcggcg

SEQ ID NO: 42783 - DNA, 21 bp, Homo sapiens
tcggggcggcggcggcggcgg

SEQ ID NO: 42784 - DNA, 22 bp, Homo sapiens
tcggggcggcggcggcggcggc

SEQ ID NO: 42785 - DNA, 23 bp, Homo sapiens
tcggggcggcggcggcggcggcg

SEQ ID NO: 42786 - DNA, 17 bp, Homo sapiens
cggggcggcggcggcgg

SEQ ID NO: 42787 - DNA, 18 bp, Homo sapiens
cggggcggcggcggcggc

SEQ ID NO: 42788 - DNA, 16 bp, Homo sapiens
ggggcggcggcggcgg

SEQ ID NO: 42789 - DNA, 17 bp, Homo sapiens
ggggcggcggcggcggc

SEQ ID NO: 42790 - DNA, 18 bp, Homo sapiens
ggggcggcggcggcggcg

SEQ ID NO: 42791 - DNA, 19 bp, Homo sapiens
ggggcggcggcggcggcgg

SEQ ID NO: 42792 - DNA, 20 bp, Homo sapiens
ggggcggcggcggcggcggc

SEQ ID NO: 42793 - DNA, 21 bp, Homo sapiens
ggggcggcggcggcggcggcg

SEQ ID NO: 42794 - DNA, 22 bp, Homo sapiens
ggggcggcggcggcggcggcgg

SEQ ID NO: 42795 - DNA, 23 bp, Homo sapiens
ggggcggcggcggcggcggcggt

SEQ ID NO: 42796 - DNA, 19 bp, Homo sapiens
gggcggcggcggcggcggc

SEQ ID NO: 42797 - DNA, 20 bp, Homo sapiens
gggcggcggcggcggcggcg

SEQ ID NO: 42798 - DNA, 17 bp, Homo sapiens
ggcggcggcggcggcgg

SEQ ID NO: 42799 - DNA, 18 bp, Homo sapiens
ggcggcggcggcggcggc

SEQ ID NO: 42800 - DNA, 19 bp, Homo sapiens
ggcggcggcggcggcggcg

SEQ ID NO: 42801 - DNA, 20 bp, Homo sapiens
ggcggcggcggcggcggcgg

SEQ ID NO: 42802 - DNA, 16 bp, Homo sapiens
gcggcggcggcggcgg

SEQ ID NO: 42803 - DNA, 17 bp, Homo sapiens
gcggcggcggcggcggc

SEQ ID NO: 42804 - DNA, 18 bp, Homo sapiens
gcggcggcggcggcggcg

SEQ ID NO: 42805 - DNA, 19 bp, Homo sapiens
gcggcggcggcggcggcgg

SEQ ID NO: 42806 - DNA, 16 bp, Homo sapiens
cggcggcggcggcggc

SEQ ID NO: 42807 - DNA, 17 bp, Homo sapiens
cggcggcggcggcggcg

SEQ ID NO: 42808 - DNA, 18 bp, Homo sapiens
cggcggcggcggcggcgg

SEQ ID NO: 42809 - DNA, 17 bp, Homo sapiens
ggcggcggcggcggcgg

SEQ ID NO: 42810 - DNA, 21 bp, Homo sapiens
ggcggcggcggcggcggtggc

SEQ ID NO: 42811 - DNA, 22 bp, Homo sapiens
ggcggcggcggcggcggtggcg

SEQ ID NO: 42812 - DNA, 16 bp, Homo sapiens
gcggcggcggcggcgg

SEQ ID NO: 42813 - DNA, 30 bp, Homo sapiens
gcggcggcggcggcggtggcggcggcggcg

SEQ ID NO: 42814 - DNA, 21 bp, Homo sapiens
ggcggcggcggcggtggcggc

SEQ ID NO: 42815 - DNA, 24 bp, Homo sapiens
ggcggcggcggcggtggcggcggc

SEQ ID NO: 42816 - DNA, 23 bp, Homo sapiens
gcggcggcggcggtggcggcggc

SEQ ID NO: 42817 - DNA, 21 bp, Homo sapiens
ggcggcggcggtggcggcggc

SEQ ID NO: 42818 - DNA, 24 bp, Homo sapiens
ggcggcggcggtggcggcggcggc

SEQ ID NO: 42819 - DNA, 23 bp, Homo sapiens
gcggcggcggtggcggcggcggc

SEQ ID NO: 42820 - DNA, 21 bp, Homo sapiens
ggcggcggtggcggcggcggc

SEQ ID NO: 42821 - DNA, 24 bp, Homo sapiens
ggcggcggtggcggcggcggcggc

SEQ ID NO: 42822 - DNA, 20 bp, Homo sapiens
gcggcggtggcggcggcggc

SEQ ID NO: 42823 - DNA, 23 bp, Homo sapiens
gcggcggtggcggcggcggcggc

SEQ ID NO: 42824 - DNA, 30 bp, Homo sapiens
gcggcggtggcggcggcggcggcggcggcg

SEQ ID NO: 42825 - DNA, 18 bp, Homo sapiens
ggcggtggcggcggcggc

SEQ ID NO: 42826 - DNA, 21 bp, Homo sapiens
ggcggtggcggcggcggcggc

SEQ ID NO: 42827 - DNA, 26 bp, Homo sapiens
gcggtggcggcggcggcggcggcggc

SEQ ID NO: 42828 - DNA, 27 bp, Homo sapiens
gcggtggcggcggcggcggcggcggcg

SEQ ID NO: 42829 - DNA, 17 bp, Homo sapiens
ggtggcggcggcggcgg

SEQ ID NO: 42830 - DNA, 18 bp, Homo sapiens
ggtggcggcggcggcggc

SEQ ID NO: 42831 - DNA, 19 bp, Homo sapiens
ggtggcggcggcggcggcg

SEQ ID NO: 42832 - DNA, 20 bp, Homo sapiens
ggtggcggcggcggcggcgg

SEQ ID NO: 42833 - DNA, 21 bp, Homo sapiens
ggtggcggcggcggcggcggc

SEQ ID NO: 42834 - DNA, 22 bp, Homo sapiens
ggtggcggcggcggcggcggcg

SEQ ID NO: 42835 - DNA, 23 bp, Homo sapiens
ggtggcggcggcggcggcggcgg

SEQ ID NO: 42836 - DNA, 24 bp, Homo sapiens
ggtggcggcggcggcggcggcggc

SEQ ID NO: 42837 - DNA, 25 bp, Homo sapiens
ggtggcggcggcggcggcggcggcg

SEQ ID NO: 42838 - DNA, 26 bp, Homo sapiens
ggtggcggcggcggcggcggcggcgg

SEQ ID NO: 42839 - DNA, 30 bp, Homo sapiens
ggtggcggcggcggcggcggcggcgggacc

SEQ ID NO: 42840 - DNA, 20 bp, Homo sapiens
gtggcggcggcggcggcggc

SEQ ID NO: 42841 - DNA, 23 bp, Homo sapiens
gtggcggcggcggcggcggcggc

SEQ ID NO: 42842 - DNA, 24 bp, Homo sapiens
gtggcggcggcggcggcggcggcg

SEQ ID NO: 42843 - DNA, 25 bp, Homo sapiens
gtggcggcggcggcggcggcggcgg

SEQ ID NO: 42844 - DNA, 17 bp, Homo sapiens
ggcggcggcggcggcgg

SEQ ID NO: 42845 - DNA, 18 bp, Homo sapiens
ggcggcggcggcggcggc

SEQ ID NO: 42846 - DNA, 19 bp, Homo sapiens
ggcggcggcggcggcggcg

SEQ ID NO: 42847 - DNA, 20 bp, Homo sapiens
ggcggcggcggcggcggcgg

SEQ ID NO: 42848 - DNA, 21 bp, Homo sapiens
ggcggcggcggcggcggcggc

SEQ ID NO: 42849 - DNA, 22 bp, Homo sapiens
ggcggcggcggcggcggcggcg

SEQ ID NO: 42850 - DNA, 23 bp, Homo sapiens
ggcggcggcggcggcggcggcgg

SEQ ID NO: 42851 - DNA, 24 bp, Homo sapiens
ggcggcggcggcggcggcggcggg

SEQ ID NO: 42852 - DNA, 16 bp, Homo sapiens
gcggcggcggcggcgg

SEQ ID NO: 42853 - DNA, 17 bp, Homo sapiens
gcggcggcggcggcggc

SEQ ID NO: 42854 - DNA, 18 bp, Homo sapiens
gcggcggcggcggcggcg

SEQ ID NO: 42855 - DNA, 19 bp, Homo sapiens
gcggcggcggcggcggcgg

SEQ ID NO: 42856 - DNA, 20 bp, Homo sapiens
gcggcggcggcggcggcggc

SEQ ID NO: 42857 - DNA, 21 bp, Homo sapiens
gcggcggcggcggcggcggcg

SEQ ID NO: 42858 - DNA, 22 bp, Homo sapiens
gcggcggcggcggcggcggcgg

SEQ ID NO: 42859 - DNA, 16 bp, Homo sapiens
cggcggcggcggcggc

SEQ ID NO: 42860 - DNA, 17 bp, Homo sapiens
cggcggcggcggcggcg

SEQ ID NO: 42861 - DNA, 18 bp, Homo sapiens
cggcggcggcggcggcgg

SEQ ID NO: 42862 - DNA, 19 bp, Homo sapiens
cggcggcggcggcggcggc

SEQ ID NO: 42863 - DNA, 20 bp, Homo sapiens
cggcggcggcggcggcggcg

SEQ ID NO: 42864 - DNA, 21 bp, Homo sapiens
cggcggcggcggcggcggcgg

SEQ ID NO: 42865 - DNA, 17 bp, Homo sapiens
ggcggcggcggcggcgg

SEQ ID NO: 42866 - DNA, 18 bp, Homo sapiens
ggcggcggcggcggcggc

SEQ ID NO: 42867 - DNA, 19 bp, Homo sapiens
ggcggcggcggcggcggcg

SEQ ID NO: 42868 - DNA, 20 bp, Homo sapiens
ggcggcggcggcggcggcgg

SEQ ID NO: 42869 - DNA, 21 bp, Homo sapiens
ggcggcggcggcggcggcggg

SEQ ID NO: 42870 - DNA, 16 bp, Homo sapiens
gcggcggcggcggcgg

SEQ ID NO: 42871 - DNA, 17 bp, Homo sapiens
gcggcggcggcggcggc

SEQ ID NO: 42872 - DNA, 18 bp, Homo sapiens
gcggcggcggcggcggcg

SEQ ID NO: 42873 - DNA, 19 bp, Homo sapiens
gcggcggcggcggcggcgg

SEQ ID NO: 42874 - DNA, 16 bp, Homo sapiens
cggcggcggcggcggc

SEQ ID NO: 42875 - DNA, 17 bp, Homo sapiens
cggcggcggcggcggcg

SEQ ID NO: 42876 - DNA, 18 bp, Homo sapiens
cggcggcggcggcggcgg

SEQ ID NO: 42877 - DNA, 17 bp, Homo sapiens
ggcggcggcggcggcgg

SEQ ID NO: 42878 - DNA, 18 bp, Homo sapiens
ggcggcggcggcggcggg

SEQ ID NO: 42879 - DNA, 16 bp, Homo sapiens
gcggcggcggcggcgg

SEQ ID NO: 42880 - DNA, 18 bp, Homo sapiens
cggcggcggcggcgggac

SEQ ID NO: 42881 - DNA, 23 bp, Homo sapiens
ggaccgaaaccccccccgagtgt

SEQ ID NO: 42882 - DNA, 24 bp, Homo sapiens
ggaccgaaaccccccccgagtgtt

SEQ ID NO: 42883 - DNA, 16 bp, Homo sapiens
gaaaccccccccgagt

SEQ ID NO: 42884 - DNA, 18 bp, Homo sapiens
gaaaccccccccgagtgt

SEQ ID NO: 42885 - DNA, 19 bp, Homo sapiens
gaaaccccccccgagtgtt

SEQ ID NO: 42886 - DNA, 17 bp, Homo sapiens
aaccccccccgagtgtt

SEQ ID NO: 42887 - DNA, 22 bp, Homo sapiens
cccccccgagtgttacagcccc

SEQ ID NO: 42888 - DNA, 21 bp, Homo sapiens
ccccccgagtgttacagcccc

SEQ ID NO: 42889 - DNA, 23 bp, Homo sapiens
ccccccgagtgttacagcccccc

SEQ ID NO: 42890 - DNA, 20 bp, Homo sapiens
cccccgagtgttacagcccc

SEQ ID NO: 42891 - DNA, 21 bp, Homo sapiens
cccccgagtgttacagccccc

SEQ ID NO: 42892 - DNA, 22 bp, Homo sapiens
cccccgagtgttacagcccccc

SEQ ID NO: 42893 - DNA, 23 bp, Homo sapiens
cccccgagtgttacagccccccc

SEQ ID NO: 42894 - DNA, 20 bp, Homo sapiens
ccccgagtgttacagccccc

SEQ ID NO: 42895 - DNA, 21 bp, Homo sapiens
ccccgagtgttacagcccccc

SEQ ID NO: 42896 - DNA, 22 bp, Homo sapiens
ccccgagtgttacagccccccc

SEQ ID NO: 42897 - DNA, 20 bp, Homo sapiens
cccgagtgttacagcccccc

SEQ ID NO: 42898 - DNA, 21 bp, Homo sapiens
cccgagtgttacagccccccc

SEQ ID NO: 42899 - DNA, 21 bp, Homo sapiens
gagtgttacagcccccccggc

SEQ ID NO: 42900 - DNA, 19 bp, Homo sapiens
agtgttacagcccccccgg

SEQ ID NO: 42901 - DNA, 18 bp, Homo sapiens
gtgttacagcccccccgg

SEQ ID NO: 42902 - DNA, 19 bp, Homo sapiens
gtgttacagcccccccggc

SEQ ID NO: 42903 - DNA, 20 bp, Homo sapiens
gtgttacagcccccccggca

SEQ ID NO: 42904 - DNA, 21 bp, Homo sapiens
gtgttacagcccccccggcag

SEQ ID NO: 42905 - DNA, 17 bp, Homo sapiens
tgttacagcccccccgg

SEQ ID NO: 42906 - DNA, 19 bp, Homo sapiens
tgttacagcccccccggca

SEQ ID NO: 42907 - DNA, 20 bp, Homo sapiens
tgttacagcccccccggcag

SEQ ID NO: 42908 - DNA, 22 bp, Homo sapiens
tgttacagcccccccggcagca

SEQ ID NO: 42909 - DNA, 23 bp, Homo sapiens
tgttacagcccccccggcagcag

SEQ ID NO: 42910 - DNA, 17 bp, Homo sapiens
gttacagcccccccggc

SEQ ID NO: 42911 - DNA, 22 bp, Homo sapiens
gttacagcccccccggcagcag

SEQ ID NO: 42912 - DNA, 21 bp, Homo sapiens
ttacagcccccccggcagcag

SEQ ID NO: 42913 - DNA, 20 bp, Homo sapiens
tacagcccccccggcagcag

SEQ ID NO: 42914 - DNA, 18 bp, Homo sapiens
acagcccccccggcagca

SEQ ID NO: 42915 - DNA, 19 bp, Homo sapiens
acagcccccccggcagcag

SEQ ID NO: 42916 - DNA, 19 bp, Homo sapiens
cggcagcagcactcgccga

SEQ ID NO: 42917 - DNA, 18 bp, Homo sapiens
ggcagcagcactcgccga

SEQ ID NO: 42918 - DNA, 22 bp, Homo sapiens
cagcagcactcgccgaatcccg

SEQ ID NO: 42919 - DNA, 24 bp, Homo sapiens
cagcagcactcgccgaatcccggg

SEQ ID NO: 42920 - DNA, 21 bp, Homo sapiens
gcagcactcgccgaatcccgg

SEQ ID NO: 42921 - DNA, 22 bp, Homo sapiens
gcagcactcgccgaatcccggg

SEQ ID NO: 42922 - DNA, 23 bp, Homo sapiens
gcagcactcgccgaatcccgggg

SEQ ID NO: 42923 - DNA, 19 bp, Homo sapiens
cagcactcgccgaatcccg

SEQ ID NO: 42924 - DNA, 20 bp, Homo sapiens
cagcactcgccgaatcccgg

SEQ ID NO: 42925 - DNA, 21 bp, Homo sapiens
cagcactcgccgaatcccggg

SEQ ID NO: 42926 - DNA, 22 bp, Homo sapiens
cagcactcgccgaatcccgggg

SEQ ID NO: 42927 - DNA, 19 bp, Homo sapiens
agcactcgccgaatcccgg

SEQ ID NO: 42928 - DNA, 30 bp, Homo sapiens; identical to SEQ ID NO: 19739

SEQ ID NO: 42929 - DNA, 18 bp, Homo sapiens
gcactcgccgaatcccgg

SEQ ID NO: 42930 - DNA, 19 bp, Homo sapiens
gcactcgccgaatcccggg

SEQ ID NO: 42931 - DNA, 20 bp, Homo sapiens
gcactcgccgaatcccgggg

SEQ ID NO: 42932 - DNA, 21 bp, Homo sapiens
gcactcgccgaatcccggggc

SEQ ID NO: 42933 - DNA, 22 bp, Homo sapiens
gcactcgccgaatcccggggcc

SEQ ID NO: 42934 - DNA, 26 bp, Homo sapiens
gcactcgccgaatcccggggccgagg

SEQ ID NO: 42935 - DNA, 27 bp, Homo sapiens
gcactcgccgaatcccggggccgaggg

SEQ ID NO: 42936 - DNA, 30 bp, Homo sapiens; identical to SEQ ID NO: 19750

SEQ ID NO: 42937 - DNA, 17 bp, Homo sapiens
cactcgccgaatcccgg

SEQ ID NO: 42938 - DNA, 18 bp, Homo sapiens
cactcgccgaatcccggg

SEQ ID NO: 42939 - DNA, 19 bp, Homo sapiens
cactcgccgaatcccgggg

SEQ ID NO: 42940 - DNA, 21 bp, Homo sapiens
cactcgccgaatcccggggcc

SEQ ID NO: 42941 - DNA, 30 bp, Homo sapiens
cactcgccgaatcccggggccgagggagcg

SEQ ID NO: 42942 - DNA, 29 bp, Homo sapiens
actcgccgaatcccggggccgagggagcg

SEQ ID NO: 42943 - DNA, 17 bp, Homo sapiens
ctcgccgaatcccgggg

SEQ ID NO: 42944 - DNA, 18 bp, Homo sapiens
ctcgccgaatcccggggc

SEQ ID NO: 42945 - DNA, 22 bp, Homo sapiens
ctcgccgaatcccggggccgag

SEQ ID NO: 42946 - DNA, 23 bp, Homo sapiens
ctcgccgaatcccggggccgagg

SEQ ID NO: 42947 - DNA, 24 bp, Homo sapiens
ctcgccgaatcccggggccgaggg

SEQ ID NO: 42948 - DNA, 25 bp, Homo sapiens
ctcgccgaatcccggggccgaggga

SEQ ID NO: 42949 - DNA, 26 bp, Homo sapiens
ctcgccgaatcccggggccgagggag

SEQ ID NO: 42950 - DNA, 27 bp, Homo sapiens
ctcgccgaatcccggggccgagggagc

SEQ ID NO: 42951 - DNA, 28 bp, Homo sapiens
ctcgccgaatcccggggccgagggagcg

SEQ ID NO: 42952 - DNA, 29 bp, Homo sapiens
ctcgccgaatcccggggccgagggagcga

SEQ ID NO: 42953 - DNA, 30 bp, Homo sapiens
ctcgccgaatcccggggccgagggagcgag

SEQ ID NO: 42954 - DNA, 21 bp, Homo sapiens
tcgccgaatcccggggccgag

SEQ ID NO: 42955 - DNA, 22 bp, Homo sapiens
tcgccgaatcccggggccgagg

SEQ ID NO: 42956 - DNA, 23 bp, Homo sapiens
tcgccgaatcccggggccgaggg

SEQ ID NO: 42957 - DNA, 24 bp, Homo sapiens
tcgccgaatcccggggccgaggga

SEQ ID NO: 42958 - DNA, 25 bp, Homo sapiens
tcgccgaatcccggggccgagggag

SEQ ID NO: 42959 - DNA, 26 bp, Homo sapiens
tcgccgaatcccggggccgagggagc

SEQ ID NO: 42960 - DNA, 27 bp, Homo sapiens
tcgccgaatcccggggccgagggagcg

SEQ ID NO: 42961 - DNA, 28 bp, Homo sapiens
tcgccgaatcccggggccgagggagcga

SEQ ID NO: 42962 - DNA, 29 bp, Homo sapiens
tcgccgaatcccggggccgagggagcgag

SEQ ID NO: 42963 - DNA, 20 bp, Homo sapiens
cgccgaatcccggggccgag

SEQ ID NO: 42964 - DNA, 21 bp, Homo sapiens
cgccgaatcccggggccgagg

SEQ ID NO: 42965 - DNA, 22 bp, Homo sapiens
cgccgaatcccggggccgaggg

SEQ ID NO: 42966 - DNA, 23 bp, Homo sapiens
cgccgaatcccggggccgaggga

SEQ ID NO: 42967 - DNA, 24 bp, Homo sapiens
cgccgaatcccggggccgagggag

SEQ ID NO: 42968 - DNA, 25 bp, Homo sapiens
cgccgaatcccggggccgagggagc

SEQ ID NO: 42969 - DNA, 26 bp, Homo sapiens
cgccgaatcccggggccgagggagcg

SEQ ID NO: 42970 - DNA, 27 bp, Homo sapiens
cgccgaatcccggggccgagggagcga

SEQ ID NO: 42971 - DNA, 28 bp, Homo sapiens
cgccgaatcccggggccgagggagcgag

SEQ ID NO: 42972 - DNA, 29 bp, Homo sapiens
cgccgaatcccggggccgagggagcgaga

SEQ ID NO: 42973 - DNA, 30 bp, Homo sapiens; identical to SEQ ID NO: 19766

SEQ ID NO: 42974 - DNA, 19 bp, Homo sapiens
gccgaatcccggggccgag

SEQ ID NO: 42975 - DNA, 20 bp, Homo sapiens
gccgaatcccggggccgagg

SEQ ID NO: 42976 - DNA, 21 bp, Homo sapiens
gccgaatcccggggccgaggg

SEQ ID NO: 42977 - DNA, 22 bp, Homo sapiens
gccgaatcccggggccgaggga

SEQ ID NO: 42978 - DNA, 24 bp, Homo sapiens
gccgaatcccggggccgagggagc

SEQ ID NO: 42979 - DNA, 25 bp, Homo sapiens
gccgaatcccggggccgagggagcg

SEQ ID NO: 42980 - DNA, 26 bp, Homo sapiens
gccgaatcccggggccgagggagcga

SEQ ID NO: 42981 - DNA, 27 bp, Homo sapiens
gccgaatcccggggccgagggagcgag

SEQ ID NO: 42982 - DNA, 28 bp, Homo sapiens
gccgaatcccggggccgagggagcgaga

SEQ ID NO: 42983 - DNA, 18 bp, Homo sapiens
ccgaatcccggggccgag

SEQ ID NO: 42984 - DNA, 21 bp, Homo sapiens
ccgaatcccggggccgaggga

SEQ ID NO: 42985 - DNA, 23 bp, Homo sapiens
ccgaatcccggggccgagggagc

SEQ ID NO: 42986 - DNA, 24 bp, Homo sapiens
ccgaatcccggggccgagggagcg

SEQ ID NO: 42987 - DNA, 25 bp, Homo sapiens
ccgaatcccggggccgagggagcga

SEQ ID NO: 42988 - DNA, 26 bp, Homo sapiens
ccgaatcccggggccgagggagcgag

SEQ ID NO: 42989 - DNA, 27 bp, Homo sapiens
ccgaatcccggggccgagggagcgaga

SEQ ID NO: 42990 - DNA, 18 bp, Homo sapiens
cgaatcccggggccgagg

SEQ ID NO: 42991 - DNA, 19 bp, Homo sapiens
cgaatcccggggccgaggg

SEQ ID NO: 42992 - DNA, 20 bp, Homo sapiens
cgaatcccggggccgaggga

SEQ ID NO: 42993 - DNA, 22 bp, Homo sapiens
cgaatcccggggccgagggagc

SEQ ID NO: 42994 - DNA, 23 bp, Homo sapiens
cgaatcccggggccgagggagcg

SEQ ID NO: 42995 - DNA, 26 bp, Homo sapiens
cgaatcccggggccgagggagcgaga

SEQ ID NO: 42996 - DNA, 27 bp, Homo sapiens
cgaatcccggggccgagggagcgagac

SEQ ID NO: 42997 - DNA, 16 bp, Homo sapiens
gaatcccggggccgag

SEQ ID NO: 42998 - DNA, 17 bp, Homo sapiens
gaatcccggggccgagg

SEQ ID NO: 42999 - DNA, 18 bp, Homo sapiens
gaatcccggggccgaggg

SEQ ID NO: 43000 - DNA, 19 bp, Homo sapiens
gaatcccggggccgaggga

SEQ ID NO: 43001 - DNA, 20 bp, Homo sapiens
gaatcccggggccgagggag

SEQ ID NO: 43002 - DNA, 21 bp, Homo sapiens
gaatcccggggccgagggagc

SEQ ID NO: 43003 - DNA, 22 bp, Homo sapiens
gaatcccggggccgagggagcg

SEQ ID NO: 43004 - DNA, 23 bp, Homo sapiens
gaatcccggggccgagggagcga

SEQ ID NO: 43005 - DNA, 24 bp, Homo sapiens
gaatcccggggccgagggagcgag

SEQ ID NO: 43006 - DNA, 25 bp, Homo sapiens
gaatcccggggccgagggagcgaga

SEQ ID NO: 43007 - DNA, 26 bp, Homo sapiens
gaatcccggggccgagggagcgagac

SEQ ID NO: 43008 - DNA, 16 bp, Homo sapiens
aatcccggggccgagg

SEQ ID NO: 43009 - DNA, 17 bp, Homo sapiens
aatcccggggccgaggg

SEQ ID NO: 43010 - DNA, 18 bp, Homo sapiens
aatcccggggccgaggga

SEQ ID NO: 43011 - DNA, 20 bp, Homo sapiens
aatcccggggccgagggagc

SEQ ID NO: 43012 - DNA, 21 bp, Homo sapiens
aatcccggggccgagggagcg

SEQ ID NO: 43013 - DNA, 22 bp, Homo sapiens
aatcccggggccgagggagcga

SEQ ID NO: 43014 - DNA, 23 bp, Homo sapiens
aatcccggggccgagggagcgag

SEQ ID NO: 43015 - DNA, 24 bp, Homo sapiens
aatcccggggccgagggagcgaga

SEQ ID NO: 43016 - DNA, 25 bp, Homo sapiens
aatcccggggccgagggagcgagac

SEQ ID NO: 43017 - DNA, 26 bp, Homo sapiens
aatcccggggccgagggagcgagacc

SEQ ID NO: 43018 - DNA, 30 bp, Homo sapiens; identical to SEQ ID NO: 19788

SEQ ID NO: 43019 - DNA, 19 bp, Homo sapiens
atcccggggccgagggagc

SEQ ID NO: 43020 - DNA, 20 bp, Homo sapiens
atcccggggccgagggagcg

SEQ ID NO: 43021 - DNA, 21 bp, Homo sapiens
atcccggggccgagggagcga

SEQ ID NO: 43022 - DNA, 22 bp, Homo sapiens
atcccggggccgagggagcgag

SEQ ID NO: 43023 - DNA, 23 bp, Homo sapiens
atcccggggccgagggagcgaga

SEQ ID NO: 43024 - DNA, 24 bp, Homo sapiens
atcccggggccgagggagcgagac

SEQ ID NO: 43025 - DNA, 25 bp, Homo sapiens
atcccggggccgagggagcgagacc

SEQ ID NO: 43026 - DNA, 30 bp, Homo sapiens; identical to SEQ ID NO: 19798

SEQ ID NO: 43027 - DNA, 18 bp, Homo sapiens
tcccggggccgagggagc

SEQ ID NO: 43028 - DNA, 19 bp, Homo sapiens
tcccggggccgagggagcg

SEQ ID NO: 43029 - DNA, 20 bp, Homo sapiens
tcccggggccgagggagcga

SEQ ID NO: 43030 - DNA, 21 bp, Homo sapiens
tcccggggccgagggagcgag

SEQ ID NO: 43031 - DNA, 22 bp, Homo sapiens
tcccggggccgagggagcgaga

SEQ ID NO: 43032 - DNA, 23 bp, Homo sapiens
tcccggggccgagggagcgagac

SEQ ID NO: 43033 - DNA, 25 bp, Homo sapiens
tcccggggccgagggagcgagaccc

SEQ ID NO: 43034 - DNA, 26 bp, Homo sapiens
tcccggggccgagggagcgagacccg

SEQ ID NO: 43035 - DNA, 18 bp, Homo sapiens
cccggggccgagggagcg

SEQ ID NO: 43036 - DNA, 19 bp, Homo sapiens
cccggggccgagggagcga

SEQ ID NO: 43037 - DNA, 20 bp, Homo sapiens
cccggggccgagggagcgag

SEQ ID NO: 43038 - DNA, 21 bp, Homo sapiens
cccggggccgagggagcgaga

SEQ ID NO: 43039 - DNA, 22 bp, Homo sapiens
cccggggccgagggagcgagac

SEQ ID NO: 43040 - DNA, 25 bp, Homo sapiens
cccggggccgagggagcgagacccg

SEQ ID NO: 43041 - DNA, 29 bp, Homo sapiens
cccggggccgagggagcgagacccgtcgc

SEQ ID NO: 43042 - DNA, 17 bp, Homo sapiens
ccggggccgagggagcg

SEQ ID NO: 43043 - DNA, 18 bp, Homo sapiens
ccggggccgagggagcga

SEQ ID NO: 43044 - DNA, 19 bp, Homo sapiens
ccggggccgagggagcgag

SEQ ID NO: 43045 - DNA, 20 bp, Homo sapiens
ccggggccgagggagcgaga

SEQ ID NO: 43046 - DNA, 21 bp, Homo sapiens
ccggggccgagggagcgagac

SEQ ID NO: 43047 - DNA, 22 bp, Homo sapiens
ccggggccgagggagcgagacc

SEQ ID NO: 43048 - DNA, 16 bp, Homo sapiens
cggggccgagggagcg

SEQ ID NO: 43049 - DNA, 17 bp, Homo sapiens
cggggccgagggagcga

SEQ ID NO: 43050 - DNA, 18 bp, Homo sapiens
cggggccgagggagcgag

SEQ ID NO: 43051 - DNA, 19 bp, Homo sapiens
cggggccgagggagcgaga

SEQ ID NO: 43052 - DNA, 20 bp, Homo sapiens
cggggccgagggagcgagac

SEQ ID NO: 43053 - DNA, 21 bp, Homo sapiens
cggggccgagggagcgagacc

SEQ ID NO: 43054 - DNA, 22 bp, Homo sapiens
cggggccgagggagcgagaccc

SEQ ID NO: 43055 - DNA, 23 bp, Homo sapiens
cggggccgagggagcgagacccg

SEQ ID NO: 43056 - DNA, 30 bp, Homo sapiens; identical to SEQ ID NO: 19821

SEQ ID NO: 43057 - DNA, 16 bp, Homo sapiens
ggggccgagggagcga

SEQ ID NO: 43058 - DNA, 17 bp, Homo sapiens
ggggccgagggagcgag

SEQ ID NO: 43059 - DNA, 18 bp, Homo sapiens
ggggccgagggagcgaga

SEQ ID NO: 43060 - DNA, 19 bp, Homo sapiens
ggggccgagggagcgagac

SEQ ID NO: 43061 - DNA, 20 bp, Homo sapiens
ggggccgagggagcgagacc

SEQ ID NO: 43062 - DNA, 26 bp, Homo sapiens
ggggccgagggagcgagacccgtcgc

SEQ ID NO: 43063 - DNA, 16 bp, Homo sapiens
gggccgagggagcgag

SEQ ID NO: 43064 - DNA, 17 bp, Homo sapiens
gggccgagggagcgaga

SEQ ID NO: 43065 - DNA, 18 bp, Homo sapiens
gggccgagggagcgagac

SEQ ID NO: 43066 - DNA, 19 bp, Homo sapiens
gggccgagggagcgagacc

SEQ ID NO: 43067 - DNA, 20 bp, Homo sapiens
gggccgagggagcgagaccc

SEQ ID NO: 43068 - DNA, 23 bp, Homo sapiens
gggccgagggagcgagacccgtc

SEQ ID NO: 43069 - DNA, 24 bp, Homo sapiens
gggccgagggagcgagacccgtcg

SEQ ID NO: 43070 - DNA, 25 bp, Homo sapiens
gggccgagggagcgagacccgtcgc

SEQ ID NO: 43071 - DNA, 26 bp, Homo sapiens
gggccgagggagcgagacccgtcgcc

SEQ ID NO: 43072 - DNA, 16 bp, Homo sapiens
ggccgagggagcgaga

SEQ ID NO: 43073 - DNA, 17 bp, Homo sapiens
ggccgagggagcgagac

SEQ ID NO: 43074 - DNA, 18 bp, Homo sapiens
ggccgagggagcgagacc

SEQ ID NO: 43075 - DNA, 19 bp, Homo sapiens
ggccgagggagcgagaccc

SEQ ID NO: 43076 - DNA, 20 bp, Homo sapiens
ggccgagggagcgagacccg

SEQ ID NO: 43077 - DNA, 21 bp, Homo sapiens
ggccgagggagcgagacccgt

SEQ ID NO: 43078 - DNA, 22 bp, Homo sapiens
ggccgagggagcgagacccgtc

SEQ ID NO: 43079 - DNA, 23 bp, Homo sapiens
ggccgagggagcgagacccgtcg

SEQ ID NO: 43080 - DNA, 27 bp, Homo sapiens
ccgagggagcgagacccgtcgccgcgc

SEQ ID NO: 43081 - DNA, 26 bp, Homo sapiens
cgagggagcgagacccgtcgccgcgc

SEQ ID NO: 43082 - DNA, 25 bp, Homo sapiens
gagggagcgagacccgtcgccgcgc

SEQ ID NO: 43083 - DNA, 20 bp, Homo sapiens
agggagcgagacccgtcgcc

SEQ ID NO: 43084 - DNA, 22 bp, Homo sapiens
agggagcgagacccgtcgccgc

SEQ ID NO: 43085 - DNA, 24 bp, Homo sapiens
agggagcgagacccgtcgccgcgc

SEQ ID NO: 43086 - DNA, 23 bp, Homo sapiens
gggagcgagacccgtcgccgcgc

SEQ ID NO: 43087 - DNA, 20 bp, Homo sapiens
gagcgagacccgtcgccgcg

SEQ ID NO: 43088 - DNA, 21 bp, Homo sapiens
gagcgagacccgtcgccgcgc

SEQ ID NO: 43089 - DNA, 22 bp, Homo sapiens
gcgagacccgtcgccgcgctct

SEQ ID NO: 43090 - DNA, 17 bp, Homo sapiens
cgagacccgtcgccgcg

SEQ ID NO: 43091 - DNA, 18 bp, Homo sapiens
cgagacccgtcgccgcgc

SEQ ID NO: 43092 - DNA, 19 bp, Homo sapiens
cgagacccgtcgccgcgct

SEQ ID NO: 43093 - DNA, 30 bp, Homo sapiens
cgagacccgtcgccgcgctctcccccctcc

SEQ ID NO: 43094 - DNA, 16 bp, Homo sapiens
gagacccgtcgccgcg

SEQ ID NO: 43095 - DNA, 17 bp, Homo sapiens
gagacccgtcgccgcgc

SEQ ID NO: 43096 - DNA, 18 bp, Homo sapiens
gagacccgtcgccgcgct

SEQ ID NO: 43097 - DNA, 19 bp, Homo sapiens
gagacccgtcgccgcgctc

SEQ ID NO: 43098 - DNA, 30 bp, Homo sapiens
gagacccgtcgccgcgctctcccccctccc

SEQ ID NO: 43099 - DNA, 16 bp, Homo sapiens
agacccgtcgccgcgc

SEQ ID NO: 43100 - DNA, 17 bp, Homo sapiens
agacccgtcgccgcgct

SEQ ID NO: 43101 - DNA, 19 bp, Homo sapiens
agacccgtcgccgcgctct

SEQ ID NO: 43102 - DNA, 21 bp, Homo sapiens
agacccgtcgccgcgctctcc

SEQ ID NO: 43103 - DNA, 22 bp, Homo sapiens
agacccgtcgccgcgctctccc

SEQ ID NO: 43104 - DNA, 28 bp, Homo sapiens
agacccgtcgccgcgctctcccccctcc

SEQ ID NO: 43105 - DNA, 29 bp, Homo sapiens
agacccgtcgccgcgctctcccccctccc

SEQ ID NO: 43106 - DNA, 30 bp, Homo sapiens
agacccgtcgccgcgctctcccccctcccg

SEQ ID NO: 43107 - DNA, 29 bp, Homo sapiens
gacccgtcgccgcgctctcccccctcccg

SEQ ID NO: 43108 - DNA, 30 bp, Homo sapiens; identical to SEQ ID NO: 19855

SEQ ID NO: 43109 - DNA, 19 bp, Homo sapiens
cccgtcgccgcgctctccc

SEQ ID NO: 43110 - DNA, 18 bp, Homo sapiens
ccgtcgccgcgctctccc

SEQ ID NO: 43111 - DNA, 19 bp, Homo sapiens
ccgtcgccgcgctctcccc

SEQ ID NO: 43112 - DNA, 21 bp, Homo sapiens
ccgtcgccgcgctctcccccc

SEQ ID NO: 43113 - DNA, 17 bp, Homo sapiens
cgtcgccgcgctctccc

SEQ ID NO: 43114 - DNA, 18 bp, Homo sapiens
cgtcgccgcgctctcccc

SEQ ID NO: 43115 - DNA, 19 bp, Homo sapiens
cgtcgccgcgctctccccc

SEQ ID NO: 43116 - DNA, 20 bp, Homo sapiens
cgtcgccgcgctctcccccc

SEQ ID NO: 43117 - DNA, 17 bp, Homo sapiens
gtcgccgcgctctcccc

SEQ ID NO: 43118 - DNA, 18 bp, Homo sapiens
gtcgccgcgctctccccc

SEQ ID NO: 43119 - DNA, 19 bp, Homo sapiens
gtcgccgcgctctcccccc

SEQ ID NO: 43120 - DNA, 20 bp, Homo sapiens
gtcgccgcgctctcccccct

SEQ ID NO: 43121 - DNA, 21 bp, Homo sapiens
gtcgccgcgctctcccccctc

SEQ ID NO: 43122 - DNA, 24 bp, Homo sapiens
gtcgccgcgctctcccccctcccg

SEQ ID NO: 43123 - DNA, 25 bp, Homo sapiens
gtcgccgcgctctcccccctcccgg

SEQ ID NO: 43124 - DNA, 26 bp, Homo sapiens
gtcgccgcgctctcccccctcccggc

SEQ ID NO: 43125 - DNA, 23 bp, Homo sapiens
cgccgcgctctcccccctcccgg

SEQ ID NO: 43126 - DNA, 24 bp, Homo sapiens
cgccgcgctctcccccctcccggc

SEQ ID NO: 43127 - DNA, 26 bp, Homo sapiens
cgccgcgctctcccccctcccggcgc

SEQ ID NO: 43128 - DNA, 22 bp, Homo sapiens
gccgcgctctcccccctcccgg

SEQ ID NO: 43129 - DNA, 23 bp, Homo sapiens
gccgcgctctcccccctcccggc

SEQ ID NO: 43130 - DNA, 25 bp, Homo sapiens
gccgcgctctcccccctcccggcgc

SEQ ID NO: 43131 - DNA, 21 bp, Homo sapiens
ccgcgctctcccccctcccgg

SEQ ID NO: 43132 - DNA, 22 bp, Homo sapiens
ccgcgctctcccccctcccggc

SEQ ID NO: 43133 - DNA, 23 bp, Homo sapiens
ccgcgctctcccccctcccggcg

SEQ ID NO: 43134 - DNA, 24 bp, Homo sapiens
ccgcgctctcccccctcccggcgc

SEQ ID NO: 43135 - DNA, 25 bp, Homo sapiens
ccgcgctctcccccctcccggcgcc

SEQ ID NO: 43136 - DNA, 20 bp, Homo sapiens
cgcgctctcccccctcccgg

SEQ ID NO: 43137 - DNA, 21 bp, Homo sapiens
cgcgctctcccccctcccggc

SEQ ID NO: 43138 - DNA, 22 bp, Homo sapiens
cgcgctctcccccctcccggcg

SEQ ID NO: 43139 - DNA, 23 bp, Homo sapiens
cgcgctctcccccctcccggcgc

SEQ ID NO: 43140 - DNA, 24 bp, Homo sapiens
cgcgctctcccccctcccggcgcc

SEQ ID NO: 43141 - DNA, 18 bp, Homo sapiens
gcgctctcccccctcccg

SEQ ID NO: 43142 - DNA, 19 bp, Homo sapiens
gcgctctcccccctcccgg

SEQ ID NO: 43143 - DNA, 20 bp, Homo sapiens
gcgctctcccccctcccggc

SEQ ID NO: 43144 - DNA, 21 bp, Homo sapiens
gcgctctcccccctcccggcg

SEQ ID NO: 43145 - DNA, 22 bp, Homo sapiens
gcgctctcccccctcccggcgc

SEQ ID NO: 43146 - DNA, 23 bp, Homo sapiens
gcgctctcccccctcccggcgcc

SEQ ID NO: 43147 - DNA, 18 bp, Homo sapiens
cgctctcccccctcccgg

SEQ ID NO: 43148 - DNA, 19 bp, Homo sapiens
cgctctcccccctcccggc

SEQ ID NO: 43149 - DNA, 20 bp, Homo sapiens
cgctctcccccctcccggcg

SEQ ID NO: 43150 - DNA, 21 bp, Homo sapiens
cgctctcccccctcccggcgc

SEQ ID NO: 43151 - DNA, 22 bp, Homo sapiens
cgctctcccccctcccggcgcc

SEQ ID NO: 43152 - DNA, 23 bp, Homo sapiens
cgctctcccccctcccggcgccc

SEQ ID NO: 43153 - DNA, 18 bp, Homo sapiens
gctctcccccctcccggc

SEQ ID NO: 43154 - DNA, 20 bp, Homo sapiens
gctctcccccctcccggcgc

SEQ ID NO: 43155 - DNA, 21 bp, Homo sapiens
gctctcccccctcccggcgcc

SEQ ID NO: 43156 - DNA, 22 bp, Homo sapiens
gctctcccccctcccggcgccc

SEQ ID NO: 43157 - DNA, 17 bp, Homo sapiens
ctctcccccctcccggc

SEQ ID NO: 43158 - DNA, 19 bp, Homo sapiens
ctctcccccctcccggcgc

SEQ ID NO: 43159 - DNA, 20 bp, Homo sapiens
ctctcccccctcccggcgcc

SEQ ID NO: 43160 - DNA, 21 bp, Homo sapiens
ctctcccccctcccggcgccc

SEQ ID NO: 43161 - DNA, 18 bp, Homo sapiens
tctcccccctcccggcgc

SEQ ID NO: 43162 - DNA, 19 bp, Homo sapiens
tctcccccctcccggcgcc

SEQ ID NO: 43163 - DNA, 20 bp, Homo sapiens
tctcccccctcccggcgccc

SEQ ID NO: 43164 - DNA, 17 bp, Homo sapiens
ctcccccctcccggcgc

SEQ ID NO: 43165 - DNA, 18 bp, Homo sapiens
ctcccccctcccggcgcc

SEQ ID NO: 43166 - DNA, 19 bp, Homo sapiens
ctcccccctcccggcgccc

SEQ ID NO: 43167 - DNA, 22 bp, Homo sapiens
ctcccccctcccggcgcccacc

SEQ ID NO: 43168 - DNA, 16 bp, Homo sapiens
tcccccctcccggcgc

SEQ ID NO: 43169 - DNA, 17 bp, Homo sapiens
tcccccctcccggcgcc

SEQ ID NO: 43170 - DNA, 18 bp, Homo sapiens
tcccccctcccggcgccc

SEQ ID NO: 43171 - DNA, 29 bp, Homo sapiens
tcccccctcccggcgcccacccccgcggg

SEQ ID NO: 43172 - DNA, 16 bp, Homo sapiens
cccccctcccggcgcc

SEQ ID NO: 43173 - DNA, 17 bp, Homo sapiens
cccccctcccggcgccc

SEQ ID NO: 43174 - DNA, 24 bp, Homo sapiens
cccccctcccggcgcccacccccg

SEQ ID NO: 43175 - DNA, 25 bp, Homo sapiens
cccccctcccggcgcccacccccgc

SEQ ID NO: 43176 - DNA, 26 bp, Homo sapiens
cccccctcccggcgcccacccccgcg

SEQ ID NO: 43177 - DNA, 27 bp, Homo sapiens
cccccctcccggcgcccacccccgcgg

SEQ ID NO: 43178 - DNA, 28 bp, Homo sapiens
cccccctcccggcgcccacccccgcggg

SEQ ID NO: 43179 - DNA, 29 bp, Homo sapiens
cccccctcccggcgcccacccccgcgggg

SEQ ID NO: 43180 - DNA, 16 bp, Homo sapiens
ccccctcccggcgccc

SEQ ID NO: 43181 - DNA, 23 bp, Homo sapiens
ccccctcccggcgcccacccccg

SEQ ID NO: 43182 - DNA, 24 bp, Homo sapiens
ccccctcccggcgcccacccccgc

SEQ ID NO: 43183 - DNA, 25 bp, Homo sapiens
ccccctcccggcgcccacccccgcg

SEQ ID NO: 43184 - DNA, 26 bp, Homo sapiens
ccccctcccggcgcccacccccgcgg

SEQ ID NO: 43185 - DNA, 27 bp, Homo sapiens
ccccctcccggcgcccacccccgcggg

SEQ ID NO: 43186 - DNA, 28 bp, Homo sapiens
ccccctcccggcgcccacccccgcgggg

SEQ ID NO: 43187 - DNA, 23 bp, Homo sapiens
cccctcccggcgcccacccccgc

SEQ ID NO: 43188 - DNA, 25 bp, Homo sapiens
cccctcccggcgcccacccccgcgg

SEQ ID NO: 43189 - DNA, 26 bp, Homo sapiens
cccctcccggcgcccacccccgcggg

SEQ ID NO: 43190 - DNA, 24 bp, Homo sapiens
ccctcccggcgcccacccccgcgg

SEQ ID NO: 43191 - DNA, 23 bp, Homo sapiens
cctcccggcgcccacccccgcgg

SEQ ID NO: 43192 - DNA, 21 bp, Homo sapiens
ctcccggcgcccacccccgcg

SEQ ID NO: 43193 - DNA, 22 bp, Homo sapiens
ctcccggcgcccacccccgcgg

SEQ ID NO: 43194 - DNA, 22 bp, Homo sapiens
tcccggcgcccacccccgcggg

SEQ ID NO: 43195 - DNA, 18 bp, Homo sapiens
cccggcgcccacccccgc

SEQ ID NO: 43196 - DNA, 19 bp, Homo sapiens
cccggcgcccacccccgcg

SEQ ID NO: 43197 - DNA, 20 bp, Homo sapiens
cccggcgcccacccccgcgg

SEQ ID NO: 43198 - DNA, 21 bp, Homo sapiens
cccggcgcccacccccgcggg

SEQ ID NO: 43199 - DNA, 22 bp, Homo sapiens
cccggcgcccacccccgcgggg

SEQ ID NO: 43200 - DNA, 23 bp, Homo sapiens
cccggcgcccacccccgcgggga

SEQ ID NO: 43201 - DNA, 24 bp, Homo sapiens
cccggcgcccacccccgcggggaa

SEQ ID NO: 43202 - DNA, 19 bp, Homo sapiens
ccggcgcccacccccgcgg

SEQ ID NO: 43203 - DNA, 20 bp, Homo sapiens
ccggcgcccacccccgcggg

SEQ ID NO: 43204 - DNA, 21 bp, Homo sapiens
ccggcgcccacccccgcgggg

SEQ ID NO: 43205 - DNA, 22 bp, Homo sapiens
ccggcgcccacccccgcgggga

SEQ ID NO: 43206 - DNA, 23 bp, Homo sapiens
ccggcgcccacccccgcggggaa

SEQ ID NO: 43207 - DNA, 17 bp, Homo sapiens
cggcgcccacccccgcg

SEQ ID NO: 43208 - DNA, 18 bp, Homo sapiens
cggcgcccacccccgcgg

SEQ ID NO: 43209 - DNA, 19 bp, Homo sapiens
cggcgcccacccccgcggg

SEQ ID NO: 43210 - DNA, 20 bp, Homo sapiens
cggcgcccacccccgcgggg

SEQ ID NO: 43211 - DNA, 21 bp, Homo sapiens
cggcgcccacccccgcgggga

SEQ ID NO: 43212 - DNA, 22 bp, Homo sapiens
cggcgcccacccccgcggggaa

SEQ ID NO: 43213 - DNA, 16 bp, Homo sapiens
ggcgcccacccccgcg

SEQ ID NO: 43214 - DNA, 17 bp, Homo sapiens
ggcgcccacccccgcgg

SEQ ID NO: 43215 - DNA, 18 bp, Homo sapiens
ggcgcccacccccgcggg

SEQ ID NO: 43216 - DNA, 19 bp, Homo sapiens
ggcgcccacccccgcgggg

SEQ ID NO: 43217 - DNA, 20 bp, Homo sapiens
ggcgcccacccccgcgggga

SEQ ID NO: 43218 - DNA, 21 bp, Homo sapiens
ggcgcccacccccgcggggaa

SEQ ID NO: 43219 - DNA, 22 bp, Homo sapiens
ggcgcccacccccgcggggaat

SEQ ID NO: 43220 - DNA, 23 bp, Homo sapiens
ggcgcccacccccgcggggaatc

SEQ ID NO: 43221 - DNA, 24 bp, Homo sapiens
ggcgcccacccccgcggggaatcc

SEQ ID NO: 43222 - DNA, 16 bp, Homo sapiens
gcgcccacccccgcgg

SEQ ID NO: 43223 - DNA, 17 bp, Homo sapiens
gcgcccacccccgcggg

SEQ ID NO: 43224 - DNA, 18 bp, Homo sapiens
gcgcccacccccgcgggg

SEQ ID NO: 43225 - DNA, 19 bp, Homo sapiens
gcgcccacccccgcgggga

SEQ ID NO: 43226 - DNA, 20 bp, Homo sapiens
gcgcccacccccgcggggaa

SEQ ID NO: 43227 - DNA, 21 bp, Homo sapiens
gcgcccacccccgcggggaat

SEQ ID NO: 43228 - DNA, 22 bp, Homo sapiens
gcgcccacccccgcggggaatc

SEQ ID NO: 43229 - DNA, 23 bp, Homo sapiens
gcgcccacccccgcggggaatcc

SEQ ID NO: 43230 - DNA, 16 bp, Homo sapiens
cgcccacccccgcggg

SEQ ID NO: 43231 - DNA, 17 bp, Homo sapiens
cgcccacccccgcgggg

SEQ ID NO: 43232 - DNA, 18 bp, Homo sapiens
cgcccacccccgcgggga

SEQ ID NO: 43233 - DNA, 19 bp, Homo sapiens
cgcccacccccgcggggaa

SEQ ID NO: 43234 - DNA, 20 bp, Homo sapiens
cgcccacccccgcggggaat

SEQ ID NO: 43235 - DNA, 21 bp, Homo sapiens
cgcccacccccgcggggaatc

SEQ ID NO: 43236 - DNA, 22 bp, Homo sapiens
cgcccacccccgcggggaatcc

SEQ ID NO: 43237 - DNA, 23 bp, Homo sapiens
cgcccacccccgcggggaatccc

SEQ ID NO: 43238 - DNA, 24 bp, Homo sapiens
cgcccacccccgcggggaatcccc

SEQ ID NO: 43239 - DNA, 16 bp, Homo sapiens
gcccacccccgcgggg

SEQ ID NO: 43240 - DNA, 17 bp, Homo sapiens
gcccacccccgcgggga

SEQ ID NO: 43241 - DNA, 18 bp, Homo sapiens
gcccacccccgcggggaa

SEQ ID NO: 43242 - DNA, 19 bp, Homo sapiens
gcccacccccgcggggaat

SEQ ID NO: 43243 - DNA, 20 bp, Homo sapiens
gcccacccccgcggggaatc

SEQ ID NO: 43244 - DNA, 21 bp, Homo sapiens
gcccacccccgcggggaatcc

SEQ ID NO: 43245 - DNA, 22 bp, Homo sapiens
gcccacccccgcggggaatccc

SEQ ID NO: 43246 - DNA, 16 bp, Homo sapiens
cccacccccgcgggga

SEQ ID NO: 43247 - DNA, 19 bp, Homo sapiens
cccacccccgcggggaatc

SEQ ID NO: 43248 - DNA, 20 bp, Homo sapiens
cccacccccgcggggaatcc

SEQ ID NO: 43249 - DNA, 17 bp, Homo sapiens
cacccccgcggggaatc

SEQ ID NO: 43250 - DNA, 18 bp, Homo sapiens
cacccccgcggggaatcc

SEQ ID NO: 43251 - DNA, 20 bp, Homo sapiens
cacccccgcggggaatcccc

SEQ ID NO: 43252 - DNA, 21 bp, Homo sapiens
cacccccgcggggaatccccc

SEQ ID NO: 43253 - DNA, 18 bp, Homo sapiens
ggtctcccccgcgggggc

SEQ ID NO: 43254 - DNA, 19 bp, Homo sapiens
ggtctcccccgcgggggcg

SEQ ID NO: 43255 - DNA, 20 bp, Homo sapiens
ggtctcccccgcgggggcgc

SEQ ID NO: 43256 - DNA, 27 bp, Homo sapiens
ggtctcccccgcgggggcgcgccggcg

SEQ ID NO: 43257 - DNA, 23 bp, Homo sapiens
tctcccccgcgggggcgcgccgg

SEQ ID NO: 43258 - DNA, 22 bp, Homo sapiens
ctcccccgcgggggcgcgccgg

SEQ ID NO: 43259 - DNA, 21 bp, Homo sapiens
tcccccgcgggggcgcgccgg

SEQ ID NO: 43260 - DNA, 19 bp, Homo sapiens
cccccgcgggggcgcgccg

SEQ ID NO: 43261 - DNA, 20 bp, Homo sapiens
cccccgcgggggcgcgccgg

SEQ ID NO: 43262 - DNA, 21 bp, Homo sapiens
cccccgcgggggcgcgccggc

SEQ ID NO: 43263 - DNA, 16 bp, Homo sapiens
ccccgcgggggcgcgc

SEQ ID NO: 43264 - DNA, 18 bp, Homo sapiens
ccccgcgggggcgcgccg

SEQ ID NO: 43265 - DNA, 19 bp, Homo sapiens
ccccgcgggggcgcgccgg

SEQ ID NO: 43266 - DNA, 20 bp, Homo sapiens
ccccgcgggggcgcgccggc

SEQ ID NO: 43267 - DNA, 18 bp, Homo sapiens
cccgcgggggcgcgccgg

SEQ ID NO: 43268 - DNA, 19 bp, Homo sapiens
cccgcgggggcgcgccggc

SEQ ID NO: 43269 - DNA, 20 bp, Homo sapiens
cccgcgggggcgcgccggcg

SEQ ID NO: 43270 - DNA, 17 bp, Homo sapiens
ccgcgggggcgcgccgg

SEQ ID NO: 43271 - DNA, 18 bp, Homo sapiens
ccgcgggggcgcgccggc

SEQ ID NO: 43272 - DNA, 19 bp, Homo sapiens
ccgcgggggcgcgccggcg

SEQ ID NO: 43273 - DNA, 16 bp, Homo sapiens
cgcgggggcgcgccgg

SEQ ID NO: 43274 - DNA, 17 bp, Homo sapiens
cgcgggggcgcgccggc

SEQ ID NO: 43275 - DNA, 18 bp, Homo sapiens
cgcgggggcgcgccggcg

SEQ ID NO: 43276 - DNA, 19 bp, Homo sapiens
cgcgggggcgcgccggcgt

SEQ ID NO: 43277 - DNA, 20 bp, Homo sapiens
cgcgggggcgcgccggcgtc

SEQ ID NO: 43278 - DNA, 16 bp, Homo sapiens
gcgggggcgcgccggc

SEQ ID NO: 43279 - DNA, 17 bp, Homo sapiens
gcgggggcgcgccggcg

SEQ ID NO: 43280 - DNA, 18 bp, Homo sapiens
gcgggggcgcgccggcgt

SEQ ID NO: 43281 - DNA, 19 bp, Homo sapiens
gcgggggcgcgccggcgtc

SEQ ID NO: 43282 - DNA, 16 bp, Homo sapiens
cgggggcgcgccggcg

SEQ ID NO: 43283 - DNA, 17 bp, Homo sapiens
cgggggcgcgccggcgt

SEQ ID NO: 43284 - DNA, 18 bp, Homo sapiens
cgggggcgcgccggcgtc

SEQ ID NO: 43285 - DNA, 20 bp, Homo sapiens
gcgccggcgtctcctcgtgg

SEQ ID NO: 43286 - DNA, 19 bp, Homo sapiens
cgccggcgtctcctcgtgg

SEQ ID NO: 43287 - DNA, 20 bp, Homo sapiens
tctcctcgtgggggggccgg

SEQ ID NO: 43288 - DNA, 19 bp, Homo sapiens
ctcctcgtgggggggccgg

SEQ ID NO: 43289 - DNA, 20 bp, Homo sapiens
ctcctcgtgggggggccggg

SEQ ID NO: 43290 - DNA, 17 bp, Homo sapiens
cctcgtgggggggccgg

SEQ ID NO: 43291 - DNA, 22 bp, Homo sapiens
ctcgtgggggggccgggccacc

SEQ ID NO: 43292 - DNA, 23 bp, Homo sapiens
ctcgtgggggggccgggccaccc

SEQ ID NO: 43293 - DNA, 24 bp, Homo sapiens
ctcgtgggggggccgggccacccc

SEQ ID NO: 43294 - DNA, 21 bp, Homo sapiens
tcgtgggggggccgggccacc

SEQ ID NO: 43295 - DNA, 22 bp, Homo sapiens
tcgtgggggggccgggccaccc

SEQ ID NO: 43296 - DNA, 20 bp, Homo sapiens
cgtgggggggccgggccacc

SEQ ID NO: 43297 - DNA, 21 bp, Homo sapiens
cgtgggggggccgggccaccc

SEQ ID NO: 43298 - DNA, 23 bp, Homo sapiens
ggggccgggccacccctcccacg

SEQ ID NO: 43299 - DNA, 21 bp, Homo sapiens
gccgggccacccctcccacgg

SEQ ID NO: 43300 - DNA, 20 bp, Homo sapiens
ccgggccacccctcccacgg

SEQ ID NO: 43301 - DNA, 22 bp, Homo sapiens
ccgggccacccctcccacggcg

SEQ ID NO: 43302 - DNA, 22 bp, Homo sapiens
cgggccacccctcccacggcgc

SEQ ID NO: 43303 - DNA, 23 bp, Homo sapiens
cgggccacccctcccacggcgcg

SEQ ID NO: 43304 - DNA, 24 bp, Homo sapiens
cgggccacccctcccacggcgcga

SEQ ID NO: 43305 - DNA, 25 bp, Homo sapiens
cgggccacccctcccacggcgcgac

SEQ ID NO: 43306 - DNA, 26 bp, Homo sapiens
cgggccacccctcccacggcgcgacc

SEQ ID NO: 43307 - DNA, 22 bp, Homo sapiens
gggccacccctcccacggcgcg

SEQ ID NO: 43308 - DNA, 24 bp, Homo sapiens
gggccacccctcccacggcgcgac

SEQ ID NO: 43309 - DNA, 25 bp, Homo sapiens
gggccacccctcccacggcgcgacc

SEQ ID NO: 43310 - DNA, 18 bp, Homo sapiens
ggccacccctcccacggc

SEQ ID NO: 43311 - DNA, 20 bp, Homo sapiens
ggccacccctcccacggcgc

SEQ ID NO: 43312 - DNA, 21 bp, Homo sapiens
ggccacccctcccacggcgcg

SEQ ID NO: 43313 - DNA, 23 bp, Homo sapiens
ggccacccctcccacggcgcgac

SEQ ID NO: 43314 - DNA, 24 bp, Homo sapiens
ggccacccctcccacggcgcgacc

SEQ ID NO: 43315 - DNA, 20 bp, Homo sapiens
gccacccctcccacggcgcg

SEQ ID NO: 43316 - DNA, 23 bp, Homo sapiens
gccacccctcccacggcgcgacc

SEQ ID NO: 43317 - DNA, 24 bp, Homo sapiens
gccacccctcccacggcgcgaccg

SEQ ID NO: 43318 - DNA, 25 bp, Homo sapiens
gccacccctcccacggcgcgaccgc

SEQ ID NO: 43319 - DNA, 19 bp, Homo sapiens
ccacccctcccacggcgcg

SEQ ID NO: 43320 - DNA, 20 bp, Homo sapiens
ccacccctcccacggcgcga

SEQ ID NO: 43321 - DNA, 21 bp, Homo sapiens
ccacccctcccacggcgcgac

SEQ ID NO: 43322 - DNA, 22 bp, Homo sapiens
ccacccctcccacggcgcgacc

SEQ ID NO: 43323 - DNA, 23 bp, Homo sapiens
ccacccctcccacggcgcgaccg

SEQ ID NO: 43324 - DNA, 24 bp, Homo sapiens
ccacccctcccacggcgcgaccgc

SEQ ID NO: 43325 - DNA, 18 bp, Homo sapiens
cacccctcccacggcgcg

SEQ ID NO: 43326 - DNA, 20 bp, Homo sapiens
cacccctcccacggcgcgac

SEQ ID NO: 43327 - DNA, 21 bp, Homo sapiens
cacccctcccacggcgcgacc

SEQ ID NO: 43328 - DNA, 22 bp, Homo sapiens
cacccctcccacggcgcgaccg

SEQ ID NO: 43329 - DNA, 23 bp, Homo sapiens
cacccctcccacggcgcgaccgc

SEQ ID NO: 43330 - DNA, 20 bp, Homo sapiens
acccctcccacggcgcgacc

SEQ ID NO: 43331 - DNA, 21 bp, Homo sapiens
acccctcccacggcgcgaccg

SEQ ID NO: 43332 - DNA, 22 bp, Homo sapiens
acccctcccacggcgcgaccgc

SEQ ID NO: 43333 - DNA, 16 bp, Homo sapiens
cccctcccacggcgcg

SEQ ID NO: 43334 - DNA, 17 bp, Homo sapiens
cccctcccacggcgcga

SEQ ID NO: 43335 - DNA, 18 bp, Homo sapiens
cccctcccacggcgcgac

SEQ ID NO: 43336 - DNA, 19 bp, Homo sapiens
cccctcccacggcgcgacc

SEQ ID NO: 43337 - DNA, 20 bp, Homo sapiens
cccctcccacggcgcgaccg

SEQ ID NO: 43338 - DNA, 21 bp, Homo sapiens
cccctcccacggcgcgaccgc

SEQ ID NO: 43339 - DNA, 22 bp, Homo sapiens
cccctcccacggcgcgaccgct

SEQ ID NO: 43340 - DNA, 23 bp, Homo sapiens
cccctcccacggcgcgaccgctc

SEQ ID NO: 43341 - DNA, 17 bp, Homo sapiens
ccctcccacggcgcgac

SEQ ID NO: 43342 - DNA, 18 bp, Homo sapiens
ccctcccacggcgcgacc

SEQ ID NO: 43343 - DNA, 19 bp, Homo sapiens
ccctcccacggcgcgaccg

SEQ ID NO: 43344 - DNA, 20 bp, Homo sapiens
ccctcccacggcgcgaccgc

SEQ ID NO: 43345 - DNA, 22 bp, Homo sapiens
ccctcccacggcgcgaccgctc

SEQ ID NO: 43346 - DNA, 17 bp, Homo sapiens
cctcccacggcgcgacc

SEQ ID NO: 43347 - DNA, 18 bp, Homo sapiens
cctcccacggcgcgaccg

SEQ ID NO: 43348 - DNA, 19 bp, Homo sapiens
cctcccacggcgcgaccgc

SEQ ID NO: 43349 - DNA, 20 bp, Homo sapiens
cctcccacggcgcgaccgct

SEQ ID NO: 43350 - DNA, 21 bp, Homo sapiens
cctcccacggcgcgaccgctc

SEQ ID NO: 43351 - DNA, 22 bp, Homo sapiens
cctcccacggcgcgaccgctct

SEQ ID NO: 43352 - DNA, 23 bp, Homo sapiens
cctcccacggcgcgaccgctctc

SEQ ID NO: 43353 - DNA, 24 bp, Homo sapiens
cctcccacggcgcgaccgctctcc

SEQ ID NO: 43354 - DNA, 25 bp, Homo sapiens
cctcccacggcgcgaccgctctccc

SEQ ID NO: 43355 - DNA, 16 bp, Homo sapiens
ctcccacggcgcgacc

SEQ ID NO: 43356 - DNA, 18 bp, Homo sapiens
ctcccacggcgcgaccgc

SEQ ID NO: 43357 - DNA, 19 bp, Homo sapiens
ctcccacggcgcgaccgct

SEQ ID NO: 43358 - DNA, 20 bp, Homo sapiens
ctcccacggcgcgaccgctc

SEQ ID NO: 43359 - DNA, 21 bp, Homo sapiens
ctcccacggcgcgaccgctct

SEQ ID NO: 43360 - DNA, 22 bp, Homo sapiens
ctcccacggcgcgaccgctctc

SEQ ID NO: 43361 - DNA, 23 bp, Homo sapiens
ctcccacggcgcgaccgctctcc

SEQ ID NO: 43362 - DNA, 24 bp, Homo sapiens
ctcccacggcgcgaccgctctccc

SEQ ID NO: 43363 - DNA, 18 bp, Homo sapiens
cggcgcgaccgctctccc

SEQ ID NO: 43364 - DNA, 22 bp, Homo sapiens
cggcgcgaccgctctcccaccc

SEQ ID NO: 43365 - DNA, 23 bp, Homo sapiens
cggcgcgaccgctctcccacccc

SEQ ID NO: 43366 - DNA, 25 bp, Homo sapiens
cggcgcgaccgctctcccacccctc

SEQ ID NO: 43367 - DNA, 26 bp, Homo sapiens
cggcgcgaccgctctcccacccctcc

SEQ ID NO: 43368 - DNA, 30 bp, Homo sapiens; identical to SEQ ID NO: 19945

SEQ ID NO: 43369 - DNA, 21 bp, Homo sapiens
ggcgcgaccgctctcccaccc

SEQ ID NO: 43370 - DNA, 22 bp, Homo sapiens
ggcgcgaccgctctcccacccc

SEQ ID NO: 43371 - DNA, 23 bp, Homo sapiens
ggcgcgaccgctctcccacccct

SEQ ID NO: 43372 - DNA, 24 bp, Homo sapiens
ggcgcgaccgctctcccacccctc

SEQ ID NO: 43373 - DNA, 25 bp, Homo sapiens
ggcgcgaccgctctcccacccctcc

SEQ ID NO: 43374 - DNA, 28 bp, Homo sapiens
ggcgcgaccgctctcccacccctcctcc

SEQ ID NO: 43375 - DNA, 29 bp, Homo sapiens
ggcgcgaccgctctcccacccctcctccc

SEQ ID NO: 43376 - DNA, 30 bp, Homo sapiens
ggcgcgaccgctctcccacccctcctcccc

SEQ ID NO: 43377 - DNA, 19 bp, Homo sapiens
gcgcgaccgctctcccacc

SEQ ID NO: 43378 - DNA, 24 bp, Homo sapiens
gcgcgaccgctctcccacccctcc

SEQ ID NO: 43379 - DNA, 19 bp, Homo sapiens
cgcgaccgctctcccaccc

SEQ ID NO: 43380 - DNA, 20 bp, Homo sapiens
cgcgaccgctctcccacccc

SEQ ID NO: 43381 - DNA, 23 bp, Homo sapiens
gctctcccacccctcctccccgc

SEQ ID NO: 43382 - DNA, 19 bp, Homo sapiens
ctcccacccctcctccccg

SEQ ID NO: 43383 - DNA, 20 bp, Homo sapiens
ctcccacccctcctccccgc

SEQ ID NO: 43384 - DNA, 21 bp, Homo sapiens
ctcccacccctcctccccgcg

SEQ ID NO: 43385 - DNA, 22 bp, Homo sapiens
ctcccacccctcctccccgcgc

SEQ ID NO: 43386 - DNA, 23 bp, Homo sapiens
ctcccacccctcctccccgcgcc

SEQ ID NO: 43387 - DNA, 18 bp, Homo sapiens
tcccacccctcctccccg

SEQ ID NO: 43388 - DNA, 19 bp, Homo sapiens
tcccacccctcctccccgc

SEQ ID NO: 43389 - DNA, 20 bp, Homo sapiens
tcccacccctcctccccgcg

SEQ ID NO: 43390 - DNA, 21 bp, Homo sapiens
tcccacccctcctccccgcgc

SEQ ID NO: 43391 - DNA, 22 bp, Homo sapiens
tcccacccctcctccccgcgcc

SEQ ID NO: 43392 - DNA, 23 bp, Homo sapiens
tcccacccctcctccccgcgccc

SEQ ID NO: 43393 - DNA, 17 bp, Homo sapiens
cccacccctcctccccg

SEQ ID NO: 43394 - DNA, 18 bp, Homo sapiens
cccacccctcctccccgc

SEQ ID NO: 43395 - DNA, 19 bp, Homo sapiens
cccacccctcctccccgcg

SEQ ID NO: 43396 - DNA, 20 bp, Homo sapiens
cccacccctcctccccgcgc

SEQ ID NO: 43397 - DNA, 21 bp, Homo sapiens
cccacccctcctccccgcgcc

SEQ ID NO: 43398 - DNA, 22 bp, Homo sapiens
cccacccctcctccccgcgccc

SEQ ID NO: 43399 - DNA, 23 bp, Homo sapiens
cccacccctcctccccgcgcccc

SEQ ID NO: 43400 - DNA, 16 bp, Homo sapiens
ccacccctcctccccg

SEQ ID NO: 43401 - DNA, 17 bp, Homo sapiens
ccacccctcctccccgc

SEQ ID NO: 43402 - DNA, 18 bp, Homo sapiens
ccacccctcctccccgcg

SEQ ID NO: 43403 - DNA, 19 bp, Homo sapiens
ccacccctcctccccgcgc

SEQ ID NO: 43404 - DNA, 20 bp, Homo sapiens
ccacccctcctccccgcgcc

SEQ ID NO: 43405 - DNA, 21 bp, Homo sapiens
ccacccctcctccccgcgccc

SEQ ID NO: 43406 - DNA, 22 bp, Homo sapiens
ccacccctcctccccgcgcccc

SEQ ID NO: 43407 - DNA, 25 bp, Homo sapiens
ccacccctcctccccgcgcccccgc

SEQ ID NO: 43408 - DNA, 16 bp, Homo sapiens
cacccctcctccccgc

SEQ ID NO: 43409 - DNA, 17 bp, Homo sapiens
cacccctcctccccgcg

SEQ ID NO: 43410 - DNA, 18 bp, Homo sapiens
cacccctcctccccgcgc

SEQ ID NO: 43411 - DNA, 19 bp, Homo sapiens
cacccctcctccccgcgcc

SEQ ID NO: 43412 - DNA, 20 bp, Homo sapiens
cacccctcctccccgcgccc

SEQ ID NO: 43413 - DNA, 21 bp, Homo sapiens
cacccctcctccccgcgcccc

SEQ ID NO: 43414 - DNA, 22 bp, Homo sapiens
cacccctcctccccgcgccccc

SEQ ID NO: 43415 - DNA, 23 bp, Homo sapiens
cacccctcctccccgcgcccccg

SEQ ID NO: 43416 - DNA, 24 bp, Homo sapiens
cacccctcctccccgcgcccccgc

SEQ ID NO: 43417 - DNA, 25 bp, Homo sapiens
cacccctcctccccgcgcccccgcc

SEQ ID NO: 43418 - DNA, 16 bp, Homo sapiens
acccctcctccccgcg

SEQ ID NO: 43419 - DNA, 17 bp, Homo sapiens
acccctcctccccgcgc

SEQ ID NO: 43420 - DNA, 18 bp, Homo sapiens
acccctcctccccgcgcc

SEQ ID NO: 43421 - DNA, 19 bp, Homo sapiens
acccctcctccccgcgccc

SEQ ID NO: 43422 - DNA, 20 bp, Homo sapiens
acccctcctccccgcgcccc

SEQ ID NO: 43423 - DNA, 21 bp, Homo sapiens
acccctcctccccgcgccccc

SEQ ID NO: 43424 - DNA, 22 bp, Homo sapiens
acccctcctccccgcgcccccg

SEQ ID NO: 43425 - DNA, 23 bp, Homo sapiens
acccctcctccccgcgcccccgc

SEQ ID NO: 43426 - DNA, 24 bp, Homo sapiens
acccctcctccccgcgcccccgcc

SEQ ID NO: 43427 - DNA, 16 bp, Homo sapiens
cccctcctccccgcgc

SEQ ID NO: 43428 - DNA, 17 bp, Homo sapiens
cccctcctccccgcgcc

SEQ ID NO: 43429 - DNA, 18 bp, Homo sapiens
cccctcctccccgcgccc

SEQ ID NO: 43430 - DNA, 19 bp, Homo sapiens
cccctcctccccgcgcccc

SEQ ID NO: 43431 - DNA, 20 bp, Homo sapiens
cccctcctccccgcgccccc

SEQ ID NO: 43432 - DNA, 21 bp, Homo sapiens
cccctcctccccgcgcccccg

SEQ ID NO: 43433 - DNA, 22 bp, Homo sapiens
cccctcctccccgcgcccccgc

SEQ ID NO: 43434 - DNA, 23 bp, Homo sapiens
cccctcctccccgcgcccccgcc

SEQ ID NO: 43435 - DNA, 24 bp, Homo sapiens
cccctcctccccgcgcccccgccc

SEQ ID NO: 43436 - DNA, 25 bp, Homo sapiens
cccctcctccccgcgcccccgcccc

SEQ ID NO: 43437 - DNA, 26 bp, Homo sapiens
cccctcctccccgcgcccccgccccg

SEQ ID NO: 43438 - DNA, 16 bp, Homo sapiens
ccctcctccccgcgcc

SEQ ID NO: 43439 - DNA, 17 bp, Homo sapiens
ccctcctccccgcgccc

SEQ ID NO: 43440 - DNA, 18 bp, Homo sapiens
ccctcctccccgcgcccc

SEQ ID NO: 43441 - DNA, 19 bp, Homo sapiens
ccctcctccccgcgccccc

SEQ ID NO: 43442 - DNA, 20 bp, Homo sapiens
ccctcctccccgcgcccccg

SEQ ID NO: 43443 - DNA, 21 bp, Homo sapiens
ccctcctccccgcgcccccgc

SEQ ID NO: 43444 - DNA, 22 bp, Homo sapiens
ccctcctccccgcgcccccgcc

SEQ ID NO: 43445 - DNA, 23 bp, Homo sapiens
ccctcctccccgcgcccccgccc

SEQ ID NO: 43446 - DNA, 24 bp, Homo sapiens
ccctcctccccgcgcccccgcccc

SEQ ID NO: 43447 - DNA, 25 bp, Homo sapiens
ccctcctccccgcgcccccgccccg

SEQ ID NO: 43448 - DNA, 26 bp, Homo sapiens
ccctcctccccgcgcccccgccccgg

SEQ ID NO: 43449 - DNA, 19 bp, Homo sapiens
cctcctccccgcgcccccg

SEQ ID NO: 43450 - DNA, 20 bp, Homo sapiens
cctcctccccgcgcccccgc

SEQ ID NO: 43451 - DNA, 21 bp, Homo sapiens
cctcctccccgcgcccccgcc

SEQ ID NO: 43452 - DNA, 22 bp, Homo sapiens
cctcctccccgcgcccccgccc

SEQ ID NO: 43453 - DNA, 23 bp, Homo sapiens
cctcctccccgcgcccccgcccc

SEQ ID NO: 43454 - DNA, 25 bp, Homo sapiens
cctcctccccgcgcccccgccccgg

SEQ ID NO: 43455 - DNA, 26 bp, Homo sapiens
cctcctccccgcgcccccgccccggc

SEQ ID NO: 43456 - DNA, 19 bp, Homo sapiens
ctcctccccgcgcccccgc

SEQ ID NO: 43457 - DNA, 20 bp, Homo sapiens
ctcctccccgcgcccccgcc

SEQ ID NO: 43458 - DNA, 21 bp, Homo sapiens
ctcctccccgcgcccccgccc

SEQ ID NO: 43459 - DNA, 22 bp, Homo sapiens
ctcctccccgcgcccccgcccc

SEQ ID NO: 43460 - DNA, 23 bp, Homo sapiens
ctcctccccgcgcccccgccccg

SEQ ID NO: 43461 - DNA, 19 bp, Homo sapiens
tcctccccgcgcccccgcc

SEQ ID NO: 43462 - DNA, 20 bp, Homo sapiens
tcctccccgcgcccccgccc

SEQ ID NO: 43463 - DNA, 18 bp, Homo sapiens
cctccccgcgcccccgcc

SEQ ID NO: 43464 - DNA, 19 bp, Homo sapiens
cctccccgcgcccccgccc

SEQ ID NO: 43465 - DNA, 20 bp, Homo sapiens
cctccccgcgcccccgcccc

SEQ ID NO: 43466 - DNA, 21 bp, Homo sapiens
cctccccgcgcccccgccccg

SEQ ID NO: 43467 - DNA, 22 bp, Homo sapiens
cctccccgcgcccccgccccgg

SEQ ID NO: 43468 - DNA, 23 bp, Homo sapiens
cctccccgcgcccccgccccggc

SEQ ID NO: 43469 - DNA, 21 bp, Homo sapiens
ctccccgcgcccccgccccgg

SEQ ID NO: 43470 - DNA, 22 bp, Homo sapiens
ctccccgcgcccccgccccggc

SEQ ID NO: 43471 - DNA, 21 bp, Homo sapiens
tccccgcgcccccgccccggc

SEQ ID NO: 43472 - DNA, 18 bp, Homo sapiens
ccccgcgcccccgccccg

SEQ ID NO: 43473 - DNA, 19 bp, Homo sapiens
ccccgcgcccccgccccgg

SEQ ID NO: 43474 - DNA, 20 bp, Homo sapiens
ccccgcgcccccgccccggc

SEQ ID NO: 43475 - DNA, 21 bp, Homo sapiens
ccccgcgcccccgccccggcg

SEQ ID NO: 43476 - DNA, 16 bp, Homo sapiens
cccgcgcccccgcccc

SEQ ID NO: 43477 - DNA, 17 bp, Homo sapiens
cccgcgcccccgccccg

SEQ ID NO: 43478 - DNA, 18 bp, Homo sapiens
cccgcgcccccgccccgg

SEQ ID NO: 43479 - DNA, 19 bp, Homo sapiens
cccgcgcccccgccccggc

SEQ ID NO: 43480 - DNA, 20 bp, Homo sapiens
cccgcgcccccgccccggcg

SEQ ID NO: 43481 - DNA, 21 bp, Homo sapiens
cccgcgcccccgccccggcga

SEQ ID NO: 43482 - DNA, 17 bp, Homo sapiens
ccgcgcccccgccccgg

SEQ ID NO: 43483 - DNA, 18 bp, Homo sapiens
ccgcgcccccgccccggc

SEQ ID NO: 43484 - DNA, 22 bp, Homo sapiens
ccgcgcccccgccccggcgacg

SEQ ID NO: 43485 - DNA, 23 bp, Homo sapiens
ccgcgcccccgccccggcgacgg

SEQ ID NO: 43486 - DNA, 17 bp, Homo sapiens
cgcgcccccgccccggc

SEQ ID NO: 43487 - DNA, 16 bp, Homo sapiens
gcgcccccgccccggc

SEQ ID NO: 43488 - DNA, 21 bp, Homo sapiens
gcgcccccgccccggcgacgg

SEQ ID NO: 43489 - DNA, 19 bp, Homo sapiens
gccccggcgacgggggggg

SEQ ID NO: 43490 - DNA, 22 bp, Homo sapiens
gccccggcgacggggggggtgc

SEQ ID NO: 43491 - DNA, 23 bp, Homo sapiens
gccccggcgacggggggggtgcc

SEQ ID NO: 43492 - DNA, 23 bp, Homo sapiens
ccccggcgacggggggggtgccg

SEQ ID NO: 43493 - DNA, 18 bp, Homo sapiens
ccggcgacggggggggtg

SEQ ID NO: 43494 - DNA, 19 bp, Homo sapiens
ccggcgacggggggggtgc

SEQ ID NO: 43495 - DNA, 22 bp, Homo sapiens
ccggcgacggggggggtgccgc

SEQ ID NO: 43496 - DNA, 17 bp, Homo sapiens
cggcgacggggggggtg

SEQ ID NO: 43497 - DNA, 16 bp, Homo sapiens
ggcgacggggggggtg

SEQ ID NO: 43498 - DNA, 17 bp, Homo sapiens
ggcgacggggggggtgc

SEQ ID NO: 43499 - DNA, 18 bp, Homo sapiens
ggcgacggggggggtgcc

SEQ ID NO: 43500 - DNA, 16 bp, Homo sapiens
gcgacggggggggtgc

SEQ ID NO: 43501 - DNA, 21 bp, Homo sapiens
acggggggggtgccgcgcgcg

SEQ ID NO: 43502 - DNA, 19 bp, Homo sapiens
ggggggggtgccgcgcgcg

SEQ ID NO: 43503 - DNA, 21 bp, Homo sapiens
ggggggggtgccgcgcgcggg

SEQ ID NO: 43504 - DNA, 18 bp, Homo sapiens
gggggggtgccgcgcgcg

SEQ ID NO: 43505 - DNA, 19 bp, Homo sapiens
gggggggtgccgcgcgcgg

SEQ ID NO: 43506 - DNA, 20 bp, Homo sapiens
gggggggtgccgcgcgcggg

SEQ ID NO: 43507 - DNA, 21 bp, Homo sapiens
gggggggtgccgcgcgcgggt

SEQ ID NO: 43508 - DNA, 22 bp, Homo sapiens
gggggggtgccgcgcgcgggtc

SEQ ID NO: 43509 - DNA, 19 bp, Homo sapiens
ggggggtgccgcgcgcggg

SEQ ID NO: 43510 - DNA, 18 bp, Homo sapiens
ggtgccgcgcgcgggtcg

SEQ ID NO: 43511 - DNA, 19 bp, Homo sapiens
ggtgccgcgcgcgggtcgg

SEQ ID NO: 43512 - DNA, 20 bp, Homo sapiens
ggtgccgcgcgcgggtcggg

SEQ ID NO: 43513 - DNA, 24 bp, Homo sapiens
ggtgccgcgcgcgggtcggggggc

SEQ ID NO: 43514 - DNA, 16 bp, Homo sapiens
gtgccgcgcgcgggtc

SEQ ID NO: 43515 - DNA, 18 bp, Homo sapiens
gtgccgcgcgcgggtcgg

SEQ ID NO: 43516 - DNA, 28 bp, Homo sapiens
gtgccgcgcgcgggtcggggggcggggc

SEQ ID NO: 43517 - DNA, 20 bp, Homo sapiens
gccgcgcgcgggtcgggggg

SEQ ID NO: 43518 - DNA, 22 bp, Homo sapiens
gccgcgcgcgggtcggggggcg

SEQ ID NO: 43519 - DNA, 24 bp, Homo sapiens
ccgcgcgcgggtcggggggcgggg

SEQ ID NO: 43520 - DNA, 25 bp, Homo sapiens
ccgcgcgcgggtcggggggcggggc

SEQ ID NO: 43521 - DNA, 16 bp, Homo sapiens
cgcgcgcgggtcgggg

SEQ ID NO: 43522 - DNA, 17 bp, Homo sapiens
cgcgcgcgggtcggggg

SEQ ID NO: 43523 - DNA, 18 bp, Homo sapiens
cgcgcgcgggtcgggggg

SEQ ID NO: 43524 - DNA, 19 bp, Homo sapiens
cgcgcgcgggtcggggggc

SEQ ID NO: 43525 - DNA, 20 bp, Homo sapiens
cgcgcgcgggtcggggggcg

SEQ ID NO: 43526 - DNA, 21 bp, Homo sapiens
cgcgcgcgggtcggggggcgg

SEQ ID NO: 43527 - DNA, 22 bp, Homo sapiens
cgcgcgcgggtcggggggcggg

SEQ ID NO: 43528 - DNA, 23 bp, Homo sapiens
cgcgcgcgggtcggggggcgggg

SEQ ID NO: 43529 - DNA, 24 bp, Homo sapiens
cgcgcgcgggtcggggggcggggc

SEQ ID NO: 43530 - DNA, 25 bp, Homo sapiens
cgcgcgcgggtcggggggcggggcg

SEQ ID NO: 43531 - DNA, 26 bp, Homo sapiens
cgcgcgcgggtcggggggcggggcgg

SEQ ID NO: 43532 - DNA, 27 bp, Homo sapiens
cgcgcgcgggtcggggggcggggcgga

SEQ ID NO: 43533 - DNA, 30 bp, Homo sapiens
cgcgcgcgggtcggggggcggggcggactg

SEQ ID NO: 43534 - DNA, 16 bp, Homo sapiens
gcgcgcgggtcggggg

SEQ ID NO: 43535 - DNA, 17 bp, Homo sapiens
gcgcgcgggtcgggggg

SEQ ID NO: 43536 - DNA, 18 bp, Homo sapiens
gcgcgcgggtcggggggc

SEQ ID NO: 43537 - DNA, 19 bp, Homo sapiens
gcgcgcgggtcggggggcg

SEQ ID NO: 43538 - DNA, 20 bp, Homo sapiens
gcgcgcgggtcggggggcgg

SEQ ID NO: 43539 - DNA, 21 bp, Homo sapiens
gcgcgcgggtcggggggcggg

SEQ ID NO: 43540 - DNA, 22 bp, Homo sapiens
gcgcgcgggtcggggggcgggg

SEQ ID NO: 43541 - DNA, 23 bp, Homo sapiens
gcgcgcgggtcggggggcggggc

SEQ ID NO: 43542 - DNA, 24 bp, Homo sapiens
gcgcgcgggtcggggggcggggcg

SEQ ID NO: 43543 - DNA, 25 bp, Homo sapiens
gcgcgcgggtcggggggcggggcgg

SEQ ID NO: 43544 - DNA, 26 bp, Homo sapiens
gcgcgcgggtcggggggcggggcgga

SEQ ID NO: 43545 - DNA, 27 bp, Homo sapiens
gcgcgcgggtcggggggcggggcggac

SEQ ID NO: 43546 - DNA, 28 bp, Homo sapiens
gcgcgcgggtcggggggcggggcggact

SEQ ID NO: 43547 - DNA, 29 bp, Homo sapiens
gcgcgcgggtcggggggcggggcggactg

SEQ ID NO: 43548 - DNA, 30 bp, Homo sapiens; identical to SEQ ID NO: 19963

SEQ ID NO: 43549 - DNA, 16 bp, Homo sapiens
cgcgcgggtcgggggg

SEQ ID NO: 43550 - DNA, 18 bp, Homo sapiens
cgcgcgggtcggggggcg

SEQ ID NO: 43551 - DNA, 19 bp, Homo sapiens
cgcgcgggtcggggggcgg

SEQ ID NO: 43552 - DNA, 20 bp, Homo sapiens
cgcgcgggtcggggggcggg

SEQ ID NO: 43553 - DNA, 21 bp, Homo sapiens
cgcgcgggtcggggggcgggg

SEQ ID NO: 43554 - DNA, 22 bp, Homo sapiens
cgcgcgggtcggggggcggggc

SEQ ID NO: 43555 - DNA, 23 bp, Homo sapiens
cgcgcgggtcggggggcggggcg

SEQ ID NO: 43556 - DNA, 24 bp, Homo sapiens
cgcgcgggtcggggggcggggcgg

SEQ ID NO: 43557 - DNA, 25 bp, Homo sapiens
cgcgcgggtcggggggcggggcgga

SEQ ID NO: 43558 - DNA, 28 bp, Homo sapiens
cgcgcgggtcggggggcggggcggactg

SEQ ID NO: 43559 - DNA, 29 bp, Homo sapiens
cgcgcgggtcggggggcggggcggactgt

SEQ ID NO: 43560 - DNA, 30 bp, Homo sapiens; identical to SEQ ID NO: 19968

SEQ ID NO: 43561 - DNA, 16 bp, Homo sapiens
gcgcgggtcggggggc

SEQ ID NO: 43562 - DNA, 17 bp, Homo sapiens
gcgcgggtcggggggcg

SEQ ID NO: 43563 - DNA, 18 bp, Homo sapiens
gcgcgggtcggggggcgg

SEQ ID NO: 43564 - DNA, 19 bp, Homo sapiens
gcgcgggtcggggggcggg

SEQ ID NO: 43565 - DNA, 20 bp, Homo sapiens
gcgcgggtcggggggcgggg

SEQ ID NO: 43566 - DNA, 21 bp, Homo sapiens
gcgcgggtcggggggcggggc

SEQ ID NO: 43567 - DNA, 22 bp, Homo sapiens
gcgcgggtcggggggcggggcg

SEQ ID NO: 43568 - DNA, 23 bp, Homo sapiens
gcgcgggtcggggggcggggcgg

SEQ ID NO: 43569 - DNA, 24 bp, Homo sapiens
gcgcgggtcggggggcggggcgga

SEQ ID NO: 43570 - DNA, 25 bp, Homo sapiens
gcgcgggtcggggggcggggcggac

SEQ ID NO: 43571 - DNA, 26 bp, Homo sapiens
gcgcgggtcggggggcggggcggact

SEQ ID NO: 43572 - DNA, 27 bp, Homo sapiens
gcgcgggtcggggggcggggcggactg

SEQ ID NO: 43573 - DNA, 28 bp, Homo sapiens
gcgcgggtcggggggcggggcggactgt

SEQ ID NO: 43574 - DNA, 29 bp, Homo sapiens
gcgcgggtcggggggcggggcggactgtc

SEQ ID NO: 43575 - DNA, 16 bp, Homo sapiens
cgcgggtcggggggcg

SEQ ID NO: 43576 - DNA, 17 bp, Homo sapiens
cgcgggtcggggggcgg

SEQ ID NO: 43577 - DNA, 18 bp, Homo sapiens
cgcgggtcggggggcggg

SEQ ID NO: 43578 - DNA, 19 bp, Homo sapiens
cgcgggtcggggggcgggg

SEQ ID NO: 43579 - DNA, 20 bp, Homo sapiens
cgcgggtcggggggcggggc

SEQ ID NO: 43580 - DNA, 21 bp, Homo sapiens
cgcgggtcggggggcggggcg

SEQ ID NO: 43581 - DNA, 22 bp, Homo sapiens
cgcgggtcggggggcggggcgg

SEQ ID NO: 43582 - DNA, 23 bp, Homo sapiens
cgcgggtcggggggcggggcgga

SEQ ID NO: 43583 - DNA, 24 bp, Homo sapiens
cgcgggtcggggggcggggcggac

SEQ ID NO: 43584 - DNA, 25 bp, Homo sapiens
cgcgggtcggggggcggggcggact

SEQ ID NO: 43585 - DNA, 26 bp, Homo sapiens
cgcgggtcggggggcggggcggactg

SEQ ID NO: 43586 - DNA, 27 bp, Homo sapiens
cgcgggtcggggggcggggcggactgt

SEQ ID NO: 43587 - DNA, 28 bp, Homo sapiens
cgcgggtcggggggcggggcggactgtc

SEQ ID NO: 43588 - DNA, 30 bp, Homo sapiens; identical to SEQ ID NO: 19969

SEQ ID NO: 43589 - DNA, 17 bp, Homo sapiens
gcgggtcggggggcggg

SEQ ID NO: 43590 - DNA, 18 bp, Homo sapiens
gcgggtcggggggcgggg

SEQ ID NO: 43591 - DNA, 19 bp, Homo sapiens
gcgggtcggggggcggggc

SEQ ID NO: 43592 - DNA, 20 bp, Homo sapiens
gcgggtcggggggcggggcg

SEQ ID NO: 43593 - DNA, 21 bp, Homo sapiens
gcgggtcggggggcggggcgg

SEQ ID NO: 43594 - DNA, 22 bp, Homo sapiens
gcgggtcggggggcggggcgga

SEQ ID NO: 43595 - DNA, 23 bp, Homo sapiens
gcgggtcggggggcggggcggac

SEQ ID NO: 43596 - DNA, 24 bp, Homo sapiens
gcgggtcggggggcggggcggact

SEQ ID NO: 43597 - DNA, 25 bp, Homo sapiens
gcgggtcggggggcggggcggactg

SEQ ID NO: 43598 - DNA, 26 bp, Homo sapiens
gcgggtcggggggcggggcggactgt

SEQ ID NO: 43599 - DNA, 27 bp, Homo sapiens
gcgggtcggggggcggggcggactgtc

SEQ ID NO: 43600 - DNA, 28 bp, Homo sapiens
gcgggtcggggggcggggcggactgtcc

SEQ ID NO: 43601 - DNA, 16 bp, Homo sapiens
cgggtcggggggcggg

SEQ ID NO: 43602 - DNA, 17 bp, Homo sapiens
cgggtcggggggcgggg

SEQ ID NO: 43603 - DNA, 18 bp, Homo sapiens
cgggtcggggggcggggc

SEQ ID NO: 43604 - DNA, 19 bp, Homo sapiens
cgggtcggggggcggggcg

SEQ ID NO: 43605 - DNA, 20 bp, Homo sapiens
cgggtcggggggcggggcgg

SEQ ID NO: 43606 - DNA, 21 bp, Homo sapiens
cgggtcggggggcggggcgga

SEQ ID NO: 43607 - DNA, 23 bp, Homo sapiens
cgggtcggggggcggggcggact

SEQ ID NO: 43608 - DNA, 25 bp, Homo sapiens
cgggtcggggggcggggcggactgt

SEQ ID NO: 43609 - DNA, 26 bp, Homo sapiens
cgggtcggggggcggggcggactgtc

SEQ ID NO: 43610 - DNA, 17 bp, Homo sapiens
gggtcggggggcggggc

SEQ ID NO: 43611 - DNA, 19 bp, Homo sapiens
gggtcggggggcggggcgg

SEQ ID NO: 43612 - DNA, 20 bp, Homo sapiens
gggtcggggggcggggcgga

SEQ ID NO: 43613 - DNA, 21 bp, Homo sapiens
gggtcggggggcggggcggac

SEQ ID NO: 43614 - DNA, 24 bp, Homo sapiens
gggtcggggggcggggcggactgt

SEQ ID NO: 43615 - DNA, 16 bp, Homo sapiens
ggtcggggggcggggc

SEQ ID NO: 43616 - DNA, 17 bp, Homo sapiens
ggtcggggggcggggcg

SEQ ID NO: 43617 - DNA, 18 bp, Homo sapiens
ggtcggggggcggggcgg

SEQ ID NO: 43618 - DNA, 19 bp, Homo sapiens
ggtcggggggcggggcgga

SEQ ID NO: 43619 - DNA, 20 bp, Homo sapiens
ggtcggggggcggggcggac

SEQ ID NO: 43620 - DNA, 21 bp, Homo sapiens
ggtcggggggcggggcggact

SEQ ID NO: 43621 - DNA, 22 bp, Homo sapiens
ggtcggggggcggggcggactg

SEQ ID NO: 43622 - DNA, 23 bp, Homo sapiens
ggtcggggggcggggcggactgt

SEQ ID NO: 43623 - DNA, 24 bp, Homo sapiens
ggtcggggggcggggcggactgtc

SEQ ID NO: 43624 - DNA, 25 bp, Homo sapiens
ggtcggggggcggggcggactgtcc

SEQ ID NO: 43625 - DNA, 26 bp, Homo sapiens
ggtcggggggcggggcggactgtccc

SEQ ID NO: 43626 - DNA, 21 bp, Homo sapiens
gtcggggggcggggcggactg

SEQ ID NO: 43627 - DNA, 22 bp, Homo sapiens
gtcggggggcggggcggactgt

SEQ ID NO: 43628 - DNA, 23 bp, Homo sapiens
gtcggggggcggggcggactgtc

SEQ ID NO: 43629 - DNA, 21 bp, Homo sapiens
tcggggggcggggcggactgt

SEQ ID NO: 43630 - DNA, 16 bp, Homo sapiens
cggggggcggggcgga

SEQ ID NO: 43631 - DNA, 19 bp, Homo sapiens
cggggggcggggcggactg

SEQ ID NO: 43632 - DNA, 20 bp, Homo sapiens
cggggggcggggcggactgt

SEQ ID NO: 43633 - DNA, 19 bp, Homo sapiens
ggggggcggggcggactgt

SEQ ID NO: 43634 - DNA, 20 bp, Homo sapiens
ggggggcggggcggactgtc

SEQ ID NO: 43635 - DNA, 18 bp, Homo sapiens
gggggcggggcggactgt

SEQ ID NO: 43636 - DNA, 19 bp, Homo sapiens
gggggcggggcggactgtc

SEQ ID NO: 43637 - DNA, 17 bp, Homo sapiens
ggggcggggcggactgt

SEQ ID NO: 43638 - DNA, 16 bp, Homo sapiens
gggcggggcggactgt

SEQ ID NO: 43639 - DNA, 17 bp, Homo sapiens
gggcggggcggactgtc

SEQ ID NO: 43640 - DNA, 18 bp, Homo sapiens
gggcggggcggactgtcc

SEQ ID NO: 43641 - DNA, 16 bp, Homo sapiens
ggcggggcggactgtc

SEQ ID NO: 43642 - DNA, 17 bp, Homo sapiens
ggcggggcggactgtcc

SEQ ID NO: 43643 - DNA, 16 bp, Homo sapiens
gcggggcggactgtcc

SEQ ID NO: 43644 - DNA, 20 bp, Homo sapiens
ggcggactgtccccagtgcg

SEQ ID NO: 43645 - DNA, 17 bp, Homo sapiens
gcggactgtccccagtg

SEQ ID NO: 43646 - DNA, 18 bp, Homo sapiens
gcggactgtccccagtgc

SEQ ID NO: 43647 - DNA, 19 bp, Homo sapiens
gcggactgtccccagtgcg

SEQ ID NO: 43648 - DNA, 17 bp, Homo sapiens
cggactgtccccagtgc

SEQ ID NO: 43649 - DNA, 19 bp, Homo sapiens
cggactgtccccagtgcgc

SEQ ID NO: 43650 - DNA, 20 bp, Homo sapiens
cggactgtccccagtgcgcc

SEQ ID NO: 43651 - DNA, 21 bp, Homo sapiens
cggactgtccccagtgcgccc

SEQ ID NO: 43652 - DNA, 22 bp, Homo sapiens
cggactgtccccagtgcgcccc

SEQ ID NO: 43653 - DNA, 16 bp, Homo sapiens
ggactgtccccagtgc

SEQ ID NO: 43654 - DNA, 18 bp, Homo sapiens
ggactgtccccagtgcgc

SEQ ID NO: 43655 - DNA, 19 bp, Homo sapiens
ggactgtccccagtgcgcc

SEQ ID NO: 43656 - DNA, 20 bp, Homo sapiens
ggactgtccccagtgcgccc

SEQ ID NO: 43657 - DNA, 21 bp, Homo sapiens
ggactgtccccagtgcgcccc

SEQ ID NO: 43658 - DNA, 22 bp, Homo sapiens
gactgtccccagtgcgccccgg

SEQ ID NO: 43659 - DNA, 21 bp, Homo sapiens
actgtccccagtgcgccccgg

SEQ ID NO: 43660 - DNA, 17 bp, Homo sapiens
ctgtccccagtgcgccc

SEQ ID NO: 43661 - DNA, 20 bp, Homo sapiens
ctgtccccagtgcgccccgg

SEQ ID NO: 43662 - DNA, 19 bp, Homo sapiens
tgtccccagtgcgccccgg

SEQ ID NO: 43663 - DNA, 18 bp, Homo sapiens
gtccccagtgcgccccgg

SEQ ID NO: 43664 - DNA, 17 bp, Homo sapiens
tccccagtgcgccccgg

SEQ ID NO: 43665 - DNA, 21 bp, Homo sapiens
tccccagtgcgccccgggcgg

SEQ ID NO: 43666 - DNA, 22 bp, Homo sapiens
tccccagtgcgccccgggcggg

SEQ ID NO: 43667 - DNA, 16 bp, Homo sapiens
ccccagtgcgccccgg

SEQ ID NO: 43668 - DNA, 20 bp, Homo sapiens
ccccagtgcgccccgggcgg

SEQ ID NO: 43669 - DNA, 21 bp, Homo sapiens
ccccagtgcgccccgggcggg

SEQ ID NO: 43670 - DNA, 22 bp, Homo sapiens
ccccagtgcgccccgggcgggt

SEQ ID NO: 43671 - DNA, 16 bp, Homo sapiens
ccagtgcgccccgggc

SEQ ID NO: 43672 - DNA, 30 bp, Homo sapiens
ccagtgcgccccgggcgggtcgcgccgtcg

SEQ ID NO: 43673 - DNA, 20 bp, Homo sapiens
cagtgcgccccgggcgggtc

SEQ ID NO: 43674 - DNA, 30 bp, Homo sapiens; identical to SEQ ID NO: 20009

SEQ ID NO: 43675 - DNA, 19 bp, Homo sapiens
agtgcgccccgggcgggtc

SEQ ID NO: 43676 - DNA, 20 bp, Homo sapiens
agtgcgccccgggcgggtcg

SEQ ID NO: 43677 - DNA, 29 bp, Homo sapiens
agtgcgccccgggcgggtcgcgccgtcgg

SEQ ID NO: 43678 - DNA, 30 bp, Homo sapiens; identical to SEQ ID NO: 20020

SEQ ID NO: 43679 - DNA, 19 bp, Homo sapiens
cgccccgggcgggtcgcgc

SEQ ID NO: 43680 - DNA, 20 bp, Homo sapiens
cgccccgggcgggtcgcgcc

SEQ ID NO: 43681 - DNA, 21 bp, Homo sapiens
cgccccgggcgggtcgcgccg

SEQ ID NO: 43682 - DNA, 22 bp, Homo sapiens
cgccccgggcgggtcgcgccgt

SEQ ID NO: 43683 - DNA, 25 bp, Homo sapiens
cgccccgggcgggtcgcgccgtcgg

SEQ ID NO: 43684 - DNA, 18 bp, Homo sapiens
gccccgggcgggtcgcgc

SEQ ID NO: 43685 - DNA, 19 bp, Homo sapiens
gccccgggcgggtcgcgcc

SEQ ID NO: 43686 - DNA, 20 bp, Homo sapiens
gccccgggcgggtcgcgccg

SEQ ID NO: 43687 - DNA, 21 bp, Homo sapiens
gccccgggcgggtcgcgccgt

SEQ ID NO: 43688 - DNA, 24 bp, Homo sapiens
gccccgggcgggtcgcgccgtcgg

SEQ ID NO: 43689 - DNA, 17 bp, Homo sapiens
ccccgggcgggtcgcgc

SEQ ID NO: 43690 - DNA, 18 bp, Homo sapiens
ccccgggcgggtcgcgcc

SEQ ID NO: 43691 - DNA, 23 bp, Homo sapiens
ccccgggcgggtcgcgccgtcgg

SEQ ID NO: 43692 - DNA, 16 bp, Homo sapiens
cccgggcgggtcgcgc

SEQ ID NO: 43693 - DNA, 17 bp, Homo sapiens
cccgggcgggtcgcgcc

SEQ ID NO: 43694 - DNA, 22 bp, Homo sapiens
cccgggcgggtcgcgccgtcgg

SEQ ID NO: 43695 - DNA, 22 bp, Homo sapiens
ccgggcgggtcgcgccgtcggg

SEQ ID NO: 43696 - DNA, 20 bp, Homo sapiens
cgggcgggtcgcgccgtcgg

SEQ ID NO: 43697 - DNA, 21 bp, Homo sapiens
cgggcgggtcgcgccgtcggg

SEQ ID NO: 43698 - DNA, 22 bp, Homo sapiens
cgggcgggtcgcgccgtcgggc

SEQ ID NO: 43699 - DNA, 23 bp, Homo sapiens
cgggcgggtcgcgccgtcgggcc

SEQ ID NO: 43700 - DNA, 27 bp, Homo sapiens
cgggcgggtcgcgccgtcgggcccggg

SEQ ID NO: 43701 - DNA, 28 bp, Homo sapiens
cgggcgggtcgcgccgtcgggcccgggg

SEQ ID NO: 43702 - DNA, 29 bp, Homo sapiens
cgggcgggtcgcgccgtcgggcccggggg

SEQ ID NO: 43703 - DNA, 19 bp, Homo sapiens
gggcgggtcgcgccgtcgg

SEQ ID NO: 43704 - DNA, 20 bp, Homo sapiens
gggcgggtcgcgccgtcggg

SEQ ID NO: 43705 - DNA, 21 bp, Homo sapiens
gggcgggtcgcgccgtcgggc

SEQ ID NO: 43706 - DNA, 22 bp, Homo sapiens
gggcgggtcgcgccgtcgggcc

SEQ ID NO: 43707 - DNA, 26 bp, Homo sapiens
gggcgggtcgcgccgtcgggcccggg

SEQ ID NO: 43708 - DNA, 30 bp, Homo sapiens
gggcgggtcgcgccgtcgggcccgggggag

SEQ ID NO: 43709 - DNA, 19 bp, Homo sapiens
ggcgggtcgcgccgtcggg

SEQ ID NO: 43710 - DNA, 21 bp, Homo sapiens
ggcgggtcgcgccgtcgggcc

SEQ ID NO: 43711 - DNA, 24 bp, Homo sapiens
ggcgggtcgcgccgtcgggcccgg

SEQ ID NO: 43712 - DNA, 25 bp, Homo sapiens
ggcgggtcgcgccgtcgggcccggg

SEQ ID NO: 43713 - DNA, 26 bp, Homo sapiens
ggcgggtcgcgccgtcgggcccgggg

SEQ ID NO: 43714 - DNA, 29 bp, Homo sapiens
ggcgggtcgcgccgtcgggcccgggggag

SEQ ID NO: 43715 - DNA, 30 bp, Homo sapiens
ggcgggtcgcgccgtcgggcccgggggagg

SEQ ID NO: 43716 - DNA, 17 bp, Homo sapiens
gcgggtcgcgccgtcgg

SEQ ID NO: 43717 - DNA, 18 bp, Homo sapiens
gcgggtcgcgccgtcggg

SEQ ID NO: 43718 - DNA, 19 bp, Homo sapiens
gcgggtcgcgccgtcgggc

SEQ ID NO: 43719 - DNA, 20 bp, Homo sapiens
gcgggtcgcgccgtcgggcc

SEQ ID NO: 43720 - DNA, 24 bp, Homo sapiens
gcgggtcgcgccgtcgggcccggg

SEQ ID NO: 43721 - DNA, 25 bp, Homo sapiens
gcgggtcgcgccgtcgggcccgggg

SEQ ID NO: 43722 - DNA, 26 bp, Homo sapiens
gcgggtcgcgccgtcgggcccggggg

SEQ ID NO: 43723 - DNA, 28 bp, Homo sapiens
gcgggtcgcgccgtcgggcccgggggag

SEQ ID NO: 43724 - DNA, 16 bp, Homo sapiens
cgggtcgcgccgtcgg

SEQ ID NO: 43725 - DNA, 17 bp, Homo sapiens
cgggtcgcgccgtcggg

SEQ ID NO: 43726 - DNA, 18 bp, Homo sapiens
cgggtcgcgccgtcgggc

SEQ ID NO: 43727 - DNA, 19 bp, Homo sapiens
cgggtcgcgccgtcgggcc

SEQ ID NO: 43728 - DNA, 23 bp, Homo sapiens
cgggtcgcgccgtcgggcccggg

SEQ ID NO: 43729 - DNA, 24 bp, Homo sapiens
cgggtcgcgccgtcgggcccgggg

SEQ ID NO: 43730 - DNA, 16 bp, Homo sapiens
gggtcgcgccgtcggg

SEQ ID NO: 43731 - DNA, 17 bp, Homo sapiens
gggtcgcgccgtcgggc

SEQ ID NO: 43732 - DNA, 18 bp, Homo sapiens
gggtcgcgccgtcgggcc

SEQ ID NO: 43733 - DNA, 22 bp, Homo sapiens
gggtcgcgccgtcgggcccggg

SEQ ID NO: 43734 - DNA, 23 bp, Homo sapiens
gggtcgcgccgtcgggcccgggg

SEQ ID NO: 43735 - DNA, 24 bp, Homo sapiens
gggtcgcgccgtcgggcccggggg

SEQ ID NO: 43736 - DNA, 25 bp, Homo sapiens
gggtcgcgccgtcgggcccggggga

SEQ ID NO: 43737 - DNA, 26 bp, Homo sapiens
gggtcgcgccgtcgggcccgggggag

SEQ ID NO: 43738 - DNA, 27 bp, Homo sapiens
gggtcgcgccgtcgggcccgggggagg

SEQ ID NO: 43739 - DNA, 28 bp, Homo sapiens
gggtcgcgccgtcgggcccgggggaggt

SEQ ID NO: 43740 - DNA, 16 bp, Homo sapiens
ggtcgcgccgtcgggc

SEQ ID NO: 43741 - DNA, 17 bp, Homo sapiens
ggtcgcgccgtcgggcc

SEQ ID NO: 43742 - DNA, 18 bp, Homo sapiens
ggtcgcgccgtcgggccc

SEQ ID NO: 43743 - DNA, 19 bp, Homo sapiens
ggtcgcgccgtcgggcccg

SEQ ID NO: 43744 - DNA, 20 bp, Homo sapiens
ggtcgcgccgtcgggcccgg

SEQ ID NO: 43745 - DNA, 21 bp, Homo sapiens
ggtcgcgccgtcgggcccggg

SEQ ID NO: 43746 - DNA, 22 bp, Homo sapiens
ggtcgcgccgtcgggcccgggg

SEQ ID NO: 43747 - DNA, 23 bp, Homo sapiens
ggtcgcgccgtcgggcccggggg

SEQ ID NO: 43748 - DNA, 24 bp, Homo sapiens
ggtcgcgccgtcgggcccggggga

SEQ ID NO: 43749 - DNA, 25 bp, Homo sapiens
ggtcgcgccgtcgggcccgggggag

SEQ ID NO: 43750 - DNA, 26 bp, Homo sapiens
ggtcgcgccgtcgggcccgggggagg

SEQ ID NO: 43751 - DNA, 27 bp, Homo sapiens
ggtcgcgccgtcgggcccgggggaggt

SEQ ID NO: 43752 - DNA, 28 bp, Homo sapiens
ggtcgcgccgtcgggcccgggggaggtt

SEQ ID NO: 43753 - DNA, 29 bp, Homo sapiens
ggtcgcgccgtcgggcccgggggaggttc

SEQ ID NO: 43754 - DNA, 30 bp, Homo sapiens; identical to SEQ ID NO: 20091

SEQ ID NO: 43755 - DNA, 16 bp, Homo sapiens
gtcgcgccgtcgggcc

SEQ ID NO: 43756 - DNA, 18 bp, Homo sapiens
gtcgcgccgtcgggcccg

SEQ ID NO: 43757 - DNA, 19 bp, Homo sapiens
gtcgcgccgtcgggcccgg

SEQ ID NO: 43758 - DNA, 20 bp, Homo sapiens
gtcgcgccgtcgggcccggg

SEQ ID NO: 43759 - DNA, 21 bp, Homo sapiens
gtcgcgccgtcgggcccgggg

SEQ ID NO: 43760 - DNA, 22 bp, Homo sapiens
gtcgcgccgtcgggcccggggg

SEQ ID NO: 43761 - DNA, 23 bp, Homo sapiens
gtcgcgccgtcgggcccggggga

SEQ ID NO: 43762 - DNA, 24 bp, Homo sapiens
gtcgcgccgtcgggcccgggggag

SEQ ID NO: 43763 - DNA, 25 bp, Homo sapiens
gtcgcgccgtcgggcccgggggagg

SEQ ID NO: 43764 - DNA, 26 bp, Homo sapiens
gtcgcgccgtcgggcccgggggaggt

SEQ ID NO: 43765 - DNA, 27 bp, Homo sapiens
gtcgcgccgtcgggcccgggggaggtt

SEQ ID NO: 43766 - DNA, 28 bp, Homo sapiens
gtcgcgccgtcgggcccgggggaggttc

SEQ ID NO: 43767 - DNA, 29 bp, Homo sapiens
gtcgcgccgtcgggcccgggggaggttct

SEQ ID NO: 43768 - DNA, 17 bp, Homo sapiens
tcgcgccgtcgggcccg

SEQ ID NO: 43769 - DNA, 18 bp, Homo sapiens
tcgcgccgtcgggcccgg

SEQ ID NO: 43770 - DNA, 19 bp, Homo sapiens
tcgcgccgtcgggcccggg

SEQ ID NO: 43771 - DNA, 20 bp, Homo sapiens
tcgcgccgtcgggcccgggg

SEQ ID NO: 43772 - DNA, 21 bp, Homo sapiens
tcgcgccgtcgggcccggggg

SEQ ID NO: 43773 - DNA, 22 bp, Homo sapiens
tcgcgccgtcgggcccggggga

SEQ ID NO: 43774 - DNA, 23 bp, Homo sapiens
tcgcgccgtcgggcccgggggag

SEQ ID NO: 43775 - DNA, 24 bp, Homo sapiens
tcgcgccgtcgggcccgggggagg

SEQ ID NO: 43776 - DNA, 25 bp, Homo sapiens
tcgcgccgtcgggcccgggggaggt

SEQ ID NO: 43777 - DNA, 26 bp, Homo sapiens
tcgcgccgtcgggcccgggggaggtt

SEQ ID NO: 43778 - DNA, 27 bp, Homo sapiens
tcgcgccgtcgggcccgggggaggttc

SEQ ID NO: 43779 - DNA, 28 bp, Homo sapiens
tcgcgccgtcgggcccgggggaggttct

SEQ ID NO: 43780 - DNA, 16 bp, Homo sapiens
cgcgccgtcgggcccg

SEQ ID NO: 43781 - DNA, 17 bp, Homo sapiens
cgcgccgtcgggcccgg

SEQ ID NO: 43782 - DNA, 18 bp, Homo sapiens
cgcgccgtcgggcccggg

SEQ ID NO: 43783 - DNA, 19 bp, Homo sapiens
cgcgccgtcgggcccgggg

SEQ ID NO: 43784 - DNA, 20 bp, Homo sapiens
cgcgccgtcgggcccggggg

SEQ ID NO: 43785 - DNA, 21 bp, Homo sapiens
cgcgccgtcgggcccggggga

SEQ ID NO: 43786 - DNA, 22 bp, Homo sapiens
cgcgccgtcgggcccgggggag

SEQ ID NO: 43787 - DNA, 23 bp, Homo sapiens
cgcgccgtcgggcccgggggagg

SEQ ID NO: 43788 - DNA, 24 bp, Homo sapiens
cgcgccgtcgggcccgggggaggt

SEQ ID NO: 43789 - DNA, 25 bp, Homo sapiens
cgcgccgtcgggcccgggggaggtt

SEQ ID NO: 43790 - DNA, 26 bp, Homo sapiens
cgcgccgtcgggcccgggggaggttc

SEQ ID NO: 43791 - DNA, 27 bp, Homo sapiens
cgcgccgtcgggcccgggggaggttct

SEQ ID NO: 43792 - DNA, 16 bp, Homo sapiens
gcgccgtcgggcccgg

SEQ ID NO: 43793 - DNA, 17 bp, Homo sapiens
gcgccgtcgggcccggg

SEQ ID NO: 43794 - DNA, 18 bp, Homo sapiens
gcgccgtcgggcccgggg

SEQ ID NO: 43795 - DNA, 19 bp, Homo sapiens
gcgccgtcgggcccggggg

SEQ ID NO: 43796 - DNA, 20 bp, Homo sapiens
gcgccgtcgggcccggggga

SEQ ID NO: 43797 - DNA, 21 bp, Homo sapiens
gcgccgtcgggcccgggggag

SEQ ID NO: 43798 - DNA, 22 bp, Homo sapiens
gcgccgtcgggcccgggggagg

SEQ ID NO: 43799 - DNA, 23 bp, Homo sapiens
gcgccgtcgggcccgggggaggt

SEQ ID NO: 43800 - DNA, 24 bp, Homo sapiens
gcgccgtcgggcccgggggaggtt

SEQ ID NO: 43801 - DNA, 25 bp, Homo sapiens
gcgccgtcgggcccgggggaggttc

SEQ ID NO: 43802 - DNA, 26 bp, Homo sapiens
gcgccgtcgggcccgggggaggttct

SEQ ID NO: 43803 - DNA, 16 bp, Homo sapiens
cgccgtcgggcccggg

SEQ ID NO: 43804 - DNA, 17 bp, Homo sapiens
cgccgtcgggcccgggg

SEQ ID NO: 43805 - DNA, 18 bp, Homo sapiens
cgccgtcgggcccggggg

SEQ ID NO: 43806 - DNA, 19 bp, Homo sapiens
cgccgtcgggcccggggga

SEQ ID NO: 43807 - DNA, 20 bp, Homo sapiens
cgccgtcgggcccgggggag

SEQ ID NO: 43808 - DNA, 21 bp, Homo sapiens
cgccgtcgggcccgggggagg

SEQ ID NO: 43809 - DNA, 22 bp, Homo sapiens
cgccgtcgggcccgggggaggt

SEQ ID NO: 43810 - DNA, 23 bp, Homo sapiens
cgccgtcgggcccgggggaggtt

SEQ ID NO: 43811 - DNA, 24 bp, Homo sapiens
cgccgtcgggcccgggggaggttc

SEQ ID NO: 43812 - DNA, 25 bp, Homo sapiens
cgccgtcgggcccgggggaggttct

SEQ ID NO: 43813 - DNA, 16 bp, Homo sapiens
gccgtcgggcccgggg

SEQ ID NO: 43814 - DNA, 17 bp, Homo sapiens
gccgtcgggcccggggg

SEQ ID NO: 43815 - DNA, 18 bp, Homo sapiens
gccgtcgggcccggggga

SEQ ID NO: 43816 - DNA, 19 bp, Homo sapiens
gccgtcgggcccgggggag

SEQ ID NO: 43817 - DNA, 20 bp, Homo sapiens
cctcccccgggcccgacggc

SEQ ID NO: 43818 - DNA, 20 bp, Homo sapiens
gccgtcgggcccgggggagg

SEQ ID NO: 43819 - DNA, 21 bp, Homo sapiens
gccgtcgggcccgggggaggt

SEQ ID NO: 43820 - DNA, 22 bp, Homo sapiens
gccgtcgggcccgggggaggtt

SEQ ID NO: 43821 - DNA, 23 bp, Homo sapiens
gccgtcgggcccgggggaggttc

SEQ ID NO: 43822 - DNA, 16 bp, Homo sapiens
ccgtcgggcccggggg

SEQ ID NO: 43823 - DNA, 17 bp, Homo sapiens
ccgtcgggcccggggga

SEQ ID NO: 43824 - DNA, 18 bp, Homo sapiens
ccgtcgggcccgggggag

SEQ ID NO: 43825 - DNA, 19 bp, Homo sapiens
ccgtcgggcccgggggagg

SEQ ID NO: 43826 - DNA, 20 bp, Homo sapiens
ccgtcgggcccgggggaggt

SEQ ID NO: 43827 - DNA, 21 bp, Homo sapiens
ccgtcgggcccgggggaggtt

SEQ ID NO: 43828 - DNA, 18 bp, Homo sapiens
cgtcgggcccgggggagg

SEQ ID NO: 43829 - DNA, 19 bp, Homo sapiens
cgtcgggcccgggggaggt

SEQ ID NO: 43830 - DNA, 17 bp, Homo sapiens
gtcgggcccgggggagg

SEQ ID NO: 43831 - DNA, 18 bp, Homo sapiens
gtcgggcccgggggaggt

SEQ ID NO: 43832 - DNA, 19 bp, Homo sapiens
gtcgggcccgggggaggtt

SEQ ID NO: 43833 - DNA, 21 bp, Homo sapiens
gggggaggttctctcggggcc

SEQ ID NO: 43834 - DNA, 24 bp, Homo sapiens
gggggaggttctctcggggccacg

SEQ ID NO: 43835 - DNA, 23 bp, Homo sapiens
ggggaggttctctcggggccacg

SEQ ID NO: 43836 - DNA, 21 bp, Homo sapiens
gggaggttctctcggggccac

SEQ ID NO: 43837 - DNA, 22 bp, Homo sapiens
gggaggttctctcggggccacg

SEQ ID NO: 43838 - DNA, 24 bp, Homo sapiens
gggaggttctctcggggccacgcg

SEQ ID NO: 43839 - DNA, 26 bp, Homo sapiens
gggaggttctctcggggccacgcgcg

SEQ ID NO: 43840 - DNA, 28 bp, Homo sapiens
gggaggttctctcggggccacgcgcgcg

SEQ ID NO: 43841 - DNA, 25 bp, Homo sapiens
ggaggttctctcggggccacgcgcg

SEQ ID NO: 43842 - DNA, 20 bp, Homo sapiens
gaggttctctcggggccacg

SEQ ID NO: 43843 - DNA, 18 bp, Homo sapiens
gttctctcggggccacgc

SEQ ID NO: 43844 - DNA, 19 bp, Homo sapiens
gttctctcggggccacgcg

SEQ ID NO: 43845 - DNA, 20 bp, Homo sapiens
gttctctcggggccacgcgc

SEQ ID NO: 43846 - DNA, 21 bp, Homo sapiens
gttctctcggggccacgcgcg

SEQ ID NO: 43847 - DNA, 22 bp, Homo sapiens
gttctctcggggccacgcgcgc

SEQ ID NO: 43848 - DNA, 23 bp, Homo sapiens
gttctctcggggccacgcgcgcg

SEQ ID NO: 43849 - DNA, 25 bp, Homo sapiens
gttctctcggggccacgcgcgcgtc

SEQ ID NO: 43850 - DNA, 20 bp, Homo sapiens
ttctctcggggccacgcgcg

SEQ ID NO: 43851 - DNA, 18 bp, Homo sapiens
ctctcggggccacgcgcg

SEQ ID NO: 43852 - DNA, 20 bp, Homo sapiens
ctctcggggccacgcgcgcg

SEQ ID NO: 43853 - DNA, 21 bp, Homo sapiens
ctctcggggccacgcgcgcgt

SEQ ID NO: 43854 - DNA, 22 bp, Homo sapiens
ctctcggggccacgcgcgcgtc

SEQ ID NO: 43855 - DNA, 25 bp, Homo sapiens
ctctcggggccacgcgcgcgtcccc

SEQ ID NO: 43856 - DNA, 26 bp, Homo sapiens
ctctcggggccacgcgcgcgtccccc

SEQ ID NO: 43857 - DNA, 27 bp, Homo sapiens
ctctcggggccacgcgcgcgtcccccg

SEQ ID NO: 43858 - DNA, 28 bp, Homo sapiens
ctctcggggccacgcgcgcgtcccccga

SEQ ID NO: 43859 - DNA, 29 bp, Homo sapiens
ctctcggggccacgcgcgcgtcccccgaa

SEQ ID NO: 43860 - DNA, 17 bp, Homo sapiens
tctcggggccacgcgcg

SEQ ID NO: 43861 - DNA, 18 bp, Homo sapiens
tctcggggccacgcgcgc

SEQ ID NO: 43862 - DNA, 19 bp, Homo sapiens
tctcggggccacgcgcgcg

SEQ ID NO: 43863 - DNA, 20 bp, Homo sapiens
tctcggggccacgcgcgcgt

SEQ ID NO: 43864 - DNA, 21 bp, Homo sapiens
tctcggggccacgcgcgcgtc

SEQ ID NO: 43865 - DNA, 22 bp, Homo sapiens
tctcggggccacgcgcgcgtcc

SEQ ID NO: 43866 - DNA, 23 bp, Homo sapiens
tctcggggccacgcgcgcgtccc

SEQ ID NO: 43867 - DNA, 25 bp, Homo sapiens
tctcggggccacgcgcgcgtccccc

SEQ ID NO: 43868 - DNA, 16 bp, Homo sapiens
ctcggggccacgcgcg

SEQ ID NO: 43869 - DNA, 17 bp, Homo sapiens
ctcggggccacgcgcgc

SEQ ID NO: 43870 - DNA, 18 bp, Homo sapiens
ctcggggccacgcgcgcg

SEQ ID NO: 43871 - DNA, 19 bp, Homo sapiens
ctcggggccacgcgcgcgt

SEQ ID NO: 43872 - DNA, 20 bp, Homo sapiens
ctcggggccacgcgcgcgtc

SEQ ID NO: 43873 - DNA, 21 bp, Homo sapiens
ctcggggccacgcgcgcgtcc

SEQ ID NO: 43874 - DNA, 22 bp, Homo sapiens
ctcggggccacgcgcgcgtccc

SEQ ID NO: 43875 - DNA, 23 bp, Homo sapiens
ctcggggccacgcgcgcgtcccc

SEQ ID NO: 43876 - DNA, 24 bp, Homo sapiens
ctcggggccacgcgcgcgtccccc

SEQ ID NO: 43877 - DNA, 16 bp, Homo sapiens
tcggggccacgcgcgc

SEQ ID NO: 43878 - DNA, 17 bp, Homo sapiens
tcggggccacgcgcgcg

SEQ ID NO: 43879 - DNA, 18 bp, Homo sapiens
tcggggccacgcgcgcgt

SEQ ID NO: 43880 - DNA, 19 bp, Homo sapiens
tcggggccacgcgcgcgtc

SEQ ID NO: 43881 - DNA, 20 bp, Homo sapiens
tcggggccacgcgcgcgtcc

SEQ ID NO: 43882 - DNA, 21 bp, Homo sapiens
tcggggccacgcgcgcgtccc

SEQ ID NO: 43883 - DNA, 22 bp, Homo sapiens
tcggggccacgcgcgcgtcccc

SEQ ID NO: 43884 - DNA, 23 bp, Homo sapiens
tcggggccacgcgcgcgtccccc

SEQ ID NO: 43885 - DNA, 24 bp, Homo sapiens
tcggggccacgcgcgcgtcccccg

SEQ ID NO: 43886 - DNA, 16 bp, Homo sapiens
cggggccacgcgcgcg

SEQ ID NO: 43887 - DNA, 17 bp, Homo sapiens
cggggccacgcgcgcgt

SEQ ID NO: 43888 - DNA, 18 bp, Homo sapiens
cggggccacgcgcgcgtc

SEQ ID NO: 43889 - DNA, 19 bp, Homo sapiens
cggggccacgcgcgcgtcc

SEQ ID NO: 43890 - DNA, 20 bp, Homo sapiens
cggggccacgcgcgcgtccc

SEQ ID NO: 43891 - DNA, 21 bp, Homo sapiens
cggggccacgcgcgcgtcccc

SEQ ID NO: 43892 - DNA, 22 bp, Homo sapiens
cggggccacgcgcgcgtccccc

SEQ ID NO: 43893 - DNA, 23 bp, Homo sapiens
cggggccacgcgcgcgtcccccg

SEQ ID NO: 43894 - DNA, 24 bp, Homo sapiens
cggggccacgcgcgcgtcccccga

SEQ ID NO: 43895 - DNA, 25 bp, Homo sapiens
cggggccacgcgcgcgtcccccgaa

SEQ ID NO: 43896 - DNA, 17 bp, Homo sapiens
ggggccacgcgcgcgtc

SEQ ID NO: 43897 - DNA, 18 bp, Homo sapiens
ggggccacgcgcgcgtcc

SEQ ID NO: 43898 - DNA, 16 bp, Homo sapiens
gggccacgcgcgcgtc

SEQ ID NO: 43899 - DNA, 17 bp, Homo sapiens
gggccacgcgcgcgtcc

SEQ ID NO: 43900 - DNA, 19 bp, Homo sapiens
ggccacgcgcgcgtccccc

SEQ ID NO: 43901 - DNA, 19 bp, Homo sapiens
ccacgcgcgcgtcccccga

SEQ ID NO: 43902 - DNA, 20 bp, Homo sapiens
cgcgcgcgtcccccgaagag

SEQ ID NO: 43903 - DNA, 21 bp, Homo sapiens
cgcgcgcgtcccccgaagagg

SEQ ID NO: 43904 - DNA, 25 bp, Homo sapiens
gcgcgcgtcccccgaagagggggac

SEQ ID NO: 43905 - DNA, 18 bp, Homo sapiens
cgcgcgtcccccgaagag

SEQ ID NO: 43906 - DNA, 19 bp, Homo sapiens
cgcgcgtcccccgaagagg

SEQ ID NO: 43907 - DNA, 24 bp, Homo sapiens
gcgtcccccgaagagggggacggc

SEQ ID NO: 43908 - DNA, 16 bp, Homo sapiens
cgtcccccgaagaggg

SEQ ID NO: 43909 - DNA, 16 bp, Homo sapiens
tcccccgaagaggggg

SEQ ID NO: 43910 - DNA, 21 bp, Homo sapiens
cgaagagggggacggcggagc

SEQ ID NO: 43911 - DNA, 18 bp, Homo sapiens
gaagagggggacggcgga

SEQ ID NO: 43912 - DNA, 19 bp, Homo sapiens
gaagagggggacggcggag

SEQ ID NO: 43913 - DNA, 20 bp, Homo sapiens
gaagagggggacggcggagc

SEQ ID NO: 43914 - DNA, 21 bp, Homo sapiens
gaagagggggacggcggagcg

SEQ ID NO: 43915 - DNA, 17 bp, Homo sapiens
aagagggggacggcgga

SEQ ID NO: 43916 - DNA, 18 bp, Homo sapiens
aagagggggacggcggag

SEQ ID NO: 43917 - DNA, 19 bp, Homo sapiens
aagagggggacggcggagc

SEQ ID NO: 43918 - DNA, 20 bp, Homo sapiens
aagagggggacggcggagcg

SEQ ID NO: 43919 - DNA, 18 bp, Homo sapiens
agagggggacggcggagc

SEQ ID NO: 43920 - DNA, 19 bp, Homo sapiens
agagggggacggcggagcg

SEQ ID NO: 43921 - DNA, 17 bp, Homo sapiens
gagggggacggcggagc

SEQ ID NO: 43922 - DNA, 18 bp, Homo sapiens
gagggggacggcggagcg

SEQ ID NO: 43923 - DNA, 22 bp, Homo sapiens
gagggggacggcggagcgagcg

SEQ ID NO: 43924 - DNA, 23 bp, Homo sapiens
gagggggacggcggagcgagcgc

SEQ ID NO: 43925 - DNA, 17 bp, Homo sapiens
agggggacggcggagcg

SEQ ID NO: 43926 - DNA, 19 bp, Homo sapiens
agggggacggcggagcgag

SEQ ID NO: 43927 - DNA, 20 bp, Homo sapiens
agggggacggcggagcgagc

SEQ ID NO: 43928 - DNA, 21 bp, Homo sapiens
agggggacggcggagcgagcg

SEQ ID NO: 43929 - DNA, 22 bp, Homo sapiens
agggggacggcggagcgagcgc

SEQ ID NO: 43930 - DNA, 21 bp, Homo sapiens
gggggacggcggagcgagcgc

SEQ ID NO: 43931 - DNA, 17 bp, Homo sapiens
ggggacggcggagcgag

SEQ ID NO: 43932 - DNA, 18 bp, Homo sapiens
ggggacggcggagcgagc

SEQ ID NO: 43933 - DNA, 19 bp, Homo sapiens
ggggacggcggagcgagcg

SEQ ID NO: 43934 - DNA, 20 bp, Homo sapiens
ggggacggcggagcgagcgc

SEQ ID NO: 43935 - DNA, 21 bp, Homo sapiens
ggggacggcggagcgagcgca

SEQ ID NO: 43936 - DNA, 22 bp, Homo sapiens
ggggacggcggagcgagcgcac

SEQ ID NO: 43937 - DNA, 17 bp, Homo sapiens
gggacggcggagcgagc

SEQ ID NO: 43938 - DNA, 18 bp, Homo sapiens
gggacggcggagcgagcg

SEQ ID NO: 43939 - DNA, 19 bp, Homo sapiens
gggacggcggagcgagcgc

SEQ ID NO: 43940 - DNA, 20 bp, Homo sapiens
gggacggcggagcgagcgca

SEQ ID NO: 43941 - DNA, 21 bp, Homo sapiens
gggacggcggagcgagcgcac

SEQ ID NO: 43942 - DNA, 24 bp, Homo sapiens
gcggagcgagcgcacggggtcggc

SEQ ID NO: 43943 - DNA, 17 bp, Homo sapiens
cggagcgagcgcacggg

SEQ ID NO: 43944 - DNA, 23 bp, Homo sapiens
cggagcgagcgcacggggtcggc

SEQ ID NO: 43945 - DNA, 21 bp, Homo sapiens
ggagcgagcgcacggggtcgg

SEQ ID NO: 43946 - DNA, 22 bp, Homo sapiens
ggagcgagcgcacggggtcggc

SEQ ID NO: 43947 - DNA, 20 bp, Homo sapiens
gagcgagcgcacggggtcgg

SEQ ID NO: 43948 - DNA, 21 bp, Homo sapiens
gagcgagcgcacggggtcggc

SEQ ID NO: 43949 - DNA, 25 bp, Homo sapiens
gcgagcgcacggggtcggcggcgac

SEQ ID NO: 43950 - DNA, 26 bp, Homo sapiens
gcgagcgcacggggtcggcggcgacg

SEQ ID NO: 43951 - DNA, 20 bp, Homo sapiens
cgagcgcacggggtcggcgg

SEQ ID NO: 43952 - DNA, 16 bp, Homo sapiens
cgcacggggtcggcgg

SEQ ID NO: 43953 - DNA, 20 bp, Homo sapiens
cgcacggggtcggcggcgac

SEQ ID NO: 43954 - DNA, 21 bp, Homo sapiens
cgcacggggtcggcggcgacg

SEQ ID NO: 43955 - DNA, 22 bp, Homo sapiens
cgcacggggtcggcggcgacgt

SEQ ID NO: 43956 - DNA, 23 bp, Homo sapiens
cgcacggggtcggcggcgacgtc

SEQ ID NO: 43957 - DNA, 25 bp, Homo sapiens
cgcacggggtcggcggcgacgtcgg

SEQ ID NO: 43958 - DNA, 26 bp, Homo sapiens
cgcacggggtcggcggcgacgtcggc

SEQ ID NO: 43959 - DNA, 19 bp, Homo sapiens
gcacggggtcggcggcgac

SEQ ID NO: 43960 - DNA, 20 bp, Homo sapiens
gcacggggtcggcggcgacg

SEQ ID NO: 43961 - DNA, 21 bp, Homo sapiens
gcacggggtcggcggcgacgt

SEQ ID NO: 43962 - DNA, 22 bp, Homo sapiens
gcacggggtcggcggcgacgtc

SEQ ID NO: 43963 - DNA, 24 bp, Homo sapiens
gcacggggtcggcggcgacgtcgg

SEQ ID NO: 43964 - DNA, 25 bp, Homo sapiens
gcacggggtcggcggcgacgtcggc

SEQ ID NO: 43965 - DNA, 29 bp, Homo sapiens
gcacggggtcggcggcgacgtcggctacc

SEQ ID NO: 43966 - DNA, 30 bp, Homo sapiens
gcacggggtcggcggcgacgtcggctaccc

SEQ ID NO: 43967 - DNA, 17 bp, Homo sapiens
cacggggtcggcggcga

SEQ ID NO: 43968 - DNA, 18 bp, Homo sapiens
cacggggtcggcggcgac

SEQ ID NO: 43969 - DNA, 19 bp, Homo sapiens
cacggggtcggcggcgacg

SEQ ID NO: 43970 - DNA, 20 bp, Homo sapiens
cacggggtcggcggcgacgt

SEQ ID NO: 43971 - DNA, 21 bp, Homo sapiens
cacggggtcggcggcgacgtc

SEQ ID NO: 43972 - DNA, 23 bp, Homo sapiens
cacggggtcggcggcgacgtcgg

SEQ ID NO: 43973 - DNA, 24 bp, Homo sapiens
cacggggtcggcggcgacgtcggc

SEQ ID NO: 43974 - DNA, 17 bp, Homo sapiens
acggggtcggcggcgac

SEQ ID NO: 43975 - DNA, 18 bp, Homo sapiens
acggggtcggcggcgacg

SEQ ID NO: 43976 - DNA, 19 bp, Homo sapiens
acggggtcggcggcgacgt

SEQ ID NO: 43977 - DNA, 20 bp, Homo sapiens
acggggtcggcggcgacgtc

SEQ ID NO: 43978 - DNA, 22 bp, Homo sapiens
acggggtcggcggcgacgtcgg

SEQ ID NO: 43979 - DNA, 23 bp, Homo sapiens
acggggtcggcggcgacgtcggc

SEQ ID NO: 43980 - DNA, 16 bp, Homo sapiens
cggggtcggcggcgac

SEQ ID NO: 43981 - DNA, 17 bp, Homo sapiens
cggggtcggcggcgacg

SEQ ID NO: 43982 - DNA, 18 bp, Homo sapiens
cggggtcggcggcgacgt

SEQ ID NO: 43983 - DNA, 19 bp, Homo sapiens
cggggtcggcggcgacgtc

SEQ ID NO: 43984 - DNA, 20 bp, Homo sapiens
cggggtcggcggcgacgtcg

SEQ ID NO: 43985 - DNA, 21 bp, Homo sapiens
cggggtcggcggcgacgtcgg

SEQ ID NO: 43986 - DNA, 22 bp, Homo sapiens
cggggtcggcggcgacgtcggc

SEQ ID NO: 43987 - DNA, 23 bp, Homo sapiens
cggggtcggcggcgacgtcggct

SEQ ID NO: 43988 - DNA, 16 bp, Homo sapiens
ggggtcggcggcgacg

SEQ ID NO: 43989 - DNA, 18 bp, Homo sapiens
ggggtcggcggcgacgtc

SEQ ID NO: 43990 - DNA, 20 bp, Homo sapiens
ggggtcggcggcgacgtcgg

SEQ ID NO: 43991 - DNA, 21 bp, Homo sapiens
ggggtcggcggcgacgtcggc

SEQ ID NO: 43992 - DNA, 22 bp, Homo sapiens
ggggtcggcggcgacgtcggct

SEQ ID NO: 43993 - DNA, 19 bp, Homo sapiens
gggtcggcggcgacgtcgg

SEQ ID NO: 43994 - DNA, 20 bp, Homo sapiens
gggtcggcggcgacgtcggc

SEQ ID NO: 43995 - DNA, 18 bp, Homo sapiens
ggtcggcggcgacgtcgg

SEQ ID NO: 43996 - DNA, 19 bp, Homo sapiens
ggtcggcggcgacgtcggc

SEQ ID NO: 43997 - DNA, 23 bp, Homo sapiens
gcggcgacgtcggctacccaccc

SEQ ID NO: 43998 - DNA, 21 bp, Homo sapiens
cggcgacgtcggctacccacc

SEQ ID NO: 43999 - DNA, 22 bp, Homo sapiens
cggcgacgtcggctacccaccc

SEQ ID NO: 44000 - DNA, 23 bp, Homo sapiens
cggcgacgtcggctacccacccg

SEQ ID NO: 44001 - DNA, 20 bp, Homo sapiens
ggcgacgtcggctacccacc

SEQ ID NO: 44002 - DNA, 21 bp, Homo sapiens
ggcgacgtcggctacccaccc

SEQ ID NO: 44003 - DNA, 22 bp, Homo sapiens
ggcgacgtcggctacccacccg

SEQ ID NO: 44004 - DNA, 23 bp, Homo sapiens
ggcgacgtcggctacccacccga

SEQ ID NO: 44005 - DNA, 16 bp, Homo sapiens
gcgacgtcggctaccc

SEQ ID NO: 44006 - DNA, 17 bp, Homo sapiens
gcgacgtcggctaccca

SEQ ID NO: 44007 - DNA, 18 bp, Homo sapiens
gcgacgtcggctacccac

SEQ ID NO: 44008 - DNA, 19 bp, Homo sapiens
gcgacgtcggctacccacc

SEQ ID NO: 44009 - DNA, 20 bp, Homo sapiens
gcgacgtcggctacccaccc

SEQ ID NO: 44010 - DNA, 21 bp, Homo sapiens
gcgacgtcggctacccacccg

SEQ ID NO: 44011 - DNA, 22 bp, Homo sapiens
gcgacgtcggctacccacccga

SEQ ID NO: 44012 - DNA, 23 bp, Homo sapiens
gcgacgtcggctacccacccgac

SEQ ID NO: 44013 - DNA, 24 bp, Homo sapiens
gcgacgtcggctacccacccgacc

SEQ ID NO: 44014 - DNA, 16 bp, Homo sapiens
cgacgtcggctaccca

SEQ ID NO: 44015 - DNA, 17 bp, Homo sapiens
cgacgtcggctacccac

SEQ ID NO: 44016 - DNA, 18 bp, Homo sapiens
cgacgtcggctacccacc

SEQ ID NO: 44017 - DNA, 19 bp, Homo sapiens
cgacgtcggctacccaccc

SEQ ID NO: 44018 - DNA, 20 bp, Homo sapiens
cgacgtcggctacccacccg

SEQ ID NO: 44019 - DNA, 21 bp, Homo sapiens
cgacgtcggctacccacccga

SEQ ID NO: 44020 - DNA, 18 bp, Homo sapiens
gacgtcggctacccaccc

SEQ ID NO: 44021 - DNA, 19 bp, Homo sapiens
gacgtcggctacccacccg

SEQ ID NO: 44022 - DNA, 20 bp, Homo sapiens
gacgtcggctacccacccga

SEQ ID NO: 44023 - DNA, 18 bp, Homo sapiens
acgtcggctacccacccg

SEQ ID NO: 44024 - DNA, 19 bp, Homo sapiens
acgtcggctacccacccga

SEQ ID NO: 44025 - DNA, 17 bp, Homo sapiens
cgtcggctacccacccg

SEQ ID NO: 44026 - DNA, 19 bp, Homo sapiens
cgtcggctacccacccgac

SEQ ID NO: 44027 - DNA, 20 bp, Homo sapiens
cgtcggctacccacccgacc

SEQ ID NO: 44028 - DNA, 24 bp, Homo sapiens
cgtcggctacccacccgacccgtc

SEQ ID NO: 44029 - DNA, 25 bp, Homo sapiens
cgtcggctacccacccgacccgtct

SEQ ID NO: 44030 - DNA, 23 bp, Homo sapiens
gtcggctacccacccgacccgtc

SEQ ID NO: 44031 - DNA, 20 bp, Homo sapiens
ggctacccacccgacccgtc

SEQ ID NO: 44032 - DNA, 21 bp, Homo sapiens
ggctacccacccgacccgtct

SEQ ID NO: 44033 - DNA, 19 bp, Homo sapiens
gctacccacccgacccgtc

SEQ ID NO: 44034 - DNA, 20 bp, Homo sapiens
gctacccacccgacccgtct

SEQ ID NO: 44035 - DNA, 18 bp, Homo sapiens
ctacccacccgacccgtc

SEQ ID NO: 44036 - DNA, 21 bp, Homo sapiens
ctacccacccgacccgtcttg

SEQ ID NO: 44037 - DNA, 16 bp, Homo sapiens
acccacccgacccgtc

SEQ ID NO: 44038 - DNA, 17 bp, Homo sapiens
acccacccgacccgtct

SEQ ID NO: 44039 - DNA, 18 bp, Homo sapiens
cccacccgacccgtcttg

SEQ ID NO: 44040 - DNA, 18 bp, Homo sapiens
cttgaaacacggaccaag

SEQ ID NO: 44041 - DNA, 19 bp, Homo sapiens
cttgaaacacggaccaagg

SEQ ID NO: 44042 - DNA, 20 bp, Homo sapiens
cttgaaacacggaccaagga

SEQ ID NO: 44043 - DNA, 21 bp, Homo sapiens
cttgaaacacggaccaaggag

SEQ ID NO: 44044 - DNA, 18 bp, Homo sapiens
ttgaaacacggaccaagg

SEQ ID NO: 44045 - DNA, 19 bp, Homo sapiens
ttgaaacacggaccaagga

SEQ ID NO: 44046 - DNA, 16 bp, Homo sapiens
tgaaacacggaccaag

SEQ ID NO: 44047 - DNA, 17 bp, Homo sapiens
tgaaacacggaccaagg

SEQ ID NO: 44048 - DNA, 18 bp, Homo sapiens
tgaaacacggaccaagga

SEQ ID NO: 44049 - DNA, 19 bp, Homo sapiens
tgaaacacggaccaaggag

SEQ ID NO: 44050 - DNA, 30 bp, Homo sapiens
tgaaacacggaccaaggagtctaacacgtg

SEQ ID NO: 44051 - DNA, 16 bp, Homo sapiens
aacacggaccaaggag

SEQ ID NO: 44052 - DNA, 19 bp, Homo sapiens
aacacggaccaaggagtct

SEQ ID NO: 44053 - DNA, 22 bp, Homo sapiens
aacacggaccaaggagtctaac

SEQ ID NO: 44054 - DNA, 25 bp, Homo sapiens
aacacggaccaaggagtctaacacg

SEQ ID NO: 44055 - DNA, 26 bp, Homo sapiens
aacacggaccaaggagtctaacacgt

SEQ ID NO: 44056 - DNA, 28 bp, Homo sapiens
aacacggaccaaggagtctaacacgtgc

SEQ ID NO: 44057 - DNA, 30 bp, Homo sapiens
aacacggaccaaggagtctaacacgtgcgc

SEQ ID NO: 44058 - DNA, 21 bp, Homo sapiens
acacggaccaaggagtctaac

SEQ ID NO: 44059 - DNA, 22 bp, Homo sapiens
acacggaccaaggagtctaaca

SEQ ID NO: 44060 - DNA, 23 bp, Homo sapiens
acacggaccaaggagtctaacac

SEQ ID NO: 44061 - DNA, 24 bp, Homo sapiens
acacggaccaaggagtctaacacg

SEQ ID NO: 44062 - DNA, 25 bp, Homo sapiens
acacggaccaaggagtctaacacgt

SEQ ID NO: 44063 - DNA, 26 bp, Homo sapiens
acacggaccaaggagtctaacacgtg

SEQ ID NO: 44064 - DNA, 27 bp, Homo sapiens
acacggaccaaggagtctaacacgtgc

SEQ ID NO: 44065 - DNA, 28 bp, Homo sapiens
acacggaccaaggagtctaacacgtgcg

SEQ ID NO: 44066 - DNA, 30 bp, Homo sapiens
acacggaccaaggagtctaacacgtgcgcg

SEQ ID NO: 44067 - DNA, 20 bp, Homo sapiens
cacggaccaaggagtctaac

SEQ ID NO: 44068 - DNA, 21 bp, Homo sapiens
cacggaccaaggagtctaaca

SEQ ID NO: 44069 - DNA, 22 bp, Homo sapiens
cacggaccaaggagtctaacac

SEQ ID NO: 44070 - DNA, 23 bp, Homo sapiens
cacggaccaaggagtctaacacg

SEQ ID NO: 44071 - DNA, 24 bp, Homo sapiens
cacggaccaaggagtctaacacgt

SEQ ID NO: 44072 - DNA, 25 bp, Homo sapiens
cacggaccaaggagtctaacacgtg

SEQ ID NO: 44073 - DNA, 26 bp, Homo sapiens
cacggaccaaggagtctaacacgtgc

SEQ ID NO: 44074 - DNA, 27 bp, Homo sapiens
cacggaccaaggagtctaacacgtgcg

SEQ ID NO: 44075 - DNA, 28 bp, Homo sapiens
cacggaccaaggagtctaacacgtgcgc

SEQ ID NO: 44076 - DNA, 29 bp, Homo sapiens
cacggaccaaggagtctaacacgtgcgcg

SEQ ID NO: 44077 - DNA, 21 bp, Homo sapiens
acggaccaaggagtctaacac

SEQ ID NO: 44078 - DNA, 22 bp, Homo sapiens
acggaccaaggagtctaacacg

SEQ ID NO: 44079 - DNA, 23 bp, Homo sapiens
acggaccaaggagtctaacacgt

SEQ ID NO: 44080 - DNA, 24 bp, Homo sapiens
acggaccaaggagtctaacacgtg

SEQ ID NO: 44081 - DNA, 25 bp, Homo sapiens
acggaccaaggagtctaacacgtgc

SEQ ID NO: 44082 - DNA, 26 bp, Homo sapiens
acggaccaaggagtctaacacgtgcg

SEQ ID NO: 44083 - DNA, 27 bp, Homo sapiens
acggaccaaggagtctaacacgtgcgc

SEQ ID NO: 44084 - DNA, 28 bp, Homo sapiens
acggaccaaggagtctaacacgtgcgcg

SEQ ID NO: 44085 - DNA, 29 bp, Homo sapiens
acggaccaaggagtctaacacgtgcgcga

SEQ ID NO: 44086 - DNA, 30 bp, Homo sapiens; identical to SEQ ID NO: 20276

SEQ ID NO: 44087 - DNA, 24 bp, Homo sapiens
cggaccaaggagtctaacacgtgc

SEQ ID NO: 44088 - DNA, 25 bp, Homo sapiens
cggaccaaggagtctaacacgtgcg

SEQ ID NO: 44089 - DNA, 26 bp, Homo sapiens
cggaccaaggagtctaacacgtgcgc

SEQ ID NO: 44090 - DNA, 28 bp, Homo sapiens
cggaccaaggagtctaacacgtgcgcga

SEQ ID NO: 44091 - DNA, 30 bp, Homo sapiens
cggaccaaggagtctaacacgtgcgcgagt

SEQ ID NO: 44092 - DNA, 21 bp, Homo sapiens
accaaggagtctaacacgtgc

SEQ ID NO: 44093 - DNA, 18 bp, Homo sapiens
ccaaggagtctaacacgt

SEQ ID NO: 44094 - DNA, 24 bp, Homo sapiens
ccaaggagtctaacacgtgcgcga

SEQ ID NO: 44095 - DNA, 17 bp, Homo sapiens
aaggagtctaacacgtg

SEQ ID NO: 44096 - DNA, 18 bp, Homo sapiens
aaggagtctaacacgtgc

SEQ ID NO: 44097 - DNA, 19 bp, Homo sapiens
aaggagtctaacacgtgcg

SEQ ID NO: 44098 - DNA, 21 bp, Homo sapiens
aaggagtctaacacgtgcgcg

SEQ ID NO: 44099 - DNA, 22 bp, Homo sapiens
aaggagtctaacacgtgcgcga

SEQ ID NO: 44100 - DNA, 23 bp, Homo sapiens
aaggagtctaacacgtgcgcgag

SEQ ID NO: 44101 - DNA, 24 bp, Homo sapiens
aaggagtctaacacgtgcgcgagt

SEQ ID NO: 44102 - DNA, 25 bp, Homo sapiens
aaggagtctaacacgtgcgcgagtc

SEQ ID NO: 44103 - DNA, 26 bp, Homo sapiens
aaggagtctaacacgtgcgcgagtcg

SEQ ID NO: 44104 - DNA, 27 bp, Homo sapiens
aaggagtctaacacgtgcgcgagtcgg

SEQ ID NO: 44105 - DNA, 28 bp, Homo sapiens
aaggagtctaacacgtgcgcgagtcggg

SEQ ID NO: 44106 - DNA, 29 bp, Homo sapiens
aaggagtctaacacgtgcgcgagtcgggg

SEQ ID NO: 44107 - DNA, 30 bp, Homo sapiens; identical to SEQ ID NO: 20303

SEQ ID NO: 44108 - DNA, 17 bp, Homo sapiens
aggagtctaacacgtgc

SEQ ID NO: 44109 - DNA, 18 bp, Homo sapiens
aggagtctaacacgtgcg

SEQ ID NO: 44110 - DNA, 19 bp, Homo sapiens
aggagtctaacacgtgcgc

SEQ ID NO: 44111 - DNA, 20 bp, Homo sapiens
aggagtctaacacgtgcgcg

SEQ ID NO: 44112 - DNA, 21 bp, Homo sapiens
aggagtctaacacgtgcgcga

SEQ ID NO: 44113 - DNA, 22 bp, Homo sapiens
aggagtctaacacgtgcgcgag

SEQ ID NO: 44114 - DNA, 27 bp, Homo sapiens
aggagtctaacacgtgcgcgagtcggg

SEQ ID NO: 44115 - DNA, 30 bp, Homo sapiens
aggagtctaacacgtgcgcgagtcgggggc

SEQ ID NO: 44116 - DNA, 18 bp, Homo sapiens
ggagtctaacacgtgcgc

SEQ ID NO: 44117 - DNA, 19 bp, Homo sapiens
ggagtctaacacgtgcgcg

SEQ ID NO: 44118 - DNA, 20 bp, Homo sapiens
ggagtctaacacgtgcgcga

SEQ ID NO: 44119 - DNA, 21 bp, Homo sapiens
ggagtctaacacgtgcgcgag

SEQ ID NO: 44120 - DNA, 18 bp, Homo sapiens
gagtctaacacgtgcgcg

SEQ ID NO: 44121 - DNA, 20 bp, Homo sapiens
gagtctaacacgtgcgcgag

SEQ ID NO: 44122 - DNA, 21 bp, Homo sapiens
gagtctaacacgtgcgcgagt

SEQ ID NO: 44123 - DNA, 24 bp, Homo sapiens
gagtctaacacgtgcgcgagtcgg

SEQ ID NO: 44124 - DNA, 25 bp, Homo sapiens
gagtctaacacgtgcgcgagtcggg

SEQ ID NO: 44125 - DNA, 23 bp, Homo sapiens
agtctaacacgtgcgcgagtcgg

SEQ ID NO: 44126 - DNA, 24 bp, Homo sapiens
agtctaacacgtgcgcgagtcggg

SEQ ID NO: 44127 - DNA, 18 bp, Homo sapiens
gtctaacacgtgcgcgag

SEQ ID NO: 44128 - DNA, 19 bp, Homo sapiens
gtctaacacgtgcgcgagt

SEQ ID NO: 44129 - DNA, 22 bp, Homo sapiens
gtctaacacgtgcgcgagtcgg

SEQ ID NO: 44130 - DNA, 23 bp, Homo sapiens
gtctaacacgtgcgcgagtcggg

SEQ ID NO: 44131 - DNA, 24 bp, Homo sapiens
gtctaacacgtgcgcgagtcgggg

SEQ ID NO: 44132 - DNA, 21 bp, Homo sapiens
tctaacacgtgcgcgagtcgg

SEQ ID NO: 44133 - DNA, 22 bp, Homo sapiens
tctaacacgtgcgcgagtcggg

SEQ ID NO: 44134 - DNA, 23 bp, Homo sapiens
tctaacacgtgcgcgagtcgggg

SEQ ID NO: 44135 - DNA, 25 bp, Homo sapiens
tctaacacgtgcgcgagtcgggggc

SEQ ID NO: 44136 - DNA, 26 bp, Homo sapiens
tctaacacgtgcgcgagtcgggggct

SEQ ID NO: 44137 - DNA, 16 bp, Homo sapiens
ctaacacgtgcgcgag

SEQ ID NO: 44138 - DNA, 17 bp, Homo sapiens
ctaacacgtgcgcgagt

SEQ ID NO: 44139 - DNA, 20 bp, Homo sapiens
ctaacacgtgcgcgagtcgg

SEQ ID NO: 44140 - DNA, 21 bp, Homo sapiens
ctaacacgtgcgcgagtcggg

SEQ ID NO: 44141 - DNA, 22 bp, Homo sapiens
ctaacacgtgcgcgagtcgggg

SEQ ID NO: 44142 - DNA, 23 bp, Homo sapiens
ctaacacgtgcgcgagtcggggg

SEQ ID NO: 44143 - DNA, 24 bp, Homo sapiens
ctaacacgtgcgcgagtcgggggc

SEQ ID NO: 44144 - DNA, 25 bp, Homo sapiens
ctaacacgtgcgcgagtcgggggct

SEQ ID NO: 44145 - DNA, 26 bp, Homo sapiens
ctaacacgtgcgcgagtcgggggctc

SEQ ID NO: 44146 - DNA, 27 bp, Homo sapiens
ctaacacgtgcgcgagtcgggggctcg

SEQ ID NO: 44147 - DNA, 28 bp, Homo sapiens
ctaacacgtgcgcgagtcgggggctcgc

SEQ ID NO: 44148 - DNA, 21 bp, Homo sapiens
acacgtgcgcgagtcgggggc

SEQ ID NO: 44149 - DNA, 22 bp, Homo sapiens
acacgtgcgcgagtcgggggct

SEQ ID NO: 44150 - DNA, 20 bp, Homo sapiens
cacgtgcgcgagtcgggggc

SEQ ID NO: 44151 - DNA, 21 bp, Homo sapiens
cacgtgcgcgagtcgggggct

SEQ ID NO: 44152 - DNA, 22 bp, Homo sapiens
cacgtgcgcgagtcgggggctc

SEQ ID NO: 44153 - DNA, 22 bp, Homo sapiens
acgtgcgcgagtcgggggctcg

SEQ ID NO: 44154 - DNA, 18 bp, Homo sapiens
cgtgcgcgagtcgggggc

SEQ ID NO: 44155 - DNA, 21 bp, Homo sapiens
cgtgcgcgagtcgggggctcg

SEQ ID NO: 44156 - DNA, 22 bp, Homo sapiens
cgtgcgcgagtcgggggctcgc

SEQ ID NO: 44157 - DNA, 17 bp, Homo sapiens
gtgcgcgagtcgggggc

SEQ ID NO: 44158 - DNA, 20 bp, Homo sapiens
gtgcgcgagtcgggggctcg

SEQ ID NO: 44159 - DNA, 21 bp, Homo sapiens
gtgcgcgagtcgggggctcgc

SEQ ID NO: 44160 - DNA, 18 bp, Homo sapiens
agtcgggggctcgcacga

SEQ ID NO: 44161 - DNA, 22 bp, Homo sapiens
ggctcgcacgaaagccgccgtg

SEQ ID NO: 44162 - DNA, 23 bp, Homo sapiens
gctcgcacgaaagccgccgtggc

SEQ ID NO: 44163 - DNA, 22 bp, Homo sapiens
ctcgcacgaaagccgccgtggc

SEQ ID NO: 44164 - DNA, 26 bp, Homo sapiens
gaaagccgccgtggcgcaatgaaggt

SEQ ID NO: 44165 - DNA, 30 bp, Homo sapiens
gaaagccgccgtggcgcaatgaaggtgaag

SEQ ID NO: 44166 - DNA, 21 bp, Homo sapiens
ccgccgtggcgcaatgaaggt

SEQ ID NO: 44167 - DNA, 26 bp, Homo sapiens
ccgtggcgcaatgaaggtgaaggccg

SEQ ID NO: 44168 - DNA, 27 bp, Homo sapiens
ccgtggcgcaatgaaggtgaaggccgg

SEQ ID NO: 44169 - DNA, 25 bp, Homo sapiens
cgtggcgcaatgaaggtgaaggccg

SEQ ID NO: 44170 - DNA, 22 bp, Homo sapiens
gtggcgcaatgaaggtgaaggc

SEQ ID NO: 44171 - DNA, 24 bp, Homo sapiens
gtggcgcaatgaaggtgaaggccg

SEQ ID NO: 44172 - DNA, 25 bp, Homo sapiens
gtggcgcaatgaaggtgaaggccgg

SEQ ID NO: 44173 - DNA, 26 bp, Homo sapiens
gtggcgcaatgaaggtgaaggccggc

SEQ ID NO: 44174 - DNA, 27 bp, Homo sapiens
gtggcgcaatgaaggtgaaggccggcg

SEQ ID NO: 44175 - DNA, 23 bp, Homo sapiens
tggcgcaatgaaggtgaaggccg

SEQ ID NO: 44176 - DNA, 24 bp, Homo sapiens
tggcgcaatgaaggtgaaggccgg

SEQ ID NO: 44177 - DNA, 25 bp, Homo sapiens
tggcgcaatgaaggtgaaggccggc

SEQ ID NO: 44178 - DNA, 19 bp, Homo sapiens
ggcgcaatgaaggtgaagg

SEQ ID NO: 44179 - DNA, 20 bp, Homo sapiens
ggcgcaatgaaggtgaaggc

SEQ ID NO: 44180 - DNA, 21 bp, Homo sapiens
ggcgcaatgaaggtgaaggcc

SEQ ID NO: 44181 - DNA, 22 bp, Homo sapiens
ggcgcaatgaaggtgaaggccg

SEQ ID NO: 44182 - DNA, 23 bp, Homo sapiens
ggcgcaatgaaggtgaaggccgg

SEQ ID NO: 44183 - DNA, 24 bp, Homo sapiens
ggcgcaatgaaggtgaaggccggc

SEQ ID NO: 44184 - DNA, 25 bp, Homo sapiens
ggcgcaatgaaggtgaaggccggcg

SEQ ID NO: 44185 - DNA, 26 bp, Homo sapiens
ggcgcaatgaaggtgaaggccggcgc

SEQ ID NO: 44186 - DNA, 20 bp, Homo sapiens
gcgcaatgaaggtgaaggcc

SEQ ID NO: 44187 - DNA, 21 bp, Homo sapiens
gcgcaatgaaggtgaaggccg

SEQ ID NO: 44188 - DNA, 22 bp, Homo sapiens
gcgcaatgaaggtgaaggccgg

SEQ ID NO: 44189 - DNA, 23 bp, Homo sapiens
gcgcaatgaaggtgaaggccggc

SEQ ID NO: 44190 - DNA, 24 bp, Homo sapiens
gcgcaatgaaggtgaaggccggcg

SEQ ID NO: 44191 - DNA, 25 bp, Homo sapiens
gcgcaatgaaggtgaaggccggcgc

SEQ ID NO: 44192 - DNA, 21 bp, Homo sapiens
cgcaatgaaggtgaaggccgg

SEQ ID NO: 44193 - DNA, 22 bp, Homo sapiens
cgcaatgaaggtgaaggccggc

SEQ ID NO: 44194 - DNA, 18 bp, Homo sapiens
gcaatgaaggtgaaggcc

SEQ ID NO: 44195 - DNA, 19 bp, Homo sapiens
gcaatgaaggtgaaggccg

SEQ ID NO: 44196 - DNA, 20 bp, Homo sapiens
gcaatgaaggtgaaggccgg

SEQ ID NO: 44197 - DNA, 21 bp, Homo sapiens
gcaatgaaggtgaaggccggc

SEQ ID NO: 44198 - DNA, 22 bp, Homo sapiens
gcaatgaaggtgaaggccggcg

SEQ ID NO: 44199 - DNA, 23 bp, Homo sapiens
gcaatgaaggtgaaggccggcgc

SEQ ID NO: 44200 - DNA, 19 bp, Homo sapiens
caatgaaggtgaaggccgg

SEQ ID NO: 44201 - DNA, 20 bp, Homo sapiens
caatgaaggtgaaggccggc

SEQ ID NO: 44202 - DNA, 21 bp, Homo sapiens
caatgaaggtgaaggccggcg

SEQ ID NO: 44203 - DNA, 22 bp, Homo sapiens
caatgaaggtgaaggccggcgc

SEQ ID NO: 44204 - DNA, 20 bp, Homo sapiens
atgaaggtgaaggccggcgc

SEQ ID NO: 44205 - DNA, 18 bp, Homo sapiens
gaaggtgaaggccggcgc

SEQ ID NO: 44206 - DNA, 21 bp, Homo sapiens
gaaggtgaaggccggcgcgct

SEQ ID NO: 44207 - DNA, 16 bp, Homo sapiens
aaggtgaaggccggcg

SEQ ID NO: 44208 - DNA, 17 bp, Homo sapiens
aaggtgaaggccggcgc

SEQ ID NO: 44209 - DNA, 18 bp, Homo sapiens
aaggtgaaggccggcgcg

SEQ ID NO: 44210 - DNA, 20 bp, Homo sapiens
aaggtgaaggccggcgcgct

SEQ ID NO: 44211 - DNA, 21 bp, Homo sapiens
ggtgaaggccggcgcgctcgc

SEQ ID NO: 44212 - DNA, 20 bp, Homo sapiens
gtgaaggccggcgcgctcgc

SEQ ID NO: 44213 - DNA, 21 bp, Homo sapiens
gtgaaggccggcgcgctcgcc

SEQ ID NO: 44214 - DNA, 19 bp, Homo sapiens
gaaggccggcgcgctcgcc

SEQ ID NO: 44215 - DNA, 18 bp, Homo sapiens
aaggccggcgcgctcgcc

SEQ ID NO: 44216 - DNA, 16 bp, Homo sapiens
ggcgcgctcgccggcc

SEQ ID NO: 44217 - DNA, 19 bp, Homo sapiens
ggcgcgctcgccggccgag

SEQ ID NO: 44218 - DNA, 20 bp, Homo sapiens
ggcgcgctcgccggccgagg

SEQ ID NO: 44219 - DNA, 21 bp, Homo sapiens
ggcgcgctcgccggccgaggt

SEQ ID NO: 44220 - DNA, 22 bp, Homo sapiens
ggcgcgctcgccggccgaggtg

SEQ ID NO: 44221 - DNA, 23 bp, Homo sapiens
ggcgcgctcgccggccgaggtgg

SEQ ID NO: 44222 - DNA, 24 bp, Homo sapiens
ggcgcgctcgccggccgaggtggg

SEQ ID NO: 44223 - DNA, 25 bp, Homo sapiens
ggcgcgctcgccggccgaggtggga

SEQ ID NO: 44224 - DNA, 26 bp, Homo sapiens
ggcgcgctcgccggccgaggtgggat

SEQ ID NO: 44225 - DNA, 30 bp, Homo sapiens
ggcgcgctcgccggccgaggtgggatcccg

SEQ ID NO: 44226 - DNA, 18 bp, Homo sapiens
gcgcgctcgccggccgag

SEQ ID NO: 44227 - DNA, 19 bp, Homo sapiens
gcgcgctcgccggccgagg

SEQ ID NO: 44228 - DNA, 20 bp, Homo sapiens
gcgcgctcgccggccgaggt

SEQ ID NO: 44229 - DNA, 21 bp, Homo sapiens
gcgcgctcgccggccgaggtg

SEQ ID NO: 44230 - DNA, 22 bp, Homo sapiens
gcgcgctcgccggccgaggtgg

SEQ ID NO: 44231 - DNA, 23 bp, Homo sapiens
gcgcgctcgccggccgaggtggg

SEQ ID NO: 44232 - DNA, 24 bp, Homo sapiens
gcgcgctcgccggccgaggtggga

SEQ ID NO: 44233 - DNA, 29 bp, Homo sapiens
gcgcgctcgccggccgaggtgggatcccg

SEQ ID NO: 44234 - DNA, 17 bp, Homo sapiens
cgcgctcgccggccgag

SEQ ID NO: 44235 - DNA, 18 bp, Homo sapiens
cgcgctcgccggccgagg

SEQ ID NO: 44236 - DNA, 19 bp, Homo sapiens
cgcgctcgccggccgaggt

SEQ ID NO: 44237 - DNA, 20 bp, Homo sapiens
cgcgctcgccggccgaggtg

SEQ ID NO: 44238 - DNA, 21 bp, Homo sapiens
cgcgctcgccggccgaggtgg

SEQ ID NO: 44239 - DNA, 22 bp, Homo sapiens
cgcgctcgccggccgaggtggg

SEQ ID NO: 44240 - DNA, 23 bp, Homo sapiens
cgcgctcgccggccgaggtggga

SEQ ID NO: 44241 - DNA, 30 bp, Homo sapiens; identical to SEQ ID NO: 4345

SEQ ID NO: 44242 - DNA, 16 bp, Homo sapiens
gcgctcgccggccgag

SEQ ID NO: 44243 - DNA, 17 bp, Homo sapiens
gcgctcgccggccgagg

SEQ ID NO: 44244 - DNA, 18 bp, Homo sapiens
gcgctcgccggccgaggt

SEQ ID NO: 44245 - DNA, 19 bp, Homo sapiens
gcgctcgccggccgaggtg

SEQ ID NO: 44246 - DNA, 20 bp, Homo sapiens
gcgctcgccggccgaggtgg

SEQ ID NO: 44247 - DNA, 21 bp, Homo sapiens
gcgctcgccggccgaggtggg

SEQ ID NO: 44248 - DNA, 22 bp, Homo sapiens
gcgctcgccggccgaggtggga

SEQ ID NO: 44249 - DNA, 29 bp, Homo sapiens
gcgctcgccggccgaggtgggatcccgag

SEQ ID NO: 44250 - DNA, 30 bp, Homo sapiens; identical to SEQ ID NO: 20406

SEQ ID NO: 44251 - DNA, 16 bp, Homo sapiens
cgctcgccggccgagg

SEQ ID NO: 44252 - DNA, 17 bp, Homo sapiens
cgctcgccggccgaggt

SEQ ID NO: 44253 - DNA, 18 bp, Homo sapiens
cgctcgccggccgaggtg

SEQ ID NO: 44254 - DNA, 19 bp, Homo sapiens
cgctcgccggccgaggtgg

SEQ ID NO: 44255 - DNA, 20 bp, Homo sapiens
cgctcgccggccgaggtggg

SEQ ID NO: 44256 - DNA, 21 bp, Homo sapiens
cgctcgccggccgaggtggga

SEQ ID NO: 44257 - DNA, 18 bp, Homo sapiens
gctcgccggccgaggtgg

SEQ ID NO: 44258 - DNA, 17 bp, Homo sapiens
ctcgccggccgaggtgg

SEQ ID NO: 44259 - DNA, 26 bp, Homo sapiens
ctcgccggccgaggtgggatcccgag

SEQ ID NO: 44260 - DNA, 24 bp, Homo sapiens
cgccggccgaggtgggatcccgag

SEQ ID NO: 44261 - DNA, 25 bp, Homo sapiens
cgccggccgaggtgggatcccgagg

SEQ ID NO: 44262 - DNA, 21 bp, Homo sapiens
gccggccgaggtgggatcccg

SEQ ID NO: 44263 - DNA, 22 bp, Homo sapiens
gccggccgaggtgggatcccga

SEQ ID NO: 44264 - DNA, 23 bp, Homo sapiens
gccggccgaggtgggatcccgag

SEQ ID NO: 44265 - DNA, 24 bp, Homo sapiens
gccggccgaggtgggatcccgagg

SEQ ID NO: 44266 - DNA, 25 bp, Homo sapiens
gccggccgaggtgggatcccgaggc

SEQ ID NO: 44267 - DNA, 21 bp, Homo sapiens
ccggccgaggtgggatcccga

SEQ ID NO: 44268 - DNA, 22 bp, Homo sapiens
ccggccgaggtgggatcccgag

SEQ ID NO: 44269 - DNA, 23 bp, Homo sapiens
ccggccgaggtgggatcccgagg

SEQ ID NO: 44270 - DNA, 24 bp, Homo sapiens
ccggccgaggtgggatcccgaggc

SEQ ID NO: 44271 - DNA, 20 bp, Homo sapiens
cggccgaggtgggatcccga

SEQ ID NO: 44272 - DNA, 21 bp, Homo sapiens
cggccgaggtgggatcccgag

SEQ ID NO: 44273 - DNA, 22 bp, Homo sapiens
cggccgaggtgggatcccgagg

SEQ ID NO: 44274 - DNA, 23 bp, Homo sapiens
cggccgaggtgggatcccgaggc

SEQ ID NO: 44275 - DNA, 18 bp, Homo sapiens
ggccgaggtgggatcccg

SEQ ID NO: 44276 - DNA, 19 bp, Homo sapiens
ggccgaggtgggatcccga

SEQ ID NO: 44277 - DNA, 20 bp, Homo sapiens
ggccgaggtgggatcccgag

SEQ ID NO: 44278 - DNA, 21 bp, Homo sapiens
ggccgaggtgggatcccgagg

SEQ ID NO: 44279 - DNA, 22 bp, Homo sapiens
ggccgaggtgggatcccgaggc

SEQ ID NO: 44280 - DNA, 25 bp, Homo sapiens
ggccgaggtgggatcccgaggcctc

SEQ ID NO: 44281 - DNA, 30 bp, Homo sapiens
ggccgaggtgggatcccgaggcctctccag

SEQ ID NO: 44282 - DNA, 17 bp, Homo sapiens
gccgaggtgggatcccg

SEQ ID NO: 44283 - DNA, 19 bp, Homo sapiens
gccgaggtgggatcccgag

SEQ ID NO: 44284 - DNA, 20 bp, Homo sapiens
gccgaggtgggatcccgagg

SEQ ID NO: 44285 - DNA, 21 bp, Homo sapiens
gccgaggtgggatcccgaggc

SEQ ID NO: 44286 - DNA, 29 bp, Homo sapiens
gccgaggtgggatcccgaggcctctccag

SEQ ID NO: 44287 - DNA, 16 bp, Homo sapiens
ccgaggtgggatcccg

SEQ ID NO: 44288 - DNA, 18 bp, Homo sapiens
ccgaggtgggatcccgag

SEQ ID NO: 44289 - DNA, 19 bp, Homo sapiens
ccgaggtgggatcccgagg

SEQ ID NO: 44290 - DNA, 20 bp, Homo sapiens
ccgaggtgggatcccgaggc

SEQ ID NO: 44291 - DNA, 21 bp, Homo sapiens
ccgaggtgggatcccgaggcc

SEQ ID NO: 44292 - DNA, 22 bp, Homo sapiens
ccgaggtgggatcccgaggcct

SEQ ID NO: 44293 - DNA, 23 bp, Homo sapiens
ccgaggtgggatcccgaggcctc

SEQ ID NO: 44294 - DNA, 24 bp, Homo sapiens
ccgaggtgggatcccgaggcctct

SEQ ID NO: 44295 - DNA, 26 bp, Homo sapiens
ccgaggtgggatcccgaggcctctcc

SEQ ID NO: 44296 - DNA, 17 bp, Homo sapiens
cgaggtgggatcccgag

SEQ ID NO: 44297 - DNA, 19 bp, Homo sapiens
cgaggtgggatcccgaggc

SEQ ID NO: 44298 - DNA, 20 bp, Homo sapiens
cgaggtgggatcccgaggcc

SEQ ID NO: 44299 - DNA, 21 bp, Homo sapiens
cgaggtgggatcccgaggcct

SEQ ID NO: 44300 - DNA, 22 bp, Homo sapiens
cgaggtgggatcccgaggcctc

SEQ ID NO: 44301 - DNA, 23 bp, Homo sapiens
cgaggtgggatcccgaggcctct

SEQ ID NO: 44302 - DNA, 24 bp, Homo sapiens
cgaggtgggatcccgaggcctctc

SEQ ID NO: 44303 - DNA, 25 bp, Homo sapiens
cgaggtgggatcccgaggcctctcc

SEQ ID NO: 44304 - DNA, 26 bp, Homo sapiens
cgaggtgggatcccgaggcctctcca

SEQ ID NO: 44305 - DNA, 27 bp, Homo sapiens
cgaggtgggatcccgaggcctctccag

SEQ ID NO: 44306 - DNA, 16 bp, Homo sapiens
gaggtgggatcccgag

SEQ ID NO: 44307 - DNA, 17 bp, Homo sapiens
gaggtgggatcccgagg

SEQ ID NO: 44308 - DNA, 18 bp, Homo sapiens
gaggtgggatcccgaggc

SEQ ID NO: 44309 - DNA, 19 bp, Homo sapiens
gaggtgggatcccgaggcc

SEQ ID NO: 44310 - DNA, 20 bp, Homo sapiens
gaggtgggatcccgaggcct

SEQ ID NO: 44311 - DNA, 21 bp, Homo sapiens
gaggtgggatcccgaggcctc

SEQ ID NO: 44312 - DNA, 22 bp, Homo sapiens
gaggtgggatcccgaggcctct

SEQ ID NO: 44313 - DNA, 24 bp, Homo sapiens
gaggtgggatcccgaggcctctcc

SEQ ID NO: 44314 - DNA, 26 bp, Homo sapiens
gaggtgggatcccgaggcctctccag

SEQ ID NO: 44315 - DNA, 22 bp, Homo sapiens
ggtgggatcccgaggcctctcc

SEQ ID NO: 44316 - DNA, 23 bp, Homo sapiens
tgggatcccgaggcctctccagt

SEQ ID NO: 44317 - DNA, 19 bp, Homo sapiens
gggatcccgaggcctctcc

SEQ ID NO: 44318 - DNA, 21 bp, Homo sapiens
gggatcccgaggcctctccag

SEQ ID NO: 44319 - DNA, 22 bp, Homo sapiens
gggatcccgaggcctctccagt

SEQ ID NO: 44320 - DNA, 18 bp, Homo sapiens
ggatcccgaggcctctcc

SEQ ID NO: 44321 - DNA, 20 bp, Homo sapiens
ggatcccgaggcctctccag

SEQ ID NO: 44322 - DNA, 21 bp, Homo sapiens
ggatcccgaggcctctccagt

SEQ ID NO: 44323 - DNA, 17 bp, Homo sapiens
gatcccgaggcctctcc

SEQ ID NO: 44324 - DNA, 18 bp, Homo sapiens
gatcccgaggcctctcca

SEQ ID NO: 44325 - DNA, 19 bp, Homo sapiens
gatcccgaggcctctccag

SEQ ID NO: 44326 - DNA, 20 bp, Homo sapiens
gatcccgaggcctctccagt

SEQ ID NO: 44327 - DNA, 21 bp, Homo sapiens
gatcccgaggcctctccagtc

SEQ ID NO: 44328 - DNA, 19 bp, Homo sapiens
atcccgaggcctctccagt

SEQ ID NO: 44329 - DNA, 23 bp, Homo sapiens
gaggcctctccagtccgccgagg

SEQ ID NO: 44330 - DNA, 24 bp, Homo sapiens
gaggcctctccagtccgccgaggg

SEQ ID NO: 44331 - DNA, 21 bp, Homo sapiens
aggcctctccagtccgccgag

SEQ ID NO: 44332 - DNA, 19 bp, Homo sapiens
gcctctccagtccgccgag

SEQ ID NO: 44333 - DNA, 21 bp, Homo sapiens
gcctctccagtccgccgaggg

SEQ ID NO: 44334 - DNA, 16 bp, Homo sapiens
cctctccagtccgccg

SEQ ID NO: 44335 - DNA, 18 bp, Homo sapiens
cctctccagtccgccgag

SEQ ID NO: 44336 - DNA, 19 bp, Homo sapiens
cctctccagtccgccgagg

SEQ ID NO: 44337 - DNA, 20 bp, Homo sapiens
cctctccagtccgccgaggg

SEQ ID NO: 44338 - DNA, 22 bp, Homo sapiens
ctctccagtccgccgagggcgc

SEQ ID NO: 44339 - DNA, 21 bp, Homo sapiens
tctccagtccgccgagggcgc

SEQ ID NO: 44340 - DNA, 20 bp, Homo sapiens
tccagtccgccgagggcgca

SEQ ID NO: 44341 - DNA, 19 bp, Homo sapiens
agtccgccgagggcgcacc

SEQ ID NO: 44342 - DNA, 24 bp, Homo sapiens
agtccgccgagggcgcaccaccgg

SEQ ID NO: 44343 - DNA, 25 bp, Homo sapiens
agtccgccgagggcgcaccaccggc

SEQ ID NO: 44344 - DNA, 26 bp, Homo sapiens
agtccgccgagggcgcaccaccggcc

SEQ ID NO: 44345 - DNA, 30 bp, Homo sapiens
agtccgccgagggcgcaccaccggcccgtc

SEQ ID NO: 44346 - DNA, 18 bp, Homo sapiens
gtccgccgagggcgcacc

SEQ ID NO: 44347 - DNA, 21 bp, Homo sapiens
gtccgccgagggcgcaccacc

SEQ ID NO: 44348 - DNA, 22 bp, Homo sapiens
gtccgccgagggcgcaccaccg

SEQ ID NO: 44349 - DNA, 23 bp, Homo sapiens
gtccgccgagggcgcaccaccgg

SEQ ID NO: 44350 - DNA, 24 bp, Homo sapiens
gtccgccgagggcgcaccaccggc

SEQ ID NO: 44351 - DNA, 25 bp, Homo sapiens
gtccgccgagggcgcaccaccggcc

SEQ ID NO: 44352 - DNA, 30 bp, Homo sapiens
gtccgccgagggcgcaccaccggcccgtct

SEQ ID NO: 44353 - DNA, 22 bp, Homo sapiens
tccgccgagggcgcaccaccgg

SEQ ID NO: 44354 - DNA, 23 bp, Homo sapiens
tccgccgagggcgcaccaccggc

SEQ ID NO: 44355 - DNA, 30 bp, Homo sapiens
tccgccgagggcgcaccaccggcccgtctc

SEQ ID NO: 44356 - DNA, 21 bp, Homo sapiens
ccgccgagggcgcaccaccgg

SEQ ID NO: 44357 - DNA, 22 bp, Homo sapiens
ccgccgagggcgcaccaccggc

SEQ ID NO: 44358 - DNA, 25 bp, Homo sapiens
ccgccgagggcgcaccaccggcccg

SEQ ID NO: 44359 - DNA, 30 bp, Homo sapiens
ccgccgagggcgcaccaccggcccgtctcg

SEQ ID NO: 44360 - DNA, 20 bp, Homo sapiens
cgccgagggcgcaccaccgg

SEQ ID NO: 44361 - DNA, 21 bp, Homo sapiens
cgccgagggcgcaccaccggc

SEQ ID NO: 44362 - DNA, 22 bp, Homo sapiens
cgccgagggcgcaccaccggcc

SEQ ID NO: 44363 - DNA, 18 bp, Homo sapiens
gccgagggcgcaccaccg

SEQ ID NO: 44364 - DNA, 19 bp, Homo sapiens
gccgagggcgcaccaccgg

SEQ ID NO: 44365 - DNA, 20 bp, Homo sapiens
gccgagggcgcaccaccggc

SEQ ID NO: 44366 - DNA, 19 bp, Homo sapiens
ccgagggcgcaccaccggc

SEQ ID NO: 44367 - DNA, 20 bp, Homo sapiens
ccgagggcgcaccaccggcc

SEQ ID NO: 44368 - DNA, 22 bp, Homo sapiens
ccgagggcgcaccaccggcccg

SEQ ID NO: 44369 - DNA, 18 bp, Homo sapiens
cgagggcgcaccaccggc

SEQ ID NO: 44370 - DNA, 19 bp, Homo sapiens
cgagggcgcaccaccggcc

SEQ ID NO: 44371 - DNA, 28 bp, Homo sapiens
cgagggcgcaccaccggcccgtctcgcc

SEQ ID NO: 44372 - DNA, 20 bp, Homo sapiens
ggcgcaccaccggcccgtct

SEQ ID NO: 44373 - DNA, 18 bp, Homo sapiens
gcgcaccaccggcccgtc

SEQ ID NO: 44374 - DNA, 21 bp, Homo sapiens
gcgcaccaccggcccgtctcg

SEQ ID NO: 44375 - DNA, 22 bp, Homo sapiens
gcgcaccaccggcccgtctcgc

SEQ ID NO: 44376 - DNA, 17 bp, Homo sapiens
cgcaccaccggcccgtc

SEQ ID NO: 44377 - DNA, 18 bp, Homo sapiens
cgcaccaccggcccgtct

SEQ ID NO: 44378 - DNA, 20 bp, Homo sapiens
cgcaccaccggcccgtctcg

SEQ ID NO: 44379 - DNA, 21 bp, Homo sapiens
cgcaccaccggcccgtctcgc

SEQ ID NO: 44380 - DNA, 20 bp, Homo sapiens
gcaccaccggcccgtctcgc

SEQ ID NO: 44381 - DNA, 17 bp, Homo sapiens
ggcccgtctcgcccgcc

SEQ ID NO: 44382 - DNA, 18 bp, Homo sapiens
ggcccgtctcgcccgccg

SEQ ID NO: 44383 - DNA, 20 bp, Homo sapiens
ggcccgtctcgcccgccgcg

SEQ ID NO: 44384 - DNA, 21 bp, Homo sapiens
ggcccgtctcgcccgccgcgc

SEQ ID NO: 44385 - DNA, 24 bp, Homo sapiens
ggcccgtctcgcccgccgcgccgg

SEQ ID NO: 44386 - DNA, 25 bp, Homo sapiens
ggcccgtctcgcccgccgcgccggg

SEQ ID NO: 44387 - DNA, 23 bp, Homo sapiens
cgtctcgcccgccgcgccgggga

SEQ ID NO: 44388 - DNA, 22 bp, Homo sapiens
gtctcgcccgccgcgccgggga

SEQ ID NO: 44389 - DNA, 20 bp, Homo sapiens
tctcgcccgccgcgccgggg

SEQ ID NO: 44390 - DNA, 19 bp, Homo sapiens
ctcgcccgccgcgccgggg

SEQ ID NO: 44391 - DNA, 20 bp, Homo sapiens
ctcgcccgccgcgccgggga

SEQ ID NO: 44392 - DNA, 19 bp, Homo sapiens
tcgcccgccgcgccgggga

SEQ ID NO: 44393 - DNA, 21 bp, Homo sapiens
tcgcccgccgcgccggggagg

SEQ ID NO: 44394 - DNA, 23 bp, Homo sapiens
tcgcccgccgcgccggggaggtg

SEQ ID NO: 44395 - DNA, 16 bp, Homo sapiens
cgcccgccgcgccggg

SEQ ID NO: 44396 - DNA, 17 bp, Homo sapiens
cgcccgccgcgccgggg

SEQ ID NO: 44397 - DNA, 18 bp, Homo sapiens
cgcccgccgcgccgggga

SEQ ID NO: 44398 - DNA, 19 bp, Homo sapiens
cgcccgccgcgccggggag

SEQ ID NO: 44399 - DNA, 20 bp, Homo sapiens
cgcccgccgcgccggggagg

SEQ ID NO: 44400 - DNA, 21 bp, Homo sapiens
cgcccgccgcgccggggaggt

SEQ ID NO: 44401 - DNA, 22 bp, Homo sapiens
cgcccgccgcgccggggaggtg

SEQ ID NO: 44402 - DNA, 23 bp, Homo sapiens
cgcccgccgcgccggggaggtgg

SEQ ID NO: 44403 - DNA, 24 bp, Homo sapiens
cgcccgccgcgccggggaggtgga

SEQ ID NO: 44404 - DNA, 25 bp, Homo sapiens
cgcccgccgcgccggggaggtggag

SEQ ID NO: 44405 - DNA, 26 bp, Homo sapiens
cgcccgccgcgccggggaggtggagc

SEQ ID NO: 44406 - DNA, 16 bp, Homo sapiens
cccgccgcgccgggga

SEQ ID NO: 44407 - DNA, 18 bp, Homo sapiens
cccgccgcgccggggagg

SEQ ID NO: 44408 - DNA, 21 bp, Homo sapiens
cccgccgcgccggggaggtgg

SEQ ID NO: 44409 - DNA, 22 bp, Homo sapiens
cccgccgcgccggggaggtgga

SEQ ID NO: 44410 - DNA, 24 bp, Homo sapiens
cccgccgcgccggggaggtggagc

SEQ ID NO: 44411 - DNA, 16 bp, Homo sapiens
cgccgcgccggggagg

SEQ ID NO: 44412 - DNA, 18 bp, Homo sapiens
cgccgcgccggggaggtg

SEQ ID NO: 44413 - DNA, 19 bp, Homo sapiens
cgccgcgccggggaggtgg

SEQ ID NO: 44414 - DNA, 20 bp, Homo sapiens
cgccgcgccggggaggtgga

SEQ ID NO: 44415 - DNA, 21 bp, Homo sapiens
cgccgcgccggggaggtggag

SEQ ID NO: 44416 - DNA, 22 bp, Homo sapiens
cgccgcgccggggaggtggagc

SEQ ID NO: 44417 - DNA, 17 bp, Homo sapiens
gccgcgccggggaggtg

SEQ ID NO: 44418 - DNA, 18 bp, Homo sapiens
gccgcgccggggaggtgg

SEQ ID NO: 44419 - DNA, 19 bp, Homo sapiens
gccgcgccggggaggtgga

SEQ ID NO: 44420 - DNA, 20 bp, Homo sapiens
gccgcgccggggaggtggag

SEQ ID NO: 44421 - DNA, 21 bp, Homo sapiens
gccgcgccggggaggtggagc

SEQ ID NO: 44422 - DNA, 22 bp, Homo sapiens
gccgcgccggggaggtggagca

SEQ ID NO: 44423 - DNA, 20 bp, Homo sapiens
ccgcgccggggaggtggagc

SEQ ID NO: 44424 - DNA, 17 bp, Homo sapiens
gcgccggggaggtggag

SEQ ID NO: 44425 - DNA, 18 bp, Homo sapiens
gcgccggggaggtggagc

SEQ ID NO: 44426 - DNA, 20 bp, Homo sapiens
ggggaggtggagcacgagcg

SEQ ID NO: 44427 - DNA, 22 bp, Homo sapiens
ggggaggtggagcacgagcgca

SEQ ID NO: 44428 - DNA, 24 bp, Homo sapiens
ggagcacgagcgcacgtgttagga

SEQ ID NO: 44429 - DNA, 23 bp, Homo sapiens
gagcacgagcgcacgtgttagga

SEQ ID NO: 44430 - DNA, 25 bp, Homo sapiens
gagcacgagcgcacgtgttaggacc

SEQ ID NO: 44431 - DNA, 30 bp, Homo sapiens
agcacgagcgcacgtgttaggacccgaaag

SEQ ID NO: 44432 - DNA, 22 bp, Homo sapiens
gcacgagcgcacgtgttaggac

SEQ ID NO: 44433 - DNA, 23 bp, Homo sapiens
gcacgagcgcacgtgttaggacc

SEQ ID NO: 44434 - DNA, 25 bp, Homo sapiens
gcacgagcgcacgtgttaggacccg

SEQ ID NO: 44435 - DNA, 26 bp, Homo sapiens
gcacgagcgcacgtgttaggacccga

SEQ ID NO: 44436 - DNA, 28 bp, Homo sapiens
gcacgagcgcacgtgttaggacccgaaa

SEQ ID NO: 44437 - DNA, 29 bp, Homo sapiens
gcacgagcgcacgtgttaggacccgaaag

SEQ ID NO: 44438 - DNA, 18 bp, Homo sapiens
cacgagcgcacgtgttag

SEQ ID NO: 44439 - DNA, 19 bp, Homo sapiens
cacgagcgcacgtgttagg

SEQ ID NO: 44440 - DNA, 20 bp, Homo sapiens
cacgagcgcacgtgttagga

SEQ ID NO: 44441 - DNA, 21 bp, Homo sapiens
cacgagcgcacgtgttaggac

SEQ ID NO: 44442 - DNA, 22 bp, Homo sapiens
cacgagcgcacgtgttaggacc

SEQ ID NO: 44443 - DNA, 23 bp, Homo sapiens
cacgagcgcacgtgttaggaccc

SEQ ID NO: 44444 - DNA, 24 bp, Homo sapiens
cacgagcgcacgtgttaggacccg

SEQ ID NO: 44445 - DNA, 25 bp, Homo sapiens
cacgagcgcacgtgttaggacccga

SEQ ID NO: 44446 - DNA, 27 bp, Homo sapiens
cacgagcgcacgtgttaggacccgaaa

SEQ ID NO: 44447 - DNA, 28 bp, Homo sapiens
cacgagcgcacgtgttaggacccgaaag

SEQ ID NO: 44448 - DNA, 29 bp, Homo sapiens
cacgagcgcacgtgttaggacccgaaaga

SEQ ID NO: 44449 - DNA, 18 bp, Homo sapiens
acgagcgcacgtgttagg

SEQ ID NO: 44450 - DNA, 19 bp, Homo sapiens
acgagcgcacgtgttagga

SEQ ID NO: 44451 - DNA, 20 bp, Homo sapiens
acgagcgcacgtgttaggac

SEQ ID NO: 44452 - DNA, 21 bp, Homo sapiens
acgagcgcacgtgttaggacc

SEQ ID NO: 44453 - DNA, 23 bp, Homo sapiens
acgagcgcacgtgttaggacccg

SEQ ID NO: 44454 - DNA, 24 bp, Homo sapiens
acgagcgcacgtgttaggacccga

SEQ ID NO: 44455 - DNA, 25 bp, Homo sapiens
acgagcgcacgtgttaggacccgaa

SEQ ID NO: 44456 - DNA, 26 bp, Homo sapiens
acgagcgcacgtgttaggacccgaaa

SEQ ID NO: 44457 - DNA, 27 bp, Homo sapiens
acgagcgcacgtgttaggacccgaaag

SEQ ID NO: 44458 - DNA, 28 bp, Homo sapiens
acgagcgcacgtgttaggacccgaaaga

SEQ ID NO: 44459 - DNA, 29 bp, Homo sapiens
acgagcgcacgtgttaggacccgaaagat

SEQ ID NO: 44460 - DNA, 30 bp, Homo sapiens
acgagcgcacgtgttaggacccgaaagatg

SEQ ID NO: 44461 - DNA, 17 bp, Homo sapiens
cgagcgcacgtgttagg

SEQ ID NO: 44462 - DNA, 18 bp, Homo sapiens
cgagcgcacgtgttagga

SEQ ID NO: 44463 - DNA, 19 bp, Homo sapiens
cgagcgcacgtgttaggac

SEQ ID NO: 44464 - DNA, 20 bp, Homo sapiens
cgagcgcacgtgttaggacc

SEQ ID NO: 44465 - DNA, 21 bp, Homo sapiens
cgagcgcacgtgttaggaccc

SEQ ID NO: 44466 - DNA, 22 bp, Homo sapiens
cgagcgcacgtgttaggacccg

SEQ ID NO: 44467 - DNA, 23 bp, Homo sapiens
cgagcgcacgtgttaggacccga

SEQ ID NO: 44468 - DNA, 24 bp, Homo sapiens
cgagcgcacgtgttaggacccgaa

SEQ ID NO: 44469 - DNA, 25 bp, Homo sapiens
cgagcgcacgtgttaggacccgaaa

SEQ ID NO: 44470 - DNA, 26 bp, Homo sapiens
cgagcgcacgtgttaggacccgaaag

SEQ ID NO: 44471 - DNA, 27 bp, Homo sapiens
cgagcgcacgtgttaggacccgaaaga

SEQ ID NO: 44472 - DNA, 28 bp, Homo sapiens
cgagcgcacgtgttaggacccgaaagat

SEQ ID NO: 44473 - DNA, 29 bp, Homo sapiens
cgagcgcacgtgttaggacccgaaagatg

SEQ ID NO: 44474 - DNA, 30 bp, Homo sapiens; identical to SEQ ID NO: 20525

SEQ ID NO: 44475 - DNA, 17 bp, Homo sapiens
gagcgcacgtgttagga

SEQ ID NO: 44476 - DNA, 18 bp, Homo sapiens
gagcgcacgtgttaggac

SEQ ID NO: 44477 - DNA, 19 bp, Homo sapiens
gagcgcacgtgttaggacc

SEQ ID NO: 44478 - DNA, 21 bp, Homo sapiens
gagcgcacgtgttaggacccg

SEQ ID NO: 44479 - DNA, 22 bp, Homo sapiens
gagcgcacgtgttaggacccga

SEQ ID NO: 44480 - DNA, 23 bp, Homo sapiens
gagcgcacgtgttaggacccgaa

SEQ ID NO: 44481 - DNA, 24 bp, Homo sapiens
gagcgcacgtgttaggacccgaaa

SEQ ID NO: 44482 - DNA, 25 bp, Homo sapiens
gagcgcacgtgttaggacccgaaag

SEQ ID NO: 44483 - DNA, 26 bp, Homo sapiens
gagcgcacgtgttaggacccgaaaga

SEQ ID NO: 44484 - DNA, 27 bp, Homo sapiens
gagcgcacgtgttaggacccgaaagat

SEQ ID NO: 44485 - DNA, 28 bp, Homo sapiens
gagcgcacgtgttaggacccgaaagatg

SEQ ID NO: 44486 - DNA, 29 bp, Homo sapiens
gagcgcacgtgttaggacccgaaagatgg

SEQ ID NO: 44487 - DNA, 16 bp, Homo sapiens
agcgcacgtgttagga

SEQ ID NO: 44488 - DNA, 17 bp, Homo sapiens
agcgcacgtgttaggac

SEQ ID NO: 44489 - DNA, 18 bp, Homo sapiens
agcgcacgtgttaggacc

SEQ ID NO: 44490 - DNA, 19 bp, Homo sapiens
agcgcacgtgttaggaccc

SEQ ID NO: 44491 - DNA, 20 bp, Homo sapiens
agcgcacgtgttaggacccg

SEQ ID NO: 44492 - DNA, 21 bp, Homo sapiens
agcgcacgtgttaggacccga

SEQ ID NO: 44493 - DNA, 22 bp, Homo sapiens
agcgcacgtgttaggacccgaa

SEQ ID NO: 44494 - DNA, 23 bp, Homo sapiens
agcgcacgtgttaggacccgaaa

SEQ ID NO: 44495 - DNA, 24 bp, Homo sapiens
agcgcacgtgttaggacccgaaag

SEQ ID NO: 44496 - DNA, 25 bp, Homo sapiens
agcgcacgtgttaggacccgaaaga

SEQ ID NO: 44497 - DNA, 26 bp, Homo sapiens
agcgcacgtgttaggacccgaaagat

SEQ ID NO: 44498 - DNA, 27 bp, Homo sapiens
agcgcacgtgttaggacccgaaagatg

SEQ ID NO: 44499 - DNA, 28 bp, Homo sapiens
agcgcacgtgttaggacccgaaagatgg

SEQ ID NO: 44500 - DNA, 29 bp, Homo sapiens
agcgcacgtgttaggacccgaaagatggt

SEQ ID NO: 44501 - DNA, 30 bp, Homo sapiens; identical to SEQ ID NO: 20545

SEQ ID NO: 44502 - DNA, 18 bp, Homo sapiens
gcgcacgtgttaggaccc

SEQ ID NO: 44503 - DNA, 19 bp, Homo sapiens
gcgcacgtgttaggacccg

SEQ ID NO: 44504 - DNA, 20 bp, Homo sapiens
gcgcacgtgttaggacccga

SEQ ID NO: 44505 - DNA, 22 bp, Homo sapiens
gcgcacgtgttaggacccgaaa

SEQ ID NO: 44506 - DNA, 23 bp, Homo sapiens
gcgcacgtgttaggacccgaaag

SEQ ID NO: 44507 - DNA, 24 bp, Homo sapiens
gcgcacgtgttaggacccgaaaga

SEQ ID NO: 44508 - DNA, 25 bp, Homo sapiens
gcgcacgtgttaggacccgaaagat

SEQ ID NO: 44509 - DNA, 26 bp, Homo sapiens
gcgcacgtgttaggacccgaaagatg

SEQ ID NO: 44510 - DNA, 27 bp, Homo sapiens
gcgcacgtgttaggacccgaaagatgg

SEQ ID NO: 44511 - DNA, 28 bp, Homo sapiens
gcgcacgtgttaggacccgaaagatggt

SEQ ID NO: 44512 - DNA, 29 bp, Homo sapiens
gcgcacgtgttaggacccgaaagatggtg

SEQ ID NO: 44513 - DNA, 18 bp, Homo sapiens
cgcacgtgttaggacccg

SEQ ID NO: 44514 - DNA, 19 bp, Homo sapiens
cgcacgtgttaggacccga

SEQ ID NO: 44515 - DNA, 21 bp, Homo sapiens
cgcacgtgttaggacccgaaa

SEQ ID NO: 44516 - DNA, 22 bp, Homo sapiens
cgcacgtgttaggacccgaaag

SEQ ID NO: 44517 - DNA, 23 bp, Homo sapiens
cgcacgtgttaggacccgaaaga

SEQ ID NO: 44518 - DNA, 24 bp, Homo sapiens
cgcacgtgttaggacccgaaagat

SEQ ID NO: 44519 - DNA, 25 bp, Homo sapiens
cgcacgtgttaggacccgaaagatg

SEQ ID NO: 44520 - DNA, 26 bp, Homo sapiens
cgcacgtgttaggacccgaaagatgg

SEQ ID NO: 44521 - DNA, 27 bp, Homo sapiens
cgcacgtgttaggacccgaaagatggt

SEQ ID NO: 44522 - DNA, 28 bp, Homo sapiens
cgcacgtgttaggacccgaaagatggtg

SEQ ID NO: 44523 - DNA, 18 bp, Homo sapiens
gcacgtgttaggacccga

SEQ ID NO: 44524 - DNA, 20 bp, Homo sapiens
gcacgtgttaggacccgaaa

SEQ ID NO: 44525 - DNA, 21 bp, Homo sapiens
gcacgtgttaggacccgaaag

SEQ ID NO: 44526 - DNA, 22 bp, Homo sapiens
gcacgtgttaggacccgaaaga

SEQ ID NO: 44527 - DNA, 23 bp, Homo sapiens
gcacgtgttaggacccgaaagat

SEQ ID NO: 44528 - DNA, 24 bp, Homo sapiens
gcacgtgttaggacccgaaagatg

SEQ ID NO: 44529 - DNA, 25 bp, Homo sapiens
gcacgtgttaggacccgaaagatgg

SEQ ID NO: 44530 - DNA, 26 bp, Homo sapiens
gcacgtgttaggacccgaaagatggt

SEQ ID NO: 44531 - DNA, 17 bp, Homo sapiens
cacgtgttaggacccga

SEQ ID NO: 44532 - DNA, 19 bp, Homo sapiens
cacgtgttaggacccgaaa

SEQ ID NO: 44533 - DNA, 20 bp, Homo sapiens
cacgtgttaggacccgaaag

SEQ ID NO: 44534 - DNA, 21 bp, Homo sapiens
cacgtgttaggacccgaaaga

SEQ ID NO: 44535 - DNA, 22 bp, Homo sapiens
cacgtgttaggacccgaaagat

SEQ ID NO: 44536 - DNA, 23 bp, Homo sapiens
cacgtgttaggacccgaaagatg

SEQ ID NO: 44537 - DNA, 24 bp, Homo sapiens
cacgtgttaggacccgaaagatgg

SEQ ID NO: 44538 - DNA, 25 bp, Homo sapiens
cacgtgttaggacccgaaagatggt

SEQ ID NO: 44539 - DNA, 26 bp, Homo sapiens
cacgtgttaggacccgaaagatggtg

SEQ ID NO: 44540 - DNA, 30 bp, Homo sapiens
cacgtgttaggacccgaaagatggtgaact

SEQ ID NO: 44541 - DNA, 16 bp, Homo sapiens
acgtgttaggacccga

SEQ ID NO: 44542 - DNA, 18 bp, Homo sapiens
acgtgttaggacccgaaa

SEQ ID NO: 44543 - DNA, 19 bp, Homo sapiens
acgtgttaggacccgaaag

SEQ ID NO: 44544 - DNA, 20 bp, Homo sapiens
acgtgttaggacccgaaaga

SEQ ID NO: 44545 - DNA, 21 bp, Homo sapiens
acgtgttaggacccgaaagat

SEQ ID NO: 44546 - DNA, 22 bp, Homo sapiens
acgtgttaggacccgaaagatg

SEQ ID NO: 44547 - DNA, 23 bp, Homo sapiens
acgtgttaggacccgaaagatgg

SEQ ID NO: 44548 - DNA, 24 bp, Homo sapiens
acgtgttaggacccgaaagatggt

SEQ ID NO: 44549 - DNA, 25 bp, Homo sapiens
acgtgttaggacccgaaagatggtg

SEQ ID NO: 44550 - DNA, 29 bp, Homo sapiens
acgtgttaggacccgaaagatggtgaact

SEQ ID NO: 44551 - DNA, 16 bp, Homo sapiens
cgtgttaggacccgaa

SEQ ID NO: 44552 - DNA, 17 bp, Homo sapiens
cgtgttaggacccgaaa

SEQ ID NO: 44553 - DNA, 18 bp, Homo sapiens
cgtgttaggacccgaaag

SEQ ID NO: 44554 - DNA, 19 bp, Homo sapiens
cgtgttaggacccgaaaga

SEQ ID NO: 44555 - DNA, 20 bp, Homo sapiens
cgtgttaggacccgaaagat

SEQ ID NO: 44556 - DNA, 21 bp, Homo sapiens
cgtgttaggacccgaaagatg

SEQ ID NO: 44557 - DNA, 22 bp, Homo sapiens
cgtgttaggacccgaaagatgg

SEQ ID NO: 44558 - DNA, 23 bp, Homo sapiens
cgtgttaggacccgaaagatggt

SEQ ID NO: 44559 - DNA, 24 bp, Homo sapiens
cgtgttaggacccgaaagatggtg

SEQ ID NO: 44560 - DNA, 25 bp, Homo sapiens
cgtgttaggacccgaaagatggtga

SEQ ID NO: 44561 - DNA, 26 bp, Homo sapiens
cgtgttaggacccgaaagatggtgaa

SEQ ID NO: 44562 - DNA, 27 bp, Homo sapiens
cgtgttaggacccgaaagatggtgaac

SEQ ID NO: 44563 - DNA, 28 bp, Homo sapiens
cgtgttaggacccgaaagatggtgaact

SEQ ID NO: 44564 - DNA, 29 bp, Homo sapiens
cgtgttaggacccgaaagatggtgaacta

SEQ ID NO: 44565 - DNA, 16 bp, Homo sapiens
gtgttaggacccgaaa

SEQ ID NO: 44566 - DNA, 17 bp, Homo sapiens
gtgttaggacccgaaag

SEQ ID NO: 44567 - DNA, 18 bp, Homo sapiens
gtgttaggacccgaaaga

SEQ ID NO: 44568 - DNA, 19 bp, Homo sapiens
gtgttaggacccgaaagat

SEQ ID NO: 44569 - DNA, 20 bp, Homo sapiens
gtgttaggacccgaaagatg

SEQ ID NO: 44570 - DNA, 21 bp, Homo sapiens
gtgttaggacccgaaagatgg

SEQ ID NO: 44571 - DNA, 22 bp, Homo sapiens
gtgttaggacccgaaagatggt

SEQ ID NO: 44572 - DNA, 23 bp, Homo sapiens
gtgttaggacccgaaagatggtg

SEQ ID NO: 44573 - DNA, 27 bp, Homo sapiens
gtgttaggacccgaaagatggtgaact

SEQ ID NO: 44574 - DNA, 16 bp, Homo sapiens
tgttaggacccgaaag

SEQ ID NO: 44575 - DNA, 17 bp, Homo sapiens
tgttaggacccgaaaga

SEQ ID NO: 44576 - DNA, 18 bp, Homo sapiens
tgttaggacccgaaagat

SEQ ID NO: 44577 - DNA, 19 bp, Homo sapiens
tgttaggacccgaaagatg

SEQ ID NO: 44578 - DNA, 20 bp, Homo sapiens
tgttaggacccgaaagatgg

SEQ ID NO: 44579 - DNA, 21 bp, Homo sapiens
tgttaggacccgaaagatggt

SEQ ID NO: 44580 - DNA, 22 bp, Homo sapiens
tgttaggacccgaaagatggtg

SEQ ID NO: 44581 - DNA, 23 bp, Homo sapiens
tgttaggacccgaaagatggtga

SEQ ID NO: 44582 - DNA, 24 bp, Homo sapiens
tgttaggacccgaaagatggtgaa

SEQ ID NO: 44583 - DNA, 25 bp, Homo sapiens
tgttaggacccgaaagatggtgaac

SEQ ID NO: 44584 - DNA, 26 bp, Homo sapiens
tgttaggacccgaaagatggtgaact

SEQ ID NO: 44585 - DNA, 27 bp, Homo sapiens
tgttaggacccgaaagatggtgaacta

SEQ ID NO: 44586 - DNA, 29 bp, Homo sapiens
tgttaggacccgaaagatggtgaactatg

SEQ ID NO: 44587 - DNA, 16 bp, Homo sapiens
gttaggacccgaaaga

SEQ ID NO: 44588 - DNA, 17 bp, Homo sapiens
gttaggacccgaaagat

SEQ ID NO: 44589 - DNA, 18 bp, Homo sapiens
gttaggacccgaaagatg

SEQ ID NO: 44590 - DNA, 19 bp, Homo sapiens
gttaggacccgaaagatgg

SEQ ID NO: 44591 - DNA, 20 bp, Homo sapiens
gttaggacccgaaagatggt

SEQ ID NO: 44592 - DNA, 21 bp, Homo sapiens
gttaggacccgaaagatggtg

SEQ ID NO: 44593 - DNA, 22 bp, Homo sapiens
gttaggacccgaaagatggtga

SEQ ID NO: 44594 - DNA, 24 bp, Homo sapiens
gttaggacccgaaagatggtgaac

SEQ ID NO: 44595 - DNA, 25 bp, Homo sapiens
gttaggacccgaaagatggtgaact

SEQ ID NO: 44596 - DNA, 28 bp, Homo sapiens
gttaggacccgaaagatggtgaactatg

SEQ ID NO: 44597 - DNA, 17 bp, Homo sapiens
ttaggacccgaaagatg

SEQ ID NO: 44598 - DNA, 18 bp, Homo sapiens
ttaggacccgaaagatgg

SEQ ID NO: 44599 - DNA, 19 bp, Homo sapiens
ttaggacccgaaagatggt

SEQ ID NO: 44600 - DNA, 20 bp, Homo sapiens
ttaggacccgaaagatggtg

SEQ ID NO: 44601 - DNA, 21 bp, Homo sapiens
ttaggacccgaaagatggtga

SEQ ID NO: 44602 - DNA, 24 bp, Homo sapiens
ttaggacccgaaagatggtgaact

SEQ ID NO: 44603 - DNA, 27 bp, Homo sapiens
ttaggacccgaaagatggtgaactatg

SEQ ID NO: 44604 - DNA, 16 bp, Homo sapiens
taggacccgaaagatg

SEQ ID NO: 44605 - DNA, 19 bp, Homo sapiens
taggacccgaaagatggtg

SEQ ID NO: 44606 - DNA, 20 bp, Homo sapiens
taggacccgaaagatggtga

SEQ ID NO: 44607 - DNA, 21 bp, Homo sapiens
taggacccgaaagatggtgaa

SEQ ID NO: 44608 - DNA, 22 bp, Homo sapiens
taggacccgaaagatggtgaac

SEQ ID NO: 44609 - DNA, 23 bp, Homo sapiens
taggacccgaaagatggtgaact

SEQ ID NO: 44610 - DNA, 26 bp, Homo sapiens
taggacccgaaagatggtgaactatg

SEQ ID NO: 44611 - DNA, 17 bp, Homo sapiens
aggacccgaaagatggt

SEQ ID NO: 44612 - DNA, 18 bp, Homo sapiens
aggacccgaaagatggtg

SEQ ID NO: 44613 - DNA, 20 bp, Homo sapiens
aggacccgaaagatggtgaa

SEQ ID NO: 44614 - DNA, 21 bp, Homo sapiens
aggacccgaaagatggtgaac

SEQ ID NO: 44615 - DNA, 22 bp, Homo sapiens
aggacccgaaagatggtgaact

SEQ ID NO: 44616 - DNA, 25 bp, Homo sapiens
aggacccgaaagatggtgaactatg

SEQ ID NO: 44617 - DNA, 19 bp, Homo sapiens
ggacccgaaagatggtgaa

SEQ ID NO: 44618 - DNA, 23 bp, Homo sapiens
gacccgaaagatggtgaactatg

SEQ ID NO: 44619 - DNA, 22 bp, Homo sapiens
acccgaaagatggtgaactatg

SEQ ID NO: 44620 - DNA, 21 bp, Homo sapiens
cccgaaagatggtgaactatg

SEQ ID NO: 44621 - DNA, 21 bp, Homo sapiens
gatggtgaactatgcctgggc

SEQ ID NO: 44622 - DNA, 23 bp, Homo sapiens
gatggtgaactatgcctgggcag

SEQ ID NO: 44623 - DNA, 28 bp, Homo sapiens
gatggtgaactatgcctgggcagggcga

SEQ ID NO: 44624 - DNA, 19 bp, Homo sapiens
atggtgaactatgcctggg

SEQ ID NO: 44625 - DNA, 22 bp, Homo sapiens
atggtgaactatgcctgggcag

SEQ ID NO: 44626 - DNA, 23 bp, Homo sapiens
atggtgaactatgcctgggcagg

SEQ ID NO: 44627 - DNA, 21 bp, Homo sapiens
tggtgaactatgcctgggcag

SEQ ID NO: 44628 - DNA, 20 bp, Homo sapiens
ggtgaactatgcctgggcag

SEQ ID NO: 44629 - DNA, 21 bp, Homo sapiens
ggtgaactatgcctgggcagg

SEQ ID NO: 44630 - DNA, 22 bp, Homo sapiens
ggtgaactatgcctgggcaggg

SEQ ID NO: 44631 - DNA, 17 bp, Homo sapiens
gtgaactatgcctgggc

SEQ ID NO: 44632 - DNA, 18 bp, Homo sapiens
gtgaactatgcctgggca

SEQ ID NO: 44633 - DNA, 19 bp, Homo sapiens
gtgaactatgcctgggcag

SEQ ID NO: 44634 - DNA, 20 bp, Homo sapiens
gtgaactatgcctgggcagg

SEQ ID NO: 44635 - DNA, 21 bp, Homo sapiens
gtgaactatgcctgggcaggg

SEQ ID NO: 44636 - DNA, 22 bp, Homo sapiens
gtgaactatgcctgggcagggc

SEQ ID NO: 44637 - DNA, 23 bp, Homo sapiens
gtgaactatgcctgggcagggcg

SEQ ID NO: 44638 - DNA, 19 bp, Homo sapiens
tgaactatgcctgggcagg

SEQ ID NO: 44639 - DNA, 22 bp, Homo sapiens
tgaactatgcctgggcagggcg

SEQ ID NO: 44640 - DNA, 17 bp, Homo sapiens
gaactatgcctgggcag

SEQ ID NO: 44641 - DNA, 18 bp, Homo sapiens
gaactatgcctgggcagg

SEQ ID NO: 44642 - DNA, 19 bp, Homo sapiens
gaactatgcctgggcaggg

SEQ ID NO: 44643 - DNA, 20 bp, Homo sapiens
gaactatgcctgggcagggc

SEQ ID NO: 44644 - DNA, 21 bp, Homo sapiens
gaactatgcctgggcagggcg

SEQ ID NO: 44645 - DNA, 22 bp, Homo sapiens
gaactatgcctgggcagggcga

SEQ ID NO: 44646 - DNA, 23 bp, Homo sapiens
gaactatgcctgggcagggcgaa

SEQ ID NO: 44647 - DNA, 24 bp, Homo sapiens
gaactatgcctgggcagggcgaag

SEQ ID NO: 44648 - DNA, 25 bp, Homo sapiens
gaactatgcctgggcagggcgaagc

SEQ ID NO: 44649 - DNA, 26 bp, Homo sapiens
gaactatgcctgggcagggcgaagcc

SEQ ID NO: 44650 - DNA, 28 bp, Homo sapiens
gaactatgcctgggcagggcgaagccag

SEQ ID NO: 44651 - DNA, 27 bp, Homo sapiens
aactatgcctgggcagggcgaagccag

SEQ ID NO: 44652 - DNA, 26 bp, Homo sapiens
actatgcctgggcagggcgaagccag

SEQ ID NO: 44653 - DNA, 24 bp, Homo sapiens
tatgcctgggcagggcgaagccag

SEQ ID NO: 44654 - DNA, 23 bp, Homo sapiens
atgcctgggcagggcgaagccag

SEQ ID NO: 44655 - DNA, 22 bp, Homo sapiens
tgcctgggcagggcgaagccag

SEQ ID NO: 44656 - DNA, 21 bp, Homo sapiens
gcctgggcagggcgaagccag

SEQ ID NO: 44657 - DNA, 22 bp, Homo sapiens
gcctgggcagggcgaagccaga

SEQ ID NO: 44658 - DNA, 24 bp, Homo sapiens
gcctgggcagggcgaagccagagg

SEQ ID NO: 44659 - DNA, 25 bp, Homo sapiens
gcctgggcagggcgaagccagagga

SEQ ID NO: 44660 - DNA, 20 bp, Homo sapiens
cctgggcagggcgaagccag

SEQ ID NO: 44661 - DNA, 21 bp, Homo sapiens
cctgggcagggcgaagccaga

SEQ ID NO: 44662 - DNA, 17 bp, Homo sapiens
cagggcgaagccagagg

SEQ ID NO: 44663 - DNA, 18 bp, Homo sapiens
cagggcgaagccagagga

SEQ ID NO: 44664 - DNA, 20 bp, Homo sapiens
cgaagccagaggaaactctg

SEQ ID NO: 44665 - DNA, 18 bp, Homo sapiens
aagccagaggaaactctg

SEQ ID NO: 44666 - DNA, 19 bp, Homo sapiens
aagccagaggaaactctgg

SEQ ID NO: 44667 - DNA, 18 bp, Homo sapiens
gccagaggaaactctggt

SEQ ID NO: 44668 - DNA, 19 bp, Homo sapiens
gccagaggaaactctggtg

SEQ ID NO: 44669 - DNA, 20 bp, Homo sapiens
gccagaggaaactctggtgg

SEQ ID NO: 44670 - DNA, 21 bp, Homo sapiens
gccagaggaaactctggtgga

SEQ ID NO: 44671 - DNA, 23 bp, Homo sapiens
gccagaggaaactctggtggagg

SEQ ID NO: 44672 - DNA, 20 bp, Homo sapiens
ccagaggaaactctggtgga

SEQ ID NO: 44673 - DNA, 22 bp, Homo sapiens
ccagaggaaactctggtggagg

SEQ ID NO: 44674 - DNA, 29 bp, Homo sapiens
ccagaggaaactctggtggaggtccgtag

SEQ ID NO: 44675 - DNA, 17 bp, Homo sapiens
cagaggaaactctggtg

SEQ ID NO: 44676 - DNA, 20 bp, Homo sapiens
cagaggaaactctggtggag

SEQ ID NO: 44677 - DNA, 21 bp, Homo sapiens
cagaggaaactctggtggagg

SEQ ID NO: 44678 - DNA, 28 bp, Homo sapiens
cagaggaaactctggtggaggtccgtag

SEQ ID NO: 44679 - DNA, 17 bp, Homo sapiens
agaggaaactctggtgg

SEQ ID NO: 44680 - DNA, 18 bp, Homo sapiens
agaggaaactctggtgga

SEQ ID NO: 44681 - DNA, 19 bp, Homo sapiens
agaggaaactctggtggag

SEQ ID NO: 44682 - DNA, 20 bp, Homo sapiens
agaggaaactctggtggagg

SEQ ID NO: 44683 - DNA, 21 bp, Homo sapiens
agaggaaactctggtggaggt

SEQ ID NO: 44684 - DNA, 22 bp, Homo sapiens
agaggaaactctggtggaggtc

SEQ ID NO: 44685 - DNA, 27 bp, Homo sapiens
agaggaaactctggtggaggtccgtag

SEQ ID NO: 44686 - DNA, 17 bp, Homo sapiens
gaggaaactctggtgga

SEQ ID NO: 44687 - DNA, 18 bp, Homo sapiens
gaggaaactctggtggag

SEQ ID NO: 44688 - DNA, 19 bp, Homo sapiens
gaggaaactctggtggagg

SEQ ID NO: 44689 - DNA, 20 bp, Homo sapiens
gaggaaactctggtggaggt

SEQ ID NO: 44690 - DNA, 21 bp, Homo sapiens
gaggaaactctggtggaggtc

SEQ ID NO: 44691 - DNA, 22 bp, Homo sapiens
gaggaaactctggtggaggtcc

SEQ ID NO: 44692 - DNA, 26 bp, Homo sapiens
gaggaaactctggtggaggtccgtag

SEQ ID NO: 44693 - DNA, 16 bp, Homo sapiens
aggaaactctggtgga

SEQ ID NO: 44694 - DNA, 17 bp, Homo sapiens
aggaaactctggtggag

SEQ ID NO: 44695 - DNA, 18 bp, Homo sapiens
aggaaactctggtggagg

SEQ ID NO: 44696 - DNA, 19 bp, Homo sapiens
aggaaactctggtggaggt

SEQ ID NO: 44697 - DNA, 20 bp, Homo sapiens
aggaaactctggtggaggtc

SEQ ID NO: 44698 - DNA, 21 bp, Homo sapiens
aggaaactctggtggaggtcc

SEQ ID NO: 44699 - DNA, 27 bp, Homo sapiens
aggaaactctggtggaggtccgtagcg

SEQ ID NO: 44700 - DNA, 16 bp, Homo sapiens
ggaaactctggtggag

SEQ ID NO: 44701 - DNA, 17 bp, Homo sapiens
ggaaactctggtggagg

SEQ ID NO: 44702 - DNA, 18 bp, Homo sapiens
ggaaactctggtggaggt

SEQ ID NO: 44703 - DNA, 19 bp, Homo sapiens
ggaaactctggtggaggtc

SEQ ID NO: 44704 - DNA, 20 bp, Homo sapiens
ggaaactctggtggaggtcc

SEQ ID NO: 44705 - DNA, 16 bp, Homo sapiens
gaaactctggtggagg

SEQ ID NO: 44706 - DNA, 17 bp, Homo sapiens
gaaactctggtggaggt

SEQ ID NO: 44707 - DNA, 18 bp, Homo sapiens
gaaactctggtggaggtc

SEQ ID NO: 44708 - DNA, 19 bp, Homo sapiens
gaaactctggtggaggtcc

SEQ ID NO: 44709 - DNA, 20 bp, Homo sapiens
gaaactctggtggaggtccg

SEQ ID NO: 44710 - DNA, 21 bp, Homo sapiens
gaaactctggtggaggtccgt

SEQ ID NO: 44711 - DNA, 22 bp, Homo sapiens
gaaactctggtggaggtccgta

SEQ ID NO: 44712 - DNA, 23 bp, Homo sapiens
gaaactctggtggaggtccgtag

SEQ ID NO: 44713 - DNA, 24 bp, Homo sapiens
gaaactctggtggaggtccgtagc

SEQ ID NO: 44714 - DNA, 25 bp, Homo sapiens
gaaactctggtggaggtccgtagcg

SEQ ID NO: 44715 - DNA, 26 bp, Homo sapiens
gaaactctggtggaggtccgtagcgg

SEQ ID NO: 44716 - DNA, 22 bp, Homo sapiens
aaactctggtggaggtccgtag

SEQ ID NO: 44717 - DNA, 18 bp, Homo sapiens
aactctggtggaggtccg

SEQ ID NO: 44718 - DNA, 20 bp, Homo sapiens
aactctggtggaggtccgta

SEQ ID NO: 44719 - DNA, 21 bp, Homo sapiens
aactctggtggaggtccgtag

SEQ ID NO: 44720 - DNA, 22 bp, Homo sapiens
aactctggtggaggtccgtagc

SEQ ID NO: 44721 - DNA, 23 bp, Homo sapiens
aactctggtggaggtccgtagcg

SEQ ID NO: 44722 - DNA, 17 bp, Homo sapiens
actctggtggaggtccg

SEQ ID NO: 44723 - DNA, 18 bp, Homo sapiens
actctggtggaggtccgt

SEQ ID NO: 44724 - DNA, 19 bp, Homo sapiens
actctggtggaggtccgta

SEQ ID NO: 44725 - DNA, 20 bp, Homo sapiens
actctggtggaggtccgtag

SEQ ID NO: 44726 - DNA, 21 bp, Homo sapiens
actctggtggaggtccgtagc

SEQ ID NO: 44727 - DNA, 22 bp, Homo sapiens
actctggtggaggtccgtagcg

SEQ ID NO: 44728 - DNA, 23 bp, Homo sapiens
actctggtggaggtccgtagcgg

SEQ ID NO: 44729 - DNA, 24 bp, Homo sapiens
actctggtggaggtccgtagcggt

SEQ ID NO: 44730 - DNA, 16 bp, Homo sapiens
ctctggtggaggtccg

SEQ ID NO: 44731 - DNA, 18 bp, Homo sapiens
ctctggtggaggtccgta

SEQ ID NO: 44732 - DNA, 19 bp, Homo sapiens
ctctggtggaggtccgtag

SEQ ID NO: 44733 - DNA, 20 bp, Homo sapiens
ctctggtggaggtccgtagc

SEQ ID NO: 44734 - DNA, 21 bp, Homo sapiens
ctctggtggaggtccgtagcg

SEQ ID NO: 44735 - DNA, 22 bp, Homo sapiens
ctctggtggaggtccgtagcgg

SEQ ID NO: 44736 - DNA, 23 bp, Homo sapiens
ctctggtggaggtccgtagcggt

SEQ ID NO: 44737 - DNA, 28 bp, Homo sapiens
ctctggtggaggtccgtagcggtcctga

SEQ ID NO: 44738 - DNA, 30 bp, Homo sapiens
ctctggtggaggtccgtagcggtcctgacg

SEQ ID NO: 44739 - DNA, 18 bp, Homo sapiens
tctggtggaggtccgtag

SEQ ID NO: 44740 - DNA, 17 bp, Homo sapiens
ctggtggaggtccgtag

SEQ ID NO: 44741 - DNA, 18 bp, Homo sapiens
ctggtggaggtccgtagc

SEQ ID NO: 44742 - DNA, 19 bp, Homo sapiens
ctggtggaggtccgtagcg

SEQ ID NO: 44743 - DNA, 21 bp, Homo sapiens
ctggtggaggtccgtagcggt

SEQ ID NO: 44744 - DNA, 22 bp, Homo sapiens
ctggtggaggtccgtagcggtc

SEQ ID NO: 44745 - DNA, 16 bp, Homo sapiens
tggtggaggtccgtag

SEQ ID NO: 44746 - DNA, 20 bp, Homo sapiens
tggtggaggtccgtagcggt

SEQ ID NO: 44747 - DNA, 21 bp, Homo sapiens
tggtggaggtccgtagcggtc

SEQ ID NO: 44748 - DNA, 17 bp, Homo sapiens
ggtggaggtccgtagcg

SEQ ID NO: 44749 - DNA, 18 bp, Homo sapiens
ggtggaggtccgtagcgg

SEQ ID NO: 44750 - DNA, 19 bp, Homo sapiens
ggtggaggtccgtagcggt

SEQ ID NO: 44751 - DNA, 20 bp, Homo sapiens
ggtggaggtccgtagcggtc

SEQ ID NO: 44752 - DNA, 21 bp, Homo sapiens
ggtggaggtccgtagcggtcc

SEQ ID NO: 44753 - DNA, 24 bp, Homo sapiens
ggtggaggtccgtagcggtcctga

SEQ ID NO: 44754 - DNA, 26 bp, Homo sapiens
ggtggaggtccgtagcggtcctgacg

SEQ ID NO: 44755 - DNA, 18 bp, Homo sapiens
gtggaggtccgtagcggt

SEQ ID NO: 44756 - DNA, 19 bp, Homo sapiens
gtggaggtccgtagcggtc

SEQ ID NO: 44757 - DNA, 20 bp, Homo sapiens
gtggaggtccgtagcggtcc

SEQ ID NO: 44758 - DNA, 17 bp, Homo sapiens
tggaggtccgtagcggt

SEQ ID NO: 44759 - DNA, 18 bp, Homo sapiens
tggaggtccgtagcggtc

SEQ ID NO: 44760 - DNA, 19 bp, Homo sapiens
tggaggtccgtagcggtcc

SEQ ID NO: 44761 - DNA, 24 bp, Homo sapiens
tggaggtccgtagcggtcctgacg

SEQ ID NO: 44762 - DNA, 16 bp, Homo sapiens
gaggtccgtagcggtc

SEQ ID NO: 44763 - DNA, 20 bp, Homo sapiens
ggtccgtagcggtcctgacg

SEQ ID NO: 44764 - DNA, 21 bp, Homo sapiens
ggtccgtagcggtcctgacgt

SEQ ID NO: 44765 - DNA, 22 bp, Homo sapiens
ggtccgtagcggtcctgacgtg

SEQ ID NO: 44766 - DNA, 23 bp, Homo sapiens
ggtccgtagcggtcctgacgtgc

SEQ ID NO: 44767 - DNA, 24 bp, Homo sapiens
ggtccgtagcggtcctgacgtgca

SEQ ID NO: 44768 - DNA, 25 bp, Homo sapiens
ggtccgtagcggtcctgacgtgcaa

SEQ ID NO: 44769 - DNA, 26 bp, Homo sapiens
ggtccgtagcggtcctgacgtgcaaa

SEQ ID NO: 44770 - DNA, 17 bp, Homo sapiens
gtccgtagcggtcctga

SEQ ID NO: 44771 - DNA, 18 bp, Homo sapiens
gtccgtagcggtcctgac

SEQ ID NO: 44772 - DNA, 19 bp, Homo sapiens
gtccgtagcggtcctgacg

SEQ ID NO: 44773 - DNA, 20 bp, Homo sapiens
gtccgtagcggtcctgacgt

SEQ ID NO: 44774 - DNA, 21 bp, Homo sapiens
gtccgtagcggtcctgacgtg

SEQ ID NO: 44775 - DNA, 22 bp, Homo sapiens
gtccgtagcggtcctgacgtgc

SEQ ID NO: 44776 - DNA, 23 bp, Homo sapiens
gtccgtagcggtcctgacgtgca

SEQ ID NO: 44777 - DNA, 21 bp, Homo sapiens
tccgtagcggtcctgacgtgc

SEQ ID NO: 44778 - DNA, 16 bp, Homo sapiens
ccgtagcggtcctgac

SEQ ID NO: 44779 - DNA, 17 bp, Homo sapiens
ccgtagcggtcctgacg

SEQ ID NO: 44780 - DNA, 18 bp, Homo sapiens
ccgtagcggtcctgacgt

SEQ ID NO: 44781 - DNA, 19 bp, Homo sapiens
ccgtagcggtcctgacgtg

SEQ ID NO: 44782 - DNA, 20 bp, Homo sapiens
ccgtagcggtcctgacgtgc

SEQ ID NO: 44783 - DNA, 21 bp, Homo sapiens
ccgtagcggtcctgacgtgca

SEQ ID NO: 44784 - DNA, 22 bp, Homo sapiens
ccgtagcggtcctgacgtgcaa

SEQ ID NO: 44785 - DNA, 24 bp, Homo sapiens
ccgtagcggtcctgacgtgcaaat

SEQ ID NO: 44786 - DNA, 28 bp, Homo sapiens
ccgtagcggtcctgacgtgcaaatcggt

SEQ ID NO: 44787 - DNA, 16 bp, Homo sapiens
cgtagcggtcctgacg

SEQ ID NO: 44788 - DNA, 17 bp, Homo sapiens
cgtagcggtcctgacgt

SEQ ID NO: 44789 - DNA, 18 bp, Homo sapiens
cgtagcggtcctgacgtg

SEQ ID NO: 44790 - DNA, 19 bp, Homo sapiens
cgtagcggtcctgacgtgc

SEQ ID NO: 44791 - DNA, 20 bp, Homo sapiens
cgtagcggtcctgacgtgca

SEQ ID NO: 44792 - DNA, 27 bp, Homo sapiens
cgtagcggtcctgacgtgcaaatcggt

SEQ ID NO: 44793 - DNA, 28 bp, Homo sapiens
cgtagcggtcctgacgtgcaaatcggtc

SEQ ID NO: 44794 - DNA, 17 bp, Homo sapiens
gtagcggtcctgacgtg

SEQ ID NO: 44795 - DNA, 18 bp, Homo sapiens
gtagcggtcctgacgtgc

SEQ ID NO: 44796 - DNA, 19 bp, Homo sapiens
gtagcggtcctgacgtgca

SEQ ID NO: 44797 - DNA, 16 bp, Homo sapiens
agcggtcctgacgtgc

SEQ ID NO: 44798 - DNA, 18 bp, Homo sapiens
cggtcctgacgtgcaaat

SEQ ID NO: 44799 - DNA, 20 bp, Homo sapiens
cggtcctgacgtgcaaatcg

SEQ ID NO: 44800 - DNA, 21 bp, Homo sapiens
cggtcctgacgtgcaaatcgg

SEQ ID NO: 44801 - DNA, 22 bp, Homo sapiens
cggtcctgacgtgcaaatcggt

SEQ ID NO: 44802 - DNA, 18 bp, Homo sapiens
ggtcctgacgtgcaaatc

SEQ ID NO: 44803 - DNA, 19 bp, Homo sapiens
ggtcctgacgtgcaaatcg

SEQ ID NO: 44804 - DNA, 21 bp, Homo sapiens
ggtcctgacgtgcaaatcggt

SEQ ID NO: 44805 - DNA, 22 bp, Homo sapiens
ggtcctgacgtgcaaatcggtc

SEQ ID NO: 44806 - DNA, 19 bp, Homo sapiens
gtcctgacgtgcaaatcgg

SEQ ID NO: 44807 - DNA, 20 bp, Homo sapiens
gtcctgacgtgcaaatcggt

SEQ ID NO: 44808 - DNA, 21 bp, Homo sapiens
gtcctgacgtgcaaatcggtc

SEQ ID NO: 44809 - DNA, 30 bp, Homo sapiens
gtcctgacgtgcaaatcggtcgtccgacct

SEQ ID NO: 44810 - DNA, 18 bp, Homo sapiens
tcctgacgtgcaaatcgg

SEQ ID NO: 44811 - DNA, 19 bp, Homo sapiens
tcctgacgtgcaaatcggt

SEQ ID NO: 44812 - DNA, 30 bp, Homo sapiens
tcctgacgtgcaaatcggtcgtccgacctg

SEQ ID NO: 44813 - DNA, 17 bp, Homo sapiens
cctgacgtgcaaatcgg

SEQ ID NO: 44814 - DNA, 18 bp, Homo sapiens
cctgacgtgcaaatcggt

SEQ ID NO: 44815 - DNA, 30 bp, Homo sapiens
cctgacgtgcaaatcggtcgtccgacctgg

SEQ ID NO: 44816 - DNA, 20 bp, Homo sapiens
acgtgcaaatcggtcgtccg

SEQ ID NO: 44817 - DNA, 26 bp, Homo sapiens
acgtgcaaatcggtcgtccgacctgg

SEQ ID NO: 44818 - DNA, 27 bp, Homo sapiens
acgtgcaaatcggtcgtccgacctggg

SEQ ID NO: 44819 - DNA, 28 bp, Homo sapiens
acgtgcaaatcggtcgtccgacctgggt

SEQ ID NO: 44820 - DNA, 19 bp, Homo sapiens
cgtgcaaatcggtcgtccg

SEQ ID NO: 44821 - DNA, 20 bp, Homo sapiens
cgtgcaaatcggtcgtccga

SEQ ID NO: 44822 - DNA, 23 bp, Homo sapiens
cgtgcaaatcggtcgtccgacct

SEQ ID NO: 44823 - DNA, 24 bp, Homo sapiens
cgtgcaaatcggtcgtccgacctg

SEQ ID NO: 44824 - DNA, 25 bp, Homo sapiens
cgtgcaaatcggtcgtccgacctgg

SEQ ID NO: 44825 - DNA, 26 bp, Homo sapiens
cgtgcaaatcggtcgtccgacctggg

SEQ ID NO: 44826 - DNA, 27 bp, Homo sapiens
cgtgcaaatcggtcgtccgacctgggt

SEQ ID NO: 44827 - DNA, 28 bp, Homo sapiens
cgtgcaaatcggtcgtccgacctgggta

SEQ ID NO: 44828 - DNA, 29 bp, Homo sapiens
cgtgcaaatcggtcgtccgacctgggtat

SEQ ID NO: 44829 - DNA, 20 bp, Homo sapiens
gtgcaaatcggtcgtccgac

SEQ ID NO: 44830 - DNA, 22 bp, Homo sapiens
gtgcaaatcggtcgtccgacct

SEQ ID NO: 44831 - DNA, 24 bp, Homo sapiens
gtgcaaatcggtcgtccgacctgg

SEQ ID NO: 44832 - DNA, 25 bp, Homo sapiens
gtgcaaatcggtcgtccgacctggg

SEQ ID NO: 44833 - DNA, 26 bp, Homo sapiens
gtgcaaatcggtcgtccgacctgggt

SEQ ID NO: 44834 - DNA, 27 bp, Homo sapiens
gtgcaaatcggtcgtccgacctgggta

SEQ ID NO: 44835 - DNA, 16 bp, Homo sapiens
tgcaaatcggtcgtcc

SEQ ID NO: 44836 - DNA, 17 bp, Homo sapiens
tgcaaatcggtcgtccg

SEQ ID NO: 44837 - DNA, 19 bp, Homo sapiens
tgcaaatcggtcgtccgac

SEQ ID NO: 44838 - DNA, 20 bp, Homo sapiens
tgcaaatcggtcgtccgacc

SEQ ID NO: 44839 - DNA, 21 bp, Homo sapiens
tgcaaatcggtcgtccgacct

SEQ ID NO: 44840 - DNA, 22 bp, Homo sapiens
tgcaaatcggtcgtccgacctg

SEQ ID NO: 44841 - DNA, 23 bp, Homo sapiens
tgcaaatcggtcgtccgacctgg

SEQ ID NO: 44842 - DNA, 24 bp, Homo sapiens
tgcaaatcggtcgtccgacctggg

SEQ ID NO: 44843 - DNA, 25 bp, Homo sapiens
tgcaaatcggtcgtccgacctgggt

SEQ ID NO: 44844 - DNA, 26 bp, Homo sapiens
tgcaaatcggtcgtccgacctgggta

SEQ ID NO: 44845 - DNA, 28 bp, Homo sapiens
tgcaaatcggtcgtccgacctgggtata

SEQ ID NO: 44846 - DNA, 29 bp, Homo sapiens
tgcaaatcggtcgtccgacctgggtatag

SEQ ID NO: 44847 - DNA, 30 bp, Homo sapiens
tgcaaatcggtcgtccgacctgggtatagg

SEQ ID NO: 44848 - DNA, 20 bp, Homo sapiens
gcaaatcggtcgtccgacct

SEQ ID NO: 44849 - DNA, 21 bp, Homo sapiens
gcaaatcggtcgtccgacctg

SEQ ID NO: 44850 - DNA, 22 bp, Homo sapiens
gcaaatcggtcgtccgacctgg

SEQ ID NO: 44851 - DNA, 23 bp, Homo sapiens
gcaaatcggtcgtccgacctggg

SEQ ID NO: 44852 - DNA, 24 bp, Homo sapiens
gcaaatcggtcgtccgacctgggt

SEQ ID NO: 44853 - DNA, 25 bp, Homo sapiens
gcaaatcggtcgtccgacctgggta

SEQ ID NO: 44854 - DNA, 27 bp, Homo sapiens
gcaaatcggtcgtccgacctgggtata

SEQ ID NO: 44855 - DNA, 28 bp, Homo sapiens
gcaaatcggtcgtccgacctgggtatag

SEQ ID NO: 44856 - DNA, 19 bp, Homo sapiens
caaatcggtcgtccgacct

SEQ ID NO: 44857 - DNA, 20 bp, Homo sapiens
caaatcggtcgtccgacctg

SEQ ID NO: 44858 - DNA, 21 bp, Homo sapiens
caaatcggtcgtccgacctgg

SEQ ID NO: 44859 - DNA, 22 bp, Homo sapiens
caaatcggtcgtccgacctggg

SEQ ID NO: 44860 - DNA, 23 bp, Homo sapiens
caaatcggtcgtccgacctgggt

SEQ ID NO: 44861 - DNA, 24 bp, Homo sapiens
caaatcggtcgtccgacctgggta

SEQ ID NO: 44862 - DNA, 25 bp, Homo sapiens
caaatcggtcgtccgacctgggtat

SEQ ID NO: 44863 - DNA, 26 bp, Homo sapiens
caaatcggtcgtccgacctgggtata

SEQ ID NO: 44864 - DNA, 27 bp, Homo sapiens
caaatcggtcgtccgacctgggtatag

SEQ ID NO: 44865 - DNA, 29 bp, Homo sapiens
caaatcggtcgtccgacctgggtataggg

SEQ ID NO: 44866 - DNA, 30 bp, Homo sapiens; identical to SEQ ID NO: 20831

SEQ ID NO: 44867 - DNA, 16 bp, Homo sapiens
aaatcggtcgtccgac

SEQ ID NO: 44868 - DNA, 17 bp, Homo sapiens
aaatcggtcgtccgacc

SEQ ID NO: 44869 - DNA, 18 bp, Homo sapiens
aaatcggtcgtccgacct

SEQ ID NO: 44870 - DNA, 19 bp, Homo sapiens
aaatcggtcgtccgacctg

SEQ ID NO: 44871 - DNA, 20 bp, Homo sapiens
aaatcggtcgtccgacctgg

SEQ ID NO: 44872 - DNA, 21 bp, Homo sapiens
aaatcggtcgtccgacctggg

SEQ ID NO: 44873 - DNA, 22 bp, Homo sapiens
aaatcggtcgtccgacctgggt

SEQ ID NO: 44874 - DNA, 23 bp, Homo sapiens
aaatcggtcgtccgacctgggta

SEQ ID NO: 44875 - DNA, 24 bp, Homo sapiens
aaatcggtcgtccgacctgggtat

SEQ ID NO: 44876 - DNA, 25 bp, Homo sapiens
aaatcggtcgtccgacctgggtata

SEQ ID NO: 44877 - DNA, 26 bp, Homo sapiens
aaatcggtcgtccgacctgggtatag

SEQ ID NO: 44878 - DNA, 28 bp, Homo sapiens
aaatcggtcgtccgacctgggtataggg

SEQ ID NO: 44879 - DNA, 29 bp, Homo sapiens
aaatcggtcgtccgacctgggtatagggg

SEQ ID NO: 44880 - DNA, 30 bp, Homo sapiens; identical to SEQ ID NO: 4436

SEQ ID NO: 44881 - DNA, 16 bp, Homo sapiens
aatcggtcgtccgacc

SEQ ID NO: 44882 - DNA, 17 bp, Homo sapiens
aatcggtcgtccgacct

SEQ ID NO: 44883 - DNA, 18 bp, Homo sapiens
aatcggtcgtccgacctg

SEQ ID NO: 44884 - DNA, 19 bp, Homo sapiens
aatcggtcgtccgacctgg

SEQ ID NO: 44885 - DNA, 20 bp, Homo sapiens
aatcggtcgtccgacctggg

SEQ ID NO: 44886 - DNA, 21 bp, Homo sapiens
aatcggtcgtccgacctgggt

SEQ ID NO: 44887 - DNA, 22 bp, Homo sapiens
aatcggtcgtccgacctgggta

SEQ ID NO: 44888 - DNA, 23 bp, Homo sapiens
aatcggtcgtccgacctgggtat

SEQ ID NO: 44889 - DNA, 24 bp, Homo sapiens
aatcggtcgtccgacctgggtata

SEQ ID NO: 44890 - DNA, 25 bp, Homo sapiens
aatcggtcgtccgacctgggtatag

SEQ ID NO: 44891 - DNA, 26 bp, Homo sapiens
aatcggtcgtccgacctgggtatagg

SEQ ID NO: 44892 - DNA, 27 bp, Homo sapiens
aatcggtcgtccgacctgggtataggg

SEQ ID NO: 44893 - DNA, 28 bp, Homo sapiens
aatcggtcgtccgacctgggtatagggg

SEQ ID NO: 44894 - DNA, 29 bp, Homo sapiens
aatcggtcgtccgacctgggtataggggc

SEQ ID NO: 44895 - DNA, 30 bp, Homo sapiens; identical to SEQ ID NO: 4444

SEQ ID NO: 44896 - DNA, 16 bp, Homo sapiens
atcggtcgtccgacct

SEQ ID NO: 44897 - DNA, 17 bp, Homo sapiens
atcggtcgtccgacctg

SEQ ID NO: 44898 - DNA, 18 bp, Homo sapiens
atcggtcgtccgacctgg

SEQ ID NO: 44899 - DNA, 19 bp, Homo sapiens
atcggtcgtccgacctggg

SEQ ID NO: 44900 - DNA, 20 bp, Homo sapiens
atcggtcgtccgacctgggt

SEQ ID NO: 44901 - DNA, 21 bp, Homo sapiens
atcggtcgtccgacctgggta

SEQ ID NO: 44902 - DNA, 22 bp, Homo sapiens
atcggtcgtccgacctgggtat

SEQ ID NO: 44903 - DNA, 23 bp, Homo sapiens
atcggtcgtccgacctgggtata

SEQ ID NO: 44904 - DNA, 24 bp, Homo sapiens
atcggtcgtccgacctgggtatag

SEQ ID NO: 44905 - DNA, 26 bp, Homo sapiens
atcggtcgtccgacctgggtataggg

SEQ ID NO: 44906 - DNA, 27 bp, Homo sapiens
atcggtcgtccgacctgggtatagggg

SEQ ID NO: 44907 - DNA, 28 bp, Homo sapiens
atcggtcgtccgacctgggtataggggc

SEQ ID NO: 44908 - DNA, 29 bp, Homo sapiens
atcggtcgtccgacctgggtataggggcg

SEQ ID NO: 44909 - DNA, 17 bp, Homo sapiens
tcggtcgtccgacctgg

SEQ ID NO: 44910 - DNA, 18 bp, Homo sapiens
tcggtcgtccgacctggg

SEQ ID NO: 44911 - DNA, 19 bp, Homo sapiens
tcggtcgtccgacctgggt

SEQ ID NO: 44912 - DNA, 20 bp, Homo sapiens
tcggtcgtccgacctgggta

SEQ ID NO: 44913 - DNA, 21 bp, Homo sapiens
tcggtcgtccgacctgggtat

SEQ ID NO: 44914 - DNA, 22 bp, Homo sapiens
tcggtcgtccgacctgggtata

SEQ ID NO: 44915 - DNA, 23 bp, Homo sapiens
tcggtcgtccgacctgggtatag

SEQ ID NO: 44916 - DNA, 27 bp, Homo sapiens
tcggtcgtccgacctgggtataggggc

SEQ ID NO: 44917 - DNA, 28 bp, Homo sapiens
tcggtcgtccgacctgggtataggggcg

SEQ ID NO: 44918 - DNA, 29 bp, Homo sapiens
tcggtcgtccgacctgggtataggggcga

SEQ ID NO: 44919 - DNA, 16 bp, Homo sapiens
cggtcgtccgacctgg

SEQ ID NO: 44920 - DNA, 17 bp, Homo sapiens
cggtcgtccgacctggg

SEQ ID NO: 44921 - DNA, 18 bp, Homo sapiens
cggtcgtccgacctgggt

SEQ ID NO: 44922 - DNA, 19 bp, Homo sapiens
cggtcgtccgacctgggta

SEQ ID NO: 44923 - DNA, 20 bp, Homo sapiens
cggtcgtccgacctgggtat

SEQ ID NO: 44924 - DNA, 21 bp, Homo sapiens
cggtcgtccgacctgggtata

SEQ ID NO: 44925 - DNA, 22 bp, Homo sapiens
cggtcgtccgacctgggtatag

SEQ ID NO: 44926 - DNA, 23 bp, Homo sapiens
cggtcgtccgacctgggtatagg

SEQ ID NO: 44927 - DNA, 24 bp, Homo sapiens
cggtcgtccgacctgggtataggg

SEQ ID NO: 44928 - DNA, 25 bp, Homo sapiens
cggtcgtccgacctgggtatagggg

SEQ ID NO: 44929 - DNA, 26 bp, Homo sapiens
cggtcgtccgacctgggtataggggc

SEQ ID NO: 44930 - DNA, 27 bp, Homo sapiens
cggtcgtccgacctgggtataggggcg

SEQ ID NO: 44931 - DNA, 28 bp, Homo sapiens
cggtcgtccgacctgggtataggggcga

SEQ ID NO: 44932 - DNA, 29 bp, Homo sapiens
cggtcgtccgacctgggtataggggcgaa

SEQ ID NO: 44933 - DNA, 16 bp, Homo sapiens
ggtcgtccgacctggg

SEQ ID NO: 44934 - DNA, 17 bp, Homo sapiens
ggtcgtccgacctgggt

SEQ ID NO: 44935 - DNA, 22 bp, Homo sapiens
ggtcgtccgacctgggtatagg

SEQ ID NO: 44936 - DNA, 23 bp, Homo sapiens
ggtcgtccgacctgggtataggg

SEQ ID NO: 44937 - DNA, 24 bp, Homo sapiens
ggtcgtccgacctgggtatagggg

SEQ ID NO: 44938 - DNA, 25 bp, Homo sapiens
ggtcgtccgacctgggtataggggc

SEQ ID NO: 44939 - DNA, 26 bp, Homo sapiens
ggtcgtccgacctgggtataggggcg

SEQ ID NO: 44940 - DNA, 30 bp, Homo sapiens
ggtcgtccgacctgggtataggggcgaaag

SEQ ID NO: 44941 - DNA, 16 bp, Homo sapiens
gtcgtccgacctgggt

SEQ ID NO: 44942 - DNA, 17 bp, Homo sapiens
gtcgtccgacctgggta

SEQ ID NO: 44943 - DNA, 18 bp, Homo sapiens
gtcgtccgacctgggtat

SEQ ID NO: 44944 - DNA, 19 bp, Homo sapiens
gtcgtccgacctgggtata

SEQ ID NO: 44945 - DNA, 22 bp, Homo sapiens
gtcgtccgacctgggtataggg

SEQ ID NO: 44946 - DNA, 23 bp, Homo sapiens
gtcgtccgacctgggtatagggg

SEQ ID NO: 44947 - DNA, 24 bp, Homo sapiens
gtcgtccgacctgggtataggggc

SEQ ID NO: 44948 - DNA, 25 bp, Homo sapiens
gtcgtccgacctgggtataggggcg

SEQ ID NO: 44949 - DNA, 29 bp, Homo sapiens
gtcgtccgacctgggtataggggcgaaag

SEQ ID NO: 44950 - DNA, 16 bp, Homo sapiens
tcgtccgacctgggta

SEQ ID NO: 44951 - DNA, 18 bp, Homo sapiens
tcgtccgacctgggtata

SEQ ID NO: 44952 - DNA, 19 bp, Homo sapiens
tcgtccgacctgggtatag

SEQ ID NO: 44953 - DNA, 21 bp, Homo sapiens
tcgtccgacctgggtataggg

SEQ ID NO: 44954 - DNA, 22 bp, Homo sapiens
tcgtccgacctgggtatagggg

SEQ ID NO: 44955 - DNA, 23 bp, Homo sapiens
tcgtccgacctgggtataggggc

SEQ ID NO: 44956 - DNA, 24 bp, Homo sapiens
tcgtccgacctgggtataggggcg

SEQ ID NO: 44957 - DNA, 27 bp, Homo sapiens
tcgtccgacctgggtataggggcgaaa

SEQ ID NO: 44958 - DNA, 18 bp, Homo sapiens
cgtccgacctgggtatag

SEQ ID NO: 44959 - DNA, 19 bp, Homo sapiens
cgtccgacctgggtatagg

SEQ ID NO: 44960 - DNA, 20 bp, Homo sapiens
cgtccgacctgggtataggg

SEQ ID NO: 44961 - DNA, 21 bp, Homo sapiens
cgtccgacctgggtatagggg

SEQ ID NO: 44962 - DNA, 22 bp, Homo sapiens
cgtccgacctgggtataggggc

SEQ ID NO: 44963 - DNA, 23 bp, Homo sapiens
cgtccgacctgggtataggggcg

SEQ ID NO: 44964 - DNA, 27 bp, Homo sapiens
cgtccgacctgggtataggggcgaaag

SEQ ID NO: 44965 - DNA, 28 bp, Homo sapiens
cgtccgacctgggtataggggcgaaaga

SEQ ID NO: 44966 - DNA, 30 bp, Homo sapiens
cgtccgacctgggtataggggcgaaagact

SEQ ID NO: 44967 - DNA, 19 bp, Homo sapiens
gtccgacctgggtataggg

SEQ ID NO: 44968 - DNA, 20 bp, Homo sapiens
gtccgacctgggtatagggg

SEQ ID NO: 44969 - DNA, 21 bp, Homo sapiens
gtccgacctgggtataggggc

SEQ ID NO: 44970 - DNA, 22 bp, Homo sapiens
gtccgacctgggtataggggcg

SEQ ID NO: 44971 - DNA, 18 bp, Homo sapiens
gacctgggtataggggcg

SEQ ID NO: 44972 - DNA, 22 bp, Homo sapiens
acctgggtataggggcgaaaga

SEQ ID NO: 44973 - DNA, 20 bp, Homo sapiens
ctgggtataggggcgaaaga

SEQ ID NO: 44974 - DNA, 22 bp, Homo sapiens
ctgggtataggggcgaaagact

SEQ ID NO: 44975 - DNA, 19 bp, Homo sapiens
tgggtataggggcgaaaga

SEQ ID NO: 44976 - DNA, 20 bp, Homo sapiens
tgggtataggggcgaaagac

SEQ ID NO: 44977 - DNA, 21 bp, Homo sapiens
tgggtataggggcgaaagact

SEQ ID NO: 44978 - DNA, 20 bp, Homo sapiens
gggtataggggcgaaagact

SEQ ID NO: 44979 - DNA, 19 bp, Homo sapiens
ggtataggggcgaaagact

SEQ ID NO: 44980 - DNA, 27 bp, Homo sapiens
gtataggggcgaaagactaatcgaacc

SEQ ID NO: 44981 - DNA, 26 bp, Homo sapiens
tataggggcgaaagactaatcgaacc

SEQ ID NO: 44982 - DNA, 25 bp, Homo sapiens
ataggggcgaaagactaatcgaacc

SEQ ID NO: 44983 - DNA, 24 bp, Homo sapiens
taggggcgaaagactaatcgaacc

SEQ ID NO: 44984 - DNA, 23 bp, Homo sapiens
aggggcgaaagactaatcgaacc

SEQ ID NO: 44985 - DNA, 22 bp, Homo sapiens
ggggcgaaagactaatcgaacc

SEQ ID NO: 44986 - DNA, 21 bp, Homo sapiens
gggcgaaagactaatcgaacc

SEQ ID NO: 44987 - DNA, 22 bp, Homo sapiens
gggcgaaagactaatcgaacca

SEQ ID NO: 44988 - DNA, 23 bp, Homo sapiens
gggcgaaagactaatcgaaccat

SEQ ID NO: 44989 - DNA, 20 bp, Homo sapiens
ggcgaaagactaatcgaacc

SEQ ID NO: 44990 - DNA, 19 bp, Homo sapiens
gcgaaagactaatcgaacc

SEQ ID NO: 44991 - DNA, 18 bp, Homo sapiens
cgaaagactaatcgaacc

SEQ ID NO: 44992 - DNA, 22 bp, Homo sapiens
cgaaagactaatcgaaccatct

SEQ ID NO: 44993 - DNA, 24 bp, Homo sapiens
cgaaagactaatcgaaccatctag

SEQ ID NO: 44994 - DNA, 27 bp, Homo sapiens
cgaaagactaatcgaaccatctagtag

SEQ ID NO: 44995 - DNA, 17 bp, Homo sapiens
gaaagactaatcgaacc

SEQ ID NO: 44996 - DNA, 22 bp, Homo sapiens
aaagactaatcgaaccatctag

SEQ ID NO: 44997 - DNA, 19 bp, Homo sapiens
aagactaatcgaaccatct

SEQ ID NO: 44998 - DNA, 20 bp, Homo sapiens
aagactaatcgaaccatcta

SEQ ID NO: 44999 - DNA, 21 bp, Homo sapiens
aagactaatcgaaccatctag

SEQ ID NO: 45000 - DNA, 22 bp, Homo sapiens
aagactaatcgaaccatctagt

SEQ ID NO: 45001 - DNA, 18 bp, Homo sapiens
agactaatcgaaccatct

SEQ ID NO: 45002 - DNA, 20 bp, Homo sapiens
agactaatcgaaccatctag

SEQ ID NO: 45003 - DNA, 21 bp, Homo sapiens
agactaatcgaaccatctagt

SEQ ID NO: 45004 - DNA, 16 bp, Homo sapiens
gactaatcgaaccatc

SEQ ID NO: 45005 - DNA, 19 bp, Homo sapiens
gactaatcgaaccatctag

SEQ ID NO: 45006 - DNA, 20 bp, Homo sapiens
gactaatcgaaccatctagt

SEQ ID NO: 45007 - DNA, 23 bp, Homo sapiens
gactaatcgaaccatctagtagc

SEQ ID NO: 45008 - DNA, 16 bp, Homo sapiens
actaatcgaaccatct

SEQ ID NO: 45009 - DNA, 17 bp, Homo sapiens
actaatcgaaccatcta

SEQ ID NO: 45010 - DNA, 18 bp, Homo sapiens
actaatcgaaccatctag

SEQ ID NO: 45011 - DNA, 19 bp, Homo sapiens
actaatcgaaccatctagt

SEQ ID NO: 45012 - DNA, 20 bp, Homo sapiens
actaatcgaaccatctagta

SEQ ID NO: 45013 - DNA, 21 bp, Homo sapiens
actaatcgaaccatctagtag

SEQ ID NO: 45014 - DNA, 22 bp, Homo sapiens
actaatcgaaccatctagtagc

SEQ ID NO: 45015 - DNA, 23 bp, Homo sapiens
actaatcgaaccatctagtagct

SEQ ID NO: 45016 - DNA, 17 bp, Homo sapiens
ctaatcgaaccatctag

SEQ ID NO: 45017 - DNA, 18 bp, Homo sapiens
ctaatcgaaccatctagt

SEQ ID NO: 45018 - DNA, 20 bp, Homo sapiens
ctaatcgaaccatctagtag

SEQ ID NO: 45019 - DNA, 21 bp, Homo sapiens
ctaatcgaaccatctagtagc

SEQ ID NO: 45020 - DNA, 22 bp, Homo sapiens
ctaatcgaaccatctagtagct

SEQ ID NO: 45021 - DNA, 23 bp, Homo sapiens
ctaatcgaaccatctagtagctg

SEQ ID NO: 45022 - DNA, 25 bp, Homo sapiens
ctaatcgaaccatctagtagctggt

SEQ ID NO: 45023 - DNA, 16 bp, Homo sapiens
aatcgaaccatctagt

SEQ ID NO: 45024 - DNA, 18 bp, Homo sapiens
aatcgaaccatctagtag

SEQ ID NO: 45025 - DNA, 20 bp, Homo sapiens
aatcgaaccatctagtagct

SEQ ID NO: 45026 - DNA, 21 bp, Homo sapiens
aatcgaaccatctagtagctg

SEQ ID NO: 45027 - DNA, 20 bp, Homo sapiens
atcgaaccatctagtagctg

SEQ ID NO: 45028 - DNA, 16 bp, Homo sapiens
tcgaaccatctagtag

SEQ ID NO: 45029 - DNA, 19 bp, Homo sapiens
tcgaaccatctagtagctg

SEQ ID NO: 45030 - DNA, 18 bp, Homo sapiens
cgaaccatctagtagctg

SEQ ID NO: 45031 - DNA, 21 bp, Homo sapiens
tctagtagctggttccctccg

SEQ ID NO: 45032 - DNA, 18 bp, Homo sapiens
ctagtagctggttccctc

SEQ ID NO: 45033 - DNA, 19 bp, Homo sapiens
ctagtagctggttccctcc

SEQ ID NO: 45034 - DNA, 20 bp, Homo sapiens
ctagtagctggttccctccg

SEQ ID NO: 45035 - DNA, 21 bp, Homo sapiens
ctagtagctggttccctccga

SEQ ID NO: 45036 - DNA, 18 bp, Homo sapiens
tagtagctggttccctcc

SEQ ID NO: 45037 - DNA, 19 bp, Homo sapiens
tagtagctggttccctccg

SEQ ID NO: 45038 - DNA, 20 bp, Homo sapiens
tagtagctggttccctccga

SEQ ID NO: 45039 - DNA, 18 bp, Homo sapiens
agtagctggttccctccg

SEQ ID NO: 45040 - DNA, 19 bp, Homo sapiens
agtagctggttccctccga

SEQ ID NO: 45041 - DNA, 21 bp, Homo sapiens
agtagctggttccctccgaag

SEQ ID NO: 45042 - DNA, 23 bp, Homo sapiens
agtagctggttccctccgaagtt

SEQ ID NO: 45043 - DNA, 18 bp, Homo sapiens
gtagctggttccctccga

SEQ ID NO: 45044 - DNA, 19 bp, Homo sapiens
gtagctggttccctccgaa

SEQ ID NO: 45045 - DNA, 20 bp, Homo sapiens
gtagctggttccctccgaag

SEQ ID NO: 45046 - DNA, 21 bp, Homo sapiens
gtagctggttccctccgaagt

SEQ ID NO: 45047 - DNA, 22 bp, Homo sapiens
gtagctggttccctccgaagtt

SEQ ID NO: 45048 - DNA, 16 bp, Homo sapiens
tagctggttccctccg

SEQ ID NO: 45049 - DNA, 17 bp, Homo sapiens
tagctggttccctccga

SEQ ID NO: 45050 - DNA, 19 bp, Homo sapiens
tagctggttccctccgaag

SEQ ID NO: 45051 - DNA, 20 bp, Homo sapiens
tagctggttccctccgaagt

SEQ ID NO: 45052 - DNA, 21 bp, Homo sapiens
tagctggttccctccgaagtt

SEQ ID NO: 45053 - DNA, 18 bp, Homo sapiens
agctggttccctccgaag

SEQ ID NO: 45054 - DNA, 19 bp, Homo sapiens
agctggttccctccgaagt

SEQ ID NO: 45055 - DNA, 20 bp, Homo sapiens
agctggttccctccgaagtt

SEQ ID NO: 45056 - DNA, 21 bp, Homo sapiens
agctggttccctccgaagttt

SEQ ID NO: 45057 - DNA, 19 bp, Homo sapiens
gctggttccctccgaagtt

SEQ ID NO: 45058 - DNA, 26 bp, Homo sapiens
gctggttccctccgaagtttccctca

SEQ ID NO: 45059 - DNA, 16 bp, Homo sapiens
ctggttccctccgaag

SEQ ID NO: 45060 - DNA, 17 bp, Homo sapiens
ctggttccctccgaagt

SEQ ID NO: 45061 - DNA, 18 bp, Homo sapiens
ctggttccctccgaagtt

SEQ ID NO: 45062 - DNA, 19 bp, Homo sapiens
ctggttccctccgaagttt

SEQ ID NO: 45063 - DNA, 20 bp, Homo sapiens
ctggttccctccgaagtttc

SEQ ID NO: 45064 - DNA, 21 bp, Homo sapiens
ctggttccctccgaagtttcc

SEQ ID NO: 45065 - DNA, 22 bp, Homo sapiens
ctggttccctccgaagtttccc

SEQ ID NO: 45066 - DNA, 23 bp, Homo sapiens
ctggttccctccgaagtttccct

SEQ ID NO: 45067 - DNA, 24 bp, Homo sapiens
ctggttccctccgaagtttccctc

SEQ ID NO: 45068 - DNA, 21 bp, Homo sapiens
tccctccgaagtttccctcag

SEQ ID NO: 45069 - DNA, 22 bp, Homo sapiens
tccctccgaagtttccctcagg

SEQ ID NO: 45070 - DNA, 20 bp, Homo sapiens
ccctccgaagtttccctcag

SEQ ID NO: 45071 - DNA, 21 bp, Homo sapiens
ccctccgaagtttccctcagg

SEQ ID NO: 45072 - DNA, 22 bp, Homo sapiens
ccctccgaagtttccctcagga

SEQ ID NO: 45073 - DNA, 16 bp, Homo sapiens
ctccgaagtttccctc

SEQ ID NO: 45074 - DNA, 17 bp, Homo sapiens
ctccgaagtttccctca

SEQ ID NO: 45075 - DNA, 19 bp, Homo sapiens
ctccgaagtttccctcagg

SEQ ID NO: 45076 - DNA, 18 bp, Homo sapiens
tccgaagtttccctcagg

SEQ ID NO: 45077 - DNA, 19 bp, Homo sapiens
tttccctcaggatagctgg

SEQ ID NO: 45078 - DNA, 17 bp, Homo sapiens
tccctcaggatagctgg

SEQ ID NO: 45079 - DNA, 25 bp, Homo sapiens
tccctcaggatagctggcgctctcg

SEQ ID NO: 45080 - DNA, 26 bp, Homo sapiens
tccctcaggatagctggcgctctcgc

SEQ ID NO: 45081 - DNA, 16 bp, Homo sapiens
ccctcaggatagctgg

SEQ ID NO: 45082 - DNA, 16 bp, Homo sapiens
ctcaggatagctggcg

SEQ ID NO: 45083 - DNA, 17 bp, Homo sapiens
ctcaggatagctggcgc

SEQ ID NO: 45084 - DNA, 18 bp, Homo sapiens
ctcaggatagctggcgct

SEQ ID NO: 45085 - DNA, 19 bp, Homo sapiens
ctcaggatagctggcgctc

SEQ ID NO: 45086 - DNA, 20 bp, Homo sapiens
ctcaggatagctggcgctct

SEQ ID NO: 45087 - DNA, 22 bp, Homo sapiens
ctcaggatagctggcgctctcg

SEQ ID NO: 45088 - DNA, 26 bp, Homo sapiens
ctcaggatagctggcgctctcgcaga

SEQ ID NO: 45089 - DNA, 24 bp, Homo sapiens
caggatagctggcgctctcgcaga

SEQ ID NO: 45090 - DNA, 26 bp, Homo sapiens
caggatagctggcgctctcgcagacc

SEQ ID NO: 45091 - DNA, 19 bp, Homo sapiens
aggatagctggcgctctcg

SEQ ID NO: 45092 - DNA, 20 bp, Homo sapiens
aggatagctggcgctctcgc

SEQ ID NO: 45093 - DNA, 18 bp, Homo sapiens
gatagctggcgctctcgc

SEQ ID NO: 45094 - DNA, 20 bp, Homo sapiens
gatagctggcgctctcgcag

SEQ ID NO: 45095 - DNA, 25 bp, Homo sapiens
gatagctggcgctctcgcagacccg

SEQ ID NO: 45096 - DNA, 19 bp, Homo sapiens
atagctggcgctctcgcag

SEQ ID NO: 45097 - DNA, 22 bp, Homo sapiens
atagctggcgctctcgcagacc

SEQ ID NO: 45098 - DNA, 23 bp, Homo sapiens
atagctggcgctctcgcagaccc

SEQ ID NO: 45099 - DNA, 24 bp, Homo sapiens
atagctggcgctctcgcagacccg

SEQ ID NO: 45100 - DNA, 25 bp, Homo sapiens
atagctggcgctctcgcagacccga

SEQ ID NO: 45101 - DNA, 28 bp, Homo sapiens
atagctggcgctctcgcagacccgacgc

SEQ ID NO: 45102 - DNA, 18 bp, Homo sapiens
tagctggcgctctcgcag

SEQ ID NO: 45103 - DNA, 19 bp, Homo sapiens
tagctggcgctctcgcaga

SEQ ID NO: 45104 - DNA, 21 bp, Homo sapiens
tagctggcgctctcgcagacc

SEQ ID NO: 45105 - DNA, 22 bp, Homo sapiens
tagctggcgctctcgcagaccc

SEQ ID NO: 45106 - DNA, 23 bp, Homo sapiens
tagctggcgctctcgcagacccg

SEQ ID NO: 45107 - DNA, 24 bp, Homo sapiens
tagctggcgctctcgcagacccga

SEQ ID NO: 45108 - DNA, 18 bp, Homo sapiens
gctggcgctctcgcagac

SEQ ID NO: 45109 - DNA, 19 bp, Homo sapiens
gctggcgctctcgcagacc

SEQ ID NO: 45110 - DNA, 20 bp, Homo sapiens
gctggcgctctcgcagaccc

SEQ ID NO: 45111 - DNA, 21 bp, Homo sapiens
gctggcgctctcgcagacccg

SEQ ID NO: 45112 - DNA, 22 bp, Homo sapiens
gctggcgctctcgcagacccga

SEQ ID NO: 45113 - DNA, 23 bp, Homo sapiens
gctggcgctctcgcagacccgac

SEQ ID NO: 45114 - DNA, 24 bp, Homo sapiens
gctggcgctctcgcagacccgacg

SEQ ID NO: 45115 - DNA, 25 bp, Homo sapiens
gctggcgctctcgcagacccgacgc

SEQ ID NO: 45116 - DNA, 26 bp, Homo sapiens
gctggcgctctcgcagacccgacgca

SEQ ID NO: 45117 - DNA, 16 bp, Homo sapiens
ctggcgctctcgcaga

SEQ ID NO: 45118 - DNA, 17 bp, Homo sapiens
ctggcgctctcgcagac

SEQ ID NO: 45119 - DNA, 18 bp, Homo sapiens
ctggcgctctcgcagacc

SEQ ID NO: 45120 - DNA, 19 bp, Homo sapiens
ctggcgctctcgcagaccc

SEQ ID NO: 45121 - DNA, 20 bp, Homo sapiens
ctggcgctctcgcagacccg

SEQ ID NO: 45122 - DNA, 21 bp, Homo sapiens
ctggcgctctcgcagacccga

SEQ ID NO: 45123 - DNA, 22 bp, Homo sapiens
ctggcgctctcgcagacccgac

SEQ ID NO: 45124 - DNA, 23 bp, Homo sapiens
ctggcgctctcgcagacccgacg

SEQ ID NO: 45125 - DNA, 24 bp, Homo sapiens
ctggcgctctcgcagacccgacgc

SEQ ID NO: 45126 - DNA, 25 bp, Homo sapiens
ctggcgctctcgcagacccgacgca

SEQ ID NO: 45127 - DNA, 27 bp, Homo sapiens
ctggcgctctcgcagacccgacgcacc

SEQ ID NO: 45128 - DNA, 19 bp, Homo sapiens
tggcgctctcgcagacccg

SEQ ID NO: 45129 - DNA, 20 bp, Homo sapiens
tggcgctctcgcagacccga

SEQ ID NO: 45130 - DNA, 21 bp, Homo sapiens
tggcgctctcgcagacccgac

SEQ ID NO: 45131 - DNA, 22 bp, Homo sapiens
tggcgctctcgcagacccgacg

SEQ ID NO: 45132 - DNA, 23 bp, Homo sapiens
tggcgctctcgcagacccgacgc

SEQ ID NO: 45133 - DNA, 16 bp, Homo sapiens
ggcgctctcgcagacc

SEQ ID NO: 45134 - DNA, 17 bp, Homo sapiens
ggcgctctcgcagaccc

SEQ ID NO: 45135 - DNA, 18 bp, Homo sapiens
ggcgctctcgcagacccg

SEQ ID NO: 45136 - DNA, 19 bp, Homo sapiens
ggcgctctcgcagacccga

SEQ ID NO: 45137 - DNA, 20 bp, Homo sapiens
ggcgctctcgcagacccgac

SEQ ID NO: 45138 - DNA, 21 bp, Homo sapiens
ggcgctctcgcagacccgacg

SEQ ID NO: 45139 - DNA, 22 bp, Homo sapiens
ggcgctctcgcagacccgacgc

SEQ ID NO: 45140 - DNA, 23 bp, Homo sapiens
ggcgctctcgcagacccgacgca

SEQ ID NO: 45141 - DNA, 25 bp, Homo sapiens
ggcgctctcgcagacccgacgcacc

SEQ ID NO: 45142 - DNA, 17 bp, Homo sapiens
gcgctctcgcagacccg

SEQ ID NO: 45143 - DNA, 19 bp, Homo sapiens
gcgctctcgcagacccgac

SEQ ID NO: 45144 - DNA, 20 bp, Homo sapiens
gcgctctcgcagacccgacg

SEQ ID NO: 45145 - DNA, 21 bp, Homo sapiens
gcgctctcgcagacccgacgc

SEQ ID NO: 45146 - DNA, 16 bp, Homo sapiens
cgctctcgcagacccg

SEQ ID NO: 45147 - DNA, 19 bp, Homo sapiens
cgctctcgcagacccgacg

SEQ ID NO: 45148 - DNA, 20 bp, Homo sapiens
cgctctcgcagacccgacgc

SEQ ID NO: 45149 - DNA, 16 bp, Homo sapiens
gctctcgcagacccga

SEQ ID NO: 45150 - DNA, 17 bp, Homo sapiens
gctctcgcagacccgac

SEQ ID NO: 45151 - DNA, 18 bp, Homo sapiens
gctctcgcagacccgacg

SEQ ID NO: 45152 - DNA, 19 bp, Homo sapiens
gctctcgcagacccgacgc

SEQ ID NO: 45153 - DNA, 20 bp, Homo sapiens
gctctcgcagacccgacgca

SEQ ID NO: 45154 - DNA, 22 bp, Homo sapiens
gctctcgcagacccgacgcacc

SEQ ID NO: 45155 - DNA, 16 bp, Homo sapiens
ctctcgcagacccgac

SEQ ID NO: 45156 - DNA, 17 bp, Homo sapiens
ctctcgcagacccgacg

SEQ ID NO: 45157 - DNA, 18 bp, Homo sapiens
ctctcgcagacccgacgc

SEQ ID NO: 45158 - DNA, 19 bp, Homo sapiens
ctctcgcagacccgacgca

SEQ ID NO: 45159 - DNA, 20 bp, Homo sapiens
ctctcgcagacccgacgcac

SEQ ID NO: 45160 - DNA, 21 bp, Homo sapiens
ctctcgcagacccgacgcacc

SEQ ID NO: 45161 - DNA, 25 bp, Homo sapiens
ctctcgcagacccgacgcacccccg

SEQ ID NO: 45162 - DNA, 16 bp, Homo sapiens
ctcgcagacccgacgc

SEQ ID NO: 45163 - DNA, 21 bp, Homo sapiens
ctcgcagacccgacgcacccc

SEQ ID NO: 45164 - DNA, 22 bp, Homo sapiens
ctcgcagacccgacgcaccccc

SEQ ID NO: 45165 - DNA, 23 bp, Homo sapiens
ctcgcagacccgacgcacccccg

SEQ ID NO: 45166 - DNA, 25 bp, Homo sapiens
ctcgcagacccgacgcacccccgcc

SEQ ID NO: 45167 - DNA, 28 bp, Homo sapiens
ctcgcagacccgacgcacccccgccacg

SEQ ID NO: 45168 - DNA, 29 bp, Homo sapiens
ctcgcagacccgacgcacccccgccacgc

SEQ ID NO: 45169 - DNA, 19 bp, Homo sapiens
gcagacccgacgcaccccc

SEQ ID NO: 45170 - DNA, 22 bp, Homo sapiens
gcagacccgacgcacccccgcc

SEQ ID NO: 45171 - DNA, 25 bp, Homo sapiens
gcagacccgacgcacccccgccacg

SEQ ID NO: 45172 - DNA, 26 bp, Homo sapiens
gcagacccgacgcacccccgccacgc

SEQ ID NO: 45173 - DNA, 19 bp, Homo sapiens
cagacccgacgcacccccg

SEQ ID NO: 45174 - DNA, 21 bp, Homo sapiens
cagacccgacgcacccccgcc

SEQ ID NO: 45175 - DNA, 19 bp, Homo sapiens
gacccgacgcacccccgcc

SEQ ID NO: 45176 - DNA, 21 bp, Homo sapiens
gacccgacgcacccccgccac

SEQ ID NO: 45177 - DNA, 22 bp, Homo sapiens
gacccgacgcacccccgccacg

SEQ ID NO: 45178 - DNA, 23 bp, Homo sapiens
gacccgacgcacccccgccacgc

SEQ ID NO: 45179 - DNA, 22 bp, Homo sapiens
acccgacgcacccccgccacgc

SEQ ID NO: 45180 - DNA, 16 bp, Homo sapiens
cccgacgcacccccgc

SEQ ID NO: 45181 - DNA, 17 bp, Homo sapiens
cccgacgcacccccgcc

SEQ ID NO: 45182 - DNA, 18 bp, Homo sapiens
cccgacgcacccccgcca

SEQ ID NO: 45183 - DNA, 19 bp, Homo sapiens
cccgacgcacccccgccac

SEQ ID NO: 45184 - DNA, 20 bp, Homo sapiens
cccgacgcacccccgccacg

SEQ ID NO: 45185 - DNA, 21 bp, Homo sapiens
cccgacgcacccccgccacgc

SEQ ID NO: 45186 - DNA, 22 bp, Homo sapiens
cccgacgcacccccgccacgca

SEQ ID NO: 45187 - DNA, 23 bp, Homo sapiens
cccgacgcacccccgccacgcag

SEQ ID NO: 45188 - DNA, 16 bp, Homo sapiens
ccgacgcacccccgcc

SEQ ID NO: 45189 - DNA, 18 bp, Homo sapiens
ccgacgcacccccgccac

SEQ ID NO: 45190 - DNA, 20 bp, Homo sapiens
ccgacgcacccccgccacgc

SEQ ID NO: 45191 - DNA, 18 bp, Homo sapiens
cgacgcacccccgccacg

SEQ ID NO: 45192 - DNA, 19 bp, Homo sapiens
cgacgcacccccgccacgc

SEQ ID NO: 45193 - DNA, 17 bp, Homo sapiens
gacgcacccccgccacg

SEQ ID NO: 45194 - DNA, 18 bp, Homo sapiens
gacgcacccccgccacgc

SEQ ID NO: 45195 - DNA, 22 bp, Homo sapiens
gacgcacccccgccacgcagtt

SEQ ID NO: 45196 - DNA, 19 bp, Homo sapiens
acccccgccacgcagtttt

SEQ ID NO: 45197 - DNA, 18 bp, Homo sapiens
cccccgccacgcagtttt

SEQ ID NO: 45198 - DNA, 21 bp, Homo sapiens
cccccgccacgcagttttatc

SEQ ID NO: 45199 - DNA, 22 bp, Homo sapiens
cccccgccacgcagttttatcc

SEQ ID NO: 45200 - DNA, 25 bp, Homo sapiens
cccccgccacgcagttttatccggt

SEQ ID NO: 45201 - DNA, 26 bp, Homo sapiens
cccccgccacgcagttttatccggta

SEQ ID NO: 45202 - DNA, 30 bp, Homo sapiens; identical to SEQ ID NO: 21143

SEQ ID NO: 45203 - DNA, 24 bp, Homo sapiens
ccccgccacgcagttttatccggt

SEQ ID NO: 45204 - DNA, 21 bp, Homo sapiens
ccgccacgcagttttatccgg

SEQ ID NO: 45205 - DNA, 22 bp, Homo sapiens
ccgccacgcagttttatccggt

SEQ ID NO: 45206 - DNA, 23 bp, Homo sapiens
ccgccacgcagttttatccggta

SEQ ID NO: 45207 - DNA, 18 bp, Homo sapiens
gccacgcagttttatccg

SEQ ID NO: 45208 - DNA, 23 bp, Homo sapiens
cacgcagttttatccggtaaagc

SEQ ID NO: 45209 - DNA, 21 bp, Homo sapiens
acgcagttttatccggtaaag

SEQ ID NO: 45210 - DNA, 22 bp, Homo sapiens
acgcagttttatccggtaaagc

SEQ ID NO: 45211 - DNA, 30 bp, Homo sapiens
acgcagttttatccggtaaagcgaatgatt

SEQ ID NO: 45212 - DNA, 20 bp, Homo sapiens
cgcagttttatccggtaaag

SEQ ID NO: 45213 - DNA, 21 bp, Homo sapiens
cgcagttttatccggtaaagc

SEQ ID NO: 45214 - DNA, 22 bp, Homo sapiens
cgcagttttatccggtaaagcg

SEQ ID NO: 45215 - DNA, 23 bp, Homo sapiens
cgcagttttatccggtaaagcga

SEQ ID NO: 45216 - DNA, 29 bp, Homo sapiens
cgcagttttatccggtaaagcgaatgatt

SEQ ID NO: 45217 - DNA, 16 bp, Homo sapiens
gcagttttatccggta

SEQ ID NO: 45218 - DNA, 18 bp, Homo sapiens
gcagttttatccggtaaa

SEQ ID NO: 45219 - DNA, 19 bp, Homo sapiens
gcagttttatccggtaaag

SEQ ID NO: 45220 - DNA, 20 bp, Homo sapiens
gcagttttatccggtaaagc

SEQ ID NO: 45221 - DNA, 21 bp, Homo sapiens
gcagttttatccggtaaagcg

SEQ ID NO: 45222 - DNA, 22 bp, Homo sapiens
gcagttttatccggtaaagcga

SEQ ID NO: 45223 - DNA, 23 bp, Homo sapiens
gcagttttatccggtaaagcgaa

SEQ ID NO: 45224 - DNA, 25 bp, Homo sapiens
gcagttttatccggtaaagcgaatg

SEQ ID NO: 45225 - DNA, 30 bp, Homo sapiens
gcagttttatccggtaaagcgaatgattag

SEQ ID NO: 45226 - DNA, 17 bp, Homo sapiens
gttttatccggtaaagc

SEQ ID NO: 45227 - DNA, 24 bp, Homo sapiens
ttatccggtaaagcgaatgattag

SEQ ID NO: 45228 - DNA, 23 bp, Homo sapiens
tatccggtaaagcgaatgattag

SEQ ID NO: 45229 - DNA, 24 bp, Homo sapiens
tatccggtaaagcgaatgattaga

SEQ ID NO: 45230 - DNA, 22 bp, Homo sapiens
atccggtaaagcgaatgattag

SEQ ID NO: 45231 - DNA, 21 bp, Homo sapiens
tccggtaaagcgaatgattag

SEQ ID NO: 45232 - DNA, 18 bp, Homo sapiens
ccggtaaagcgaatgatt

SEQ ID NO: 45233 - DNA, 20 bp, Homo sapiens
ccggtaaagcgaatgattag

SEQ ID NO: 45234 - DNA, 21 bp, Homo sapiens
ggtaaagcgaatgattagagg

SEQ ID NO: 45235 - DNA, 22 bp, Homo sapiens
ggtaaagcgaatgattagaggt

SEQ ID NO: 45236 - DNA, 22 bp, Homo sapiens
gtaaagcgaatgattagaggtc

SEQ ID NO: 45237 - DNA, 16 bp, Homo sapiens
taaagcgaatgattag

SEQ ID NO: 45238 - DNA, 19 bp, Homo sapiens
taaagcgaatgattagagg

SEQ ID NO: 45239 - DNA, 18 bp, Homo sapiens
aaagcgaatgattagagg

SEQ ID NO: 45240 - DNA, 24 bp, Homo sapiens
aaagcgaatgattagaggtcttgg

SEQ ID NO: 45241 - DNA, 17 bp, Homo sapiens
aagcgaatgattagagg

SEQ ID NO: 45242 - DNA, 23 bp, Homo sapiens
aagcgaatgattagaggtcttgg

SEQ ID NO: 45243 - DNA, 26 bp, Homo sapiens
aagcgaatgattagaggtcttggggc

SEQ ID NO: 45244 - DNA, 16 bp, Homo sapiens
agcgaatgattagagg

SEQ ID NO: 45245 - DNA, 21 bp, Homo sapiens
agcgaatgattagaggtcttg

SEQ ID NO: 45246 - DNA, 22 bp, Homo sapiens
agcgaatgattagaggtcttgg

SEQ ID NO: 45247 - DNA, 24 bp, Homo sapiens
agcgaatgattagaggtcttgggg

SEQ ID NO: 45248 - DNA, 25 bp, Homo sapiens
agcgaatgattagaggtcttggggc

SEQ ID NO: 45249 - DNA, 20 bp, Homo sapiens
gcgaatgattagaggtcttg

SEQ ID NO: 45250 - DNA, 21 bp, Homo sapiens
gcgaatgattagaggtcttgg

SEQ ID NO: 45251 - DNA, 22 bp, Homo sapiens
gcgaatgattagaggtcttggg

SEQ ID NO: 45252 - DNA, 23 bp, Homo sapiens
gcgaatgattagaggtcttgggg

SEQ ID NO: 45253 - DNA, 24 bp, Homo sapiens
gcgaatgattagaggtcttggggc

SEQ ID NO: 45254 - DNA, 25 bp, Homo sapiens
gcgaatgattagaggtcttggggcc

SEQ ID NO: 45255 - DNA, 19 bp, Homo sapiens
cgaatgattagaggtcttg

SEQ ID NO: 45256 - DNA, 20 bp, Homo sapiens
cgaatgattagaggtcttgg

SEQ ID NO: 45257 - DNA, 22 bp, Homo sapiens
cgaatgattagaggtcttgggg

SEQ ID NO: 45258 - DNA, 23 bp, Homo sapiens
cgaatgattagaggtcttggggc

SEQ ID NO: 45259 - DNA, 24 bp, Homo sapiens
cgaatgattagaggtcttggggcc

SEQ ID NO: 45260 - DNA, 18 bp, Homo sapiens
gaatgattagaggtcttg

SEQ ID NO: 45261 - DNA, 19 bp, Homo sapiens
gaatgattagaggtcttgg

SEQ ID NO: 45262 - DNA, 20 bp, Homo sapiens
gaatgattagaggtcttggg

SEQ ID NO: 45263 - DNA, 21 bp, Homo sapiens
gaatgattagaggtcttgggg

SEQ ID NO: 45264 - DNA, 22 bp, Homo sapiens
gaatgattagaggtcttggggc

SEQ ID NO: 45265 - DNA, 23 bp, Homo sapiens
gaatgattagaggtcttggggcc

SEQ ID NO: 45266 - DNA, 25 bp, Homo sapiens
gaatgattagaggtcttggggccga

SEQ ID NO: 45267 - DNA, 29 bp, Homo sapiens
gaatgattagaggtcttggggccgaaacg

SEQ ID NO: 45268 - DNA, 17 bp, Homo sapiens
aatgattagaggtcttg

SEQ ID NO: 45269 - DNA, 18 bp, Homo sapiens
aatgattagaggtcttgg

SEQ ID NO: 45270 - DNA, 19 bp, Homo sapiens
aatgattagaggtcttggg

SEQ ID NO: 45271 - DNA, 20 bp, Homo sapiens
aatgattagaggtcttgggg

SEQ ID NO: 45272 - DNA, 21 bp, Homo sapiens
aatgattagaggtcttggggc

SEQ ID NO: 45273 - DNA, 22 bp, Homo sapiens
aatgattagaggtcttggggcc

SEQ ID NO: 45274 - DNA, 23 bp, Homo sapiens
aatgattagaggtcttggggccg

SEQ ID NO: 45275 - DNA, 24 bp, Homo sapiens
aatgattagaggtcttggggccga

SEQ ID NO: 45276 - DNA, 25 bp, Homo sapiens
aatgattagaggtcttggggccgaa

SEQ ID NO: 45277 - DNA, 27 bp, Homo sapiens
aatgattagaggtcttggggccgaaac

SEQ ID NO: 45278 - DNA, 28 bp, Homo sapiens
aatgattagaggtcttggggccgaaacg

SEQ ID NO: 45279 - DNA, 29 bp, Homo sapiens
aatgattagaggtcttggggccgaaacga

SEQ ID NO: 45280 - DNA, 17 bp, Homo sapiens
atgattagaggtcttgg

SEQ ID NO: 45281 - DNA, 19 bp, Homo sapiens
atgattagaggtcttgggg

SEQ ID NO: 45282 - DNA, 20 bp, Homo sapiens
atgattagaggtcttggggc

SEQ ID NO: 45283 - DNA, 21 bp, Homo sapiens
atgattagaggtcttggggcc

SEQ ID NO: 45284 - DNA, 22 bp, Homo sapiens
atgattagaggtcttggggccg

SEQ ID NO: 45285 - DNA, 23 bp, Homo sapiens
atgattagaggtcttggggccga

SEQ ID NO: 45286 - DNA, 26 bp, Homo sapiens
atgattagaggtcttggggccgaaac

SEQ ID NO: 45287 - DNA, 27 bp, Homo sapiens
atgattagaggtcttggggccgaaacg

SEQ ID NO: 45288 - DNA, 16 bp, Homo sapiens
tgattagaggtcttgg

SEQ ID NO: 45289 - DNA, 18 bp, Homo sapiens
tgattagaggtcttgggg

SEQ ID NO: 45290 - DNA, 19 bp, Homo sapiens
tgattagaggtcttggggc

SEQ ID NO: 45291 - DNA, 20 bp, Homo sapiens
tgattagaggtcttggggcc

SEQ ID NO: 45292 - DNA, 21 bp, Homo sapiens
tgattagaggtcttggggccg

SEQ ID NO: 45293 - DNA, 22 bp, Homo sapiens
tgattagaggtcttggggccga

SEQ ID NO: 45294 - DNA, 25 bp, Homo sapiens
tgattagaggtcttggggccgaaac

SEQ ID NO: 45295 - DNA, 26 bp, Homo sapiens
tgattagaggtcttggggccgaaacg

SEQ ID NO: 45296 - DNA, 17 bp, Homo sapiens
gattagaggtcttgggg

SEQ ID NO: 45297 - DNA, 18 bp, Homo sapiens
gattagaggtcttggggc

SEQ ID NO: 45298 - DNA, 19 bp, Homo sapiens
gattagaggtcttggggcc

SEQ ID NO: 45299 - DNA, 20 bp, Homo sapiens
gattagaggtcttggggccg

SEQ ID NO: 45300 - DNA, 21 bp, Homo sapiens
gattagaggtcttggggccga

SEQ ID NO: 45301 - DNA, 25 bp, Homo sapiens
gattagaggtcttggggccgaaacg

SEQ ID NO: 45302 - DNA, 16 bp, Homo sapiens
attagaggtcttgggg

SEQ ID NO: 45303 - DNA, 17 bp, Homo sapiens
attagaggtcttggggc

SEQ ID NO: 45304 - DNA, 24 bp, Homo sapiens
attagaggtcttggggccgaaacg

SEQ ID NO: 45305 - DNA, 21 bp, Homo sapiens
ttagaggtcttggggccgaaa

SEQ ID NO: 45306 - DNA, 23 bp, Homo sapiens
ttagaggtcttggggccgaaacg

SEQ ID NO: 45307 - DNA, 18 bp, Homo sapiens
tagaggtcttggggccga

SEQ ID NO: 45308 - DNA, 19 bp, Homo sapiens
tagaggtcttggggccgaa

SEQ ID NO: 45309 - DNA, 20 bp, Homo sapiens
tagaggtcttggggccgaaa

SEQ ID NO: 45310 - DNA, 22 bp, Homo sapiens
tagaggtcttggggccgaaacg

SEQ ID NO: 45311 - DNA, 23 bp, Homo sapiens
tagaggtcttggggccgaaacga

SEQ ID NO: 45312 - DNA, 20 bp, Homo sapiens
agaggtcttggggccgaaac

SEQ ID NO: 45313 - DNA, 21 bp, Homo sapiens
agaggtcttggggccgaaacg

SEQ ID NO: 45314 - DNA, 20 bp, Homo sapiens
gaggtcttggggccgaaacg

SEQ ID NO: 45315 - DNA, 26 bp, Homo sapiens
gaggtcttggggccgaaacgatctca

SEQ ID NO: 45316 - DNA, 19 bp, Homo sapiens
aggtcttggggccgaaacg

SEQ ID NO: 45317 - DNA, 18 bp, Homo sapiens
ggtcttggggccgaaacg

SEQ ID NO: 45318 - DNA, 24 bp, Homo sapiens
ggtcttggggccgaaacgatctca

SEQ ID NO: 45319 - DNA, 17 bp, Homo sapiens
gtcttggggccgaaacg

SEQ ID NO: 45320 - DNA, 16 bp, Homo sapiens
tcttggggccgaaacg

SEQ ID NO: 45321 - DNA, 20 bp, Homo sapiens
gggccgaaacgatctcaacc

SEQ ID NO: 45322 - DNA, 21 bp, Homo sapiens
ggccgaaacgatctcaaccta

SEQ ID NO: 45323 - DNA, 19 bp, Homo sapiens
ccgaaacgatctcaaccta

SEQ ID NO: 45324 - DNA, 20 bp, Homo sapiens
acgatctcaacctattctca

SEQ ID NO: 45325 - DNA, 19 bp, Homo sapiens
cgatctcaacctattctca

SEQ ID NO: 45326 - DNA, 22 bp, Homo sapiens
cgatctcaacctattctcaaac

SEQ ID NO: 45327 - DNA, 26 bp, Homo sapiens
cgatctcaacctattctcaaacttta

SEQ ID NO: 45328 - DNA, 17 bp, Homo sapiens
gatctcaacctattctc

SEQ ID NO: 45329 - DNA, 18 bp, Homo sapiens
gatctcaacctattctca

SEQ ID NO: 45330 - DNA, 21 bp, Homo sapiens
gatctcaacctattctcaaac

SEQ ID NO: 45331 - DNA, 22 bp, Homo sapiens
gatctcaacctattctcaaact

SEQ ID NO: 45332 - DNA, 19 bp, Homo sapiens
ctcaacctattctcaaact

SEQ ID NO: 45333 - DNA, 20 bp, Homo sapiens
ctcaacctattctcaaactt

SEQ ID NO: 45334 - DNA, 22 bp, Homo sapiens
ctcaacctattctcaaacttta

SEQ ID NO: 45335 - DNA, 18 bp, Homo sapiens
caacctattctcaaactt

SEQ ID NO: 45336 - DNA, 20 bp, Homo sapiens
caacctattctcaaacttta

SEQ ID NO: 45337 - DNA, 21 bp, Homo sapiens
cctattctcaaactttaaatg

SEQ ID NO: 45338 - DNA, 23 bp, Homo sapiens
cctattctcaaactttaaatggg

SEQ ID NO: 45339 - DNA, 24 bp, Homo sapiens
cctattctcaaactttaaatgggt

SEQ ID NO: 45340 - DNA, 22 bp, Homo sapiens
ctattctcaaactttaaatggg

SEQ ID NO: 45341 - DNA, 23 bp, Homo sapiens
ctattctcaaactttaaatgggt

SEQ ID NO: 45342 - DNA, 20 bp, Homo sapiens
aatgggtaagaagcccggct

SEQ ID NO: 45343 - DNA, 22 bp, Homo sapiens
aatgggtaagaagcccggctcg

SEQ ID NO: 45344 - DNA, 30 bp, Homo sapiens
aatgggtaagaagcccggctcgctggcgtg

SEQ ID NO: 45345 - DNA, 20 bp, Homo sapiens
gggtaagaagcccggctcgc

SEQ ID NO: 45346 - DNA, 21 bp, Homo sapiens
gggtaagaagcccggctcgct

SEQ ID NO: 45347 - DNA, 27 bp, Homo sapiens
ggtaagaagcccggctcgctggcgtgg

SEQ ID NO: 45348 - DNA, 28 bp, Homo sapiens
ggtaagaagcccggctcgctggcgtgga

SEQ ID NO: 45349 - DNA, 21 bp, Homo sapiens
gtaagaagcccggctcgctgg

SEQ ID NO: 45350 - DNA, 26 bp, Homo sapiens
gtaagaagcccggctcgctggcgtgg

SEQ ID NO: 45351 - DNA, 27 bp, Homo sapiens
gtaagaagcccggctcgctggcgtgga

SEQ ID NO: 45352 - DNA, 20 bp, Homo sapiens
taagaagcccggctcgctgg

SEQ ID NO: 45353 - DNA, 25 bp, Homo sapiens
taagaagcccggctcgctggcgtgg

SEQ ID NO: 45354 - DNA, 26 bp, Homo sapiens
taagaagcccggctcgctggcgtgga

SEQ ID NO: 45355 - DNA, 19 bp, Homo sapiens
aagaagcccggctcgctgg

SEQ ID NO: 45356 - DNA, 21 bp, Homo sapiens
aagaagcccggctcgctggcg

SEQ ID NO: 45357 - DNA, 22 bp, Homo sapiens
aagaagcccggctcgctggcgt

SEQ ID NO: 45358 - DNA, 23 bp, Homo sapiens
aagaagcccggctcgctggcgtg

SEQ ID NO: 45359 - DNA, 24 bp, Homo sapiens
aagaagcccggctcgctggcgtgg

SEQ ID NO: 45360 - DNA, 25 bp, Homo sapiens
aagaagcccggctcgctggcgtgga

SEQ ID NO: 45361 - DNA, 26 bp, Homo sapiens
aagaagcccggctcgctggcgtggag

SEQ ID NO: 45362 - DNA, 23 bp, Homo sapiens
agaagcccggctcgctggcgtgg

SEQ ID NO: 45363 - DNA, 24 bp, Homo sapiens
agaagcccggctcgctggcgtgga

SEQ ID NO: 45364 - DNA, 25 bp, Homo sapiens
agaagcccggctcgctggcgtggag

SEQ ID NO: 45365 - DNA, 26 bp, Homo sapiens
agaagcccggctcgctggcgtggagc

SEQ ID NO: 45366 - DNA, 17 bp, Homo sapiens
gaagcccggctcgctgg

SEQ ID NO: 45367 - DNA, 18 bp, Homo sapiens
gaagcccggctcgctggc

SEQ ID NO: 45368 - DNA, 21 bp, Homo sapiens
gaagcccggctcgctggcgtg

SEQ ID NO: 45369 - DNA, 22 bp, Homo sapiens
gaagcccggctcgctggcgtgg

SEQ ID NO: 45370 - DNA, 23 bp, Homo sapiens
gaagcccggctcgctggcgtgga

SEQ ID NO: 45371 - DNA, 24 bp, Homo sapiens
gaagcccggctcgctggcgtggag

SEQ ID NO: 45372 - DNA, 25 bp, Homo sapiens
gaagcccggctcgctggcgtggagc

SEQ ID NO: 45373 - DNA, 16 bp, Homo sapiens
aagcccggctcgctgg

SEQ ID NO: 45374 - DNA, 21 bp, Homo sapiens
aagcccggctcgctggcgtgg

SEQ ID NO: 45375 - DNA, 22 bp, Homo sapiens
aagcccggctcgctggcgtgga

SEQ ID NO: 45376 - DNA, 23 bp, Homo sapiens
aagcccggctcgctggcgtggag

SEQ ID NO: 45377 - DNA, 24 bp, Homo sapiens
aagcccggctcgctggcgtggagc

SEQ ID NO: 45378 - DNA, 20 bp, Homo sapiens
agcccggctcgctggcgtgg

SEQ ID NO: 45379 - DNA, 21 bp, Homo sapiens
agcccggctcgctggcgtgga

SEQ ID NO: 45380 - DNA, 22 bp, Homo sapiens
agcccggctcgctggcgtggag

SEQ ID NO: 45381 - DNA, 23 bp, Homo sapiens
agcccggctcgctggcgtggagc

SEQ ID NO: 45382 - DNA, 19 bp, Homo sapiens
gcccggctcgctggcgtgg

SEQ ID NO: 45383 - DNA, 20 bp, Homo sapiens
gcccggctcgctggcgtgga

SEQ ID NO: 45384 - DNA, 21 bp, Homo sapiens
gcccggctcgctggcgtggag

SEQ ID NO: 45385 - DNA, 22 bp, Homo sapiens
gcccggctcgctggcgtggagc

SEQ ID NO: 45386 - DNA, 18 bp, Homo sapiens
cccggctcgctggcgtgg

SEQ ID NO: 45387 - DNA, 19 bp, Homo sapiens
cccggctcgctggcgtgga

SEQ ID NO: 45388 - DNA, 20 bp, Homo sapiens
cccggctcgctggcgtggag

SEQ ID NO: 45389 - DNA, 21 bp, Homo sapiens
cccggctcgctggcgtggagc

SEQ ID NO: 45390 - DNA, 17 bp, Homo sapiens
ccggctcgctggcgtgg

SEQ ID NO: 45391 - DNA, 18 bp, Homo sapiens
ccggctcgctggcgtgga

SEQ ID NO: 45392 - DNA, 19 bp, Homo sapiens
ccggctcgctggcgtggag

SEQ ID NO: 45393 - DNA, 20 bp, Homo sapiens
ccggctcgctggcgtggagc

SEQ ID NO: 45394 - DNA, 16 bp, Homo sapiens
cggctcgctggcgtgg

SEQ ID NO: 45395 - DNA, 17 bp, Homo sapiens
cggctcgctggcgtgga

SEQ ID NO: 45396 - DNA, 18 bp, Homo sapiens
cggctcgctggcgtggag

SEQ ID NO: 45397 - DNA, 19 bp, Homo sapiens
cggctcgctggcgtggagc

SEQ ID NO: 45398 - DNA, 16 bp, Homo sapiens
ggctcgctggcgtgga

SEQ ID NO: 45399 - DNA, 17 bp, Homo sapiens
ggctcgctggcgtggag

SEQ ID NO: 45400 - DNA, 18 bp, Homo sapiens
ggctcgctggcgtggagc

SEQ ID NO: 45401 - DNA, 21 bp, Homo sapiens
ggctcgctggcgtggagccgg

SEQ ID NO: 45402 - DNA, 20 bp, Homo sapiens
gctcgctggcgtggagccgg

SEQ ID NO: 45403 - DNA, 19 bp, Homo sapiens
ctcgctggcgtggagccgg

SEQ ID NO: 45404 - DNA, 21 bp, Homo sapiens
ctcgctggcgtggagccgggc

SEQ ID NO: 45405 - DNA, 20 bp, Homo sapiens
tggcgtggagccgggcgtgg

SEQ ID NO: 45406 - DNA, 21 bp, Homo sapiens
tggcgtggagccgggcgtgga

SEQ ID NO: 45407 - DNA, 22 bp, Homo sapiens
tggcgtggagccgggcgtggaa

SEQ ID NO: 45408 - DNA, 23 bp, Homo sapiens
tggcgtggagccgggcgtggaat

SEQ ID NO: 45409 - DNA, 19 bp, Homo sapiens
ggcgtggagccgggcgtgg

SEQ ID NO: 45410 - DNA, 20 bp, Homo sapiens
ggcgtggagccgggcgtgga

SEQ ID NO: 45411 - DNA, 25 bp, Homo sapiens
ggcgtggagccgggcgtggaatgcg

SEQ ID NO: 45412 - DNA, 18 bp, Homo sapiens
gcgtggagccgggcgtgg

SEQ ID NO: 45413 - DNA, 19 bp, Homo sapiens
gcgtggagccgggcgtgga

SEQ ID NO: 45414 - DNA, 20 bp, Homo sapiens
gcgtggagccgggcgtggaa

SEQ ID NO: 45415 - DNA, 21 bp, Homo sapiens
gcgtggagccgggcgtggaat

SEQ ID NO: 45416 - DNA, 22 bp, Homo sapiens
gcgtggagccgggcgtggaatg

SEQ ID NO: 45417 - DNA, 23 bp, Homo sapiens
gcgtggagccgggcgtggaatgc

SEQ ID NO: 45418 - DNA, 24 bp, Homo sapiens
gcgtggagccgggcgtggaatgcg

SEQ ID NO: 45419 - DNA, 25 bp, Homo sapiens
gcgtggagccgggcgtggaatgcga

SEQ ID NO: 45420 - DNA, 16 bp, Homo sapiens
cgtggagccgggcgtg

SEQ ID NO: 45421 - DNA, 17 bp, Homo sapiens
cgtggagccgggcgtgg

SEQ ID NO: 45422 - DNA, 18 bp, Homo sapiens
cgtggagccgggcgtgga

SEQ ID NO: 45423 - DNA, 19 bp, Homo sapiens
cgtggagccgggcgtggaa

SEQ ID NO: 45424 - DNA, 20 bp, Homo sapiens
cgtggagccgggcgtggaat

SEQ ID NO: 45425 - DNA, 21 bp, Homo sapiens
cgtggagccgggcgtggaatg

SEQ ID NO: 45426 - DNA, 22 bp, Homo sapiens
cgtggagccgggcgtggaatgc

SEQ ID NO: 45427 - DNA, 23 bp, Homo sapiens
cgtggagccgggcgtggaatgcg

SEQ ID NO: 45428 - DNA, 24 bp, Homo sapiens
cgtggagccgggcgtggaatgcga

SEQ ID NO: 45429 - DNA, 25 bp, Homo sapiens
cgtggagccgggcgtggaatgcgag

SEQ ID NO: 45430 - DNA, 26 bp, Homo sapiens
cgtggagccgggcgtggaatgcgagt

SEQ ID NO: 45431 - DNA, 30 bp, Homo sapiens
cgtggagccgggcgtggaatgcgagtgcct

SEQ ID NO: 45432 - DNA, 16 bp, Homo sapiens
gtggagccgggcgtgg

SEQ ID NO: 45433 - DNA, 17 bp, Homo sapiens
gtggagccgggcgtgga

SEQ ID NO: 45434 - DNA, 18 bp, Homo sapiens
gtggagccgggcgtggaa

SEQ ID NO: 45435 - DNA, 19 bp, Homo sapiens
gtggagccgggcgtggaat

SEQ ID NO: 45436 - DNA, 20 bp, Homo sapiens
gtggagccgggcgtggaatg

SEQ ID NO: 45437 - DNA, 21 bp, Homo sapiens
gtggagccgggcgtggaatgc

SEQ ID NO: 45438 - DNA, 22 bp, Homo sapiens
gtggagccgggcgtggaatgcg

SEQ ID NO: 45439 - DNA, 23 bp, Homo sapiens
gtggagccgggcgtggaatgcga

SEQ ID NO: 45440 - DNA, 24 bp, Homo sapiens
gtggagccgggcgtggaatgcgag

SEQ ID NO: 45441 - DNA, 25 bp, Homo sapiens
gtggagccgggcgtggaatgcgagt

SEQ ID NO: 45442 - DNA, 16 bp, Homo sapiens
tggagccgggcgtgga

SEQ ID NO: 45443 - DNA, 17 bp, Homo sapiens
tggagccgggcgtggaa

SEQ ID NO: 45444 - DNA, 18 bp, Homo sapiens
tggagccgggcgtggaat

SEQ ID NO: 45445 - DNA, 19 bp, Homo sapiens
tggagccgggcgtggaatg

SEQ ID NO: 45446 - DNA, 20 bp, Homo sapiens
tggagccgggcgtggaatgc

SEQ ID NO: 45447 - DNA, 21 bp, Homo sapiens
tggagccgggcgtggaatgcg

SEQ ID NO: 45448 - DNA, 22 bp, Homo sapiens
tggagccgggcgtggaatgcga

SEQ ID NO: 45449 - DNA, 23 bp, Homo sapiens
tggagccgggcgtggaatgcgag

SEQ ID NO: 45450 - DNA, 24 bp, Homo sapiens
tggagccgggcgtggaatgcgagt

SEQ ID NO: 45451 - DNA, 25 bp, Homo sapiens
tggagccgggcgtggaatgcgagtg

SEQ ID NO: 45452 - DNA, 26 bp, Homo sapiens
tggagccgggcgtggaatgcgagtgc

SEQ ID NO: 45453 - DNA, 27 bp, Homo sapiens
tggagccgggcgtggaatgcgagtgcc

SEQ ID NO: 45454 - DNA, 16 bp, Homo sapiens
ggagccgggcgtggaa

SEQ ID NO: 45455 - DNA, 17 bp, Homo sapiens
ggagccgggcgtggaat

SEQ ID NO: 45456 - DNA, 18 bp, Homo sapiens
ggagccgggcgtggaatg

SEQ ID NO: 45457 - DNA, 19 bp, Homo sapiens
ggagccgggcgtggaatgc

SEQ ID NO: 45458 - DNA, 20 bp, Homo sapiens
ggagccgggcgtggaatgcg

SEQ ID NO: 45459 - DNA, 21 bp, Homo sapiens
ggagccgggcgtggaatgcga

SEQ ID NO: 45460 - DNA, 22 bp, Homo sapiens
ggagccgggcgtggaatgcgag

SEQ ID NO: 45461 - DNA, 23 bp, Homo sapiens
ggagccgggcgtggaatgcgagt

SEQ ID NO: 45462 - DNA, 16 bp, Homo sapiens
gagccgggcgtggaat

SEQ ID NO: 45463 - DNA, 17 bp, Homo sapiens
gagccgggcgtggaatg

SEQ ID NO: 45464 - DNA, 18 bp, Homo sapiens
gagccgggcgtggaatgc

SEQ ID NO: 45465 - DNA, 19 bp, Homo sapiens
gagccgggcgtggaatgcg

SEQ ID NO: 45466 - DNA, 20 bp, Homo sapiens
gagccgggcgtggaatgcga

SEQ ID NO: 45467 - DNA, 21 bp, Homo sapiens
gagccgggcgtggaatgcgag

SEQ ID NO: 45468 - DNA, 22 bp, Homo sapiens
gagccgggcgtggaatgcgagt

SEQ ID NO: 45469 - DNA, 24 bp, Homo sapiens
gagccgggcgtggaatgcgagtgc

SEQ ID NO: 45470 - DNA, 16 bp, Homo sapiens
agccgggcgtggaatg

SEQ ID NO: 45471 - DNA, 18 bp, Homo sapiens
agccgggcgtggaatgcg

SEQ ID NO: 45472 - DNA, 19 bp, Homo sapiens
agccgggcgtggaatgcga

SEQ ID NO: 45473 - DNA, 20 bp, Homo sapiens
agccgggcgtggaatgcgag

SEQ ID NO: 45474 - DNA, 23 bp, Homo sapiens
agccgggcgtggaatgcgagtgc

SEQ ID NO: 45475 - DNA, 17 bp, Homo sapiens
gccgggcgtggaatgcg

SEQ ID NO: 45476 - DNA, 18 bp, Homo sapiens
gccgggcgtggaatgcga

SEQ ID NO: 45477 - DNA, 17 bp, Homo sapiens
ccgggcgtggaatgcga

SEQ ID NO: 45478 - DNA, 18 bp, Homo sapiens
ccgggcgtggaatgcgag

SEQ ID NO: 45479 - DNA, 21 bp, Homo sapiens
ccgggcgtggaatgcgagtgc

SEQ ID NO: 45480 - DNA, 21 bp, Homo sapiens
gggcgtggaatgcgagtgcct

SEQ ID NO: 45481 - DNA, 18 bp, Homo sapiens
ggcgtggaatgcgagtgc

SEQ ID NO: 45482 - DNA, 19 bp, Homo sapiens
ggcgtggaatgcgagtgcc

SEQ ID NO: 45483 - DNA, 20 bp, Homo sapiens
ggcgtggaatgcgagtgcct

SEQ ID NO: 45484 - DNA, 19 bp, Homo sapiens
gcgtggaatgcgagtgcct

SEQ ID NO: 45485 - DNA, 23 bp, Homo sapiens
gagtgcctagtgggccacttttg

SEQ ID NO: 45486 - DNA, 22 bp, Homo sapiens
gtgcctagtgggccacttttgg

SEQ ID NO: 45487 - DNA, 21 bp, Homo sapiens
tagtgggccacttttggtaag

SEQ ID NO: 45488 - DNA, 16 bp, Homo sapiens
agtgggccacttttgg

SEQ ID NO: 45489 - DNA, 17 bp, Homo sapiens
agtgggccacttttggt

SEQ ID NO: 45490 - DNA, 20 bp, Homo sapiens
agtgggccacttttggtaag

SEQ ID NO: 45491 - DNA, 23 bp, Homo sapiens
gtgggccacttttggtaagcaga

SEQ ID NO: 45492 - DNA, 20 bp, Homo sapiens
ttttggtaagcagaactggc

SEQ ID NO: 45493 - DNA, 19 bp, Homo sapiens
agcagaactggcgctgcgg

SEQ ID NO: 45494 - DNA, 16 bp, Homo sapiens
cagaactggcgctgcg

SEQ ID NO: 45495 - DNA, 19 bp, Homo sapiens
cagaactggcgctgcggga

SEQ ID NO: 45496 - DNA, 19 bp, Homo sapiens
ctggcgctgcgggatgaac

SEQ ID NO: 45497 - DNA, 26 bp, Homo sapiens
ctggcgctgcgggatgaaccgaacgc

SEQ ID NO: 45498 - DNA, 25 bp, Homo sapiens
tggcgctgcgggatgaaccgaacgc

SEQ ID NO: 45499 - DNA, 19 bp, Homo sapiens
ggcgctgcgggatgaaccg

SEQ ID NO: 45500 - DNA, 17 bp, Homo sapiens
gcgctgcgggatgaacc

SEQ ID NO: 45501 - DNA, 19 bp, Homo sapiens
ctgcgggatgaaccgaacg

SEQ ID NO: 45502 - DNA, 20 bp, Homo sapiens
ctgcgggatgaaccgaacgc

SEQ ID NO: 45503 - DNA, 22 bp, Homo sapiens
ctgcgggatgaaccgaacgccg

SEQ ID NO: 45504 - DNA, 23 bp, Homo sapiens
ctgcgggatgaaccgaacgccgg

SEQ ID NO: 45505 - DNA, 24 bp, Homo sapiens
ctgcgggatgaaccgaacgccggg

SEQ ID NO: 45506 - DNA, 26 bp, Homo sapiens
ctgcgggatgaaccgaacgccgggtt

SEQ ID NO: 45507 - DNA, 21 bp, Homo sapiens
gcgggatgaaccgaacgccgg

SEQ ID NO: 45508 - DNA, 18 bp, Homo sapiens
cgggatgaaccgaacgcc

SEQ ID NO: 45509 - DNA, 19 bp, Homo sapiens
cgggatgaaccgaacgccg

SEQ ID NO: 45510 - DNA, 20 bp, Homo sapiens
cgggatgaaccgaacgccgg

SEQ ID NO: 45511 - DNA, 21 bp, Homo sapiens
cgggatgaaccgaacgccggg

SEQ ID NO: 45512 - DNA, 22 bp, Homo sapiens
cgggatgaaccgaacgccgggt

SEQ ID NO: 45513 - DNA, 24 bp, Homo sapiens
cgggatgaaccgaacgccgggtta

SEQ ID NO: 45514 - DNA, 25 bp, Homo sapiens
cgggatgaaccgaacgccgggttaa

SEQ ID NO: 45515 - DNA, 26 bp, Homo sapiens
cgggatgaaccgaacgccgggttaag

SEQ ID NO: 45516 - DNA, 27 bp, Homo sapiens
cgggatgaaccgaacgccgggttaagg

SEQ ID NO: 45517 - DNA, 16 bp, Homo sapiens
gggatgaaccgaacgc

SEQ ID NO: 45518 - DNA, 17 bp, Homo sapiens
gggatgaaccgaacgcc

SEQ ID NO: 45519 - DNA, 19 bp, Homo sapiens
gggatgaaccgaacgccgg

SEQ ID NO: 45520 - DNA, 20 bp, Homo sapiens
gggatgaaccgaacgccggg

SEQ ID NO: 45521 - DNA, 21 bp, Homo sapiens
gggatgaaccgaacgccgggt

SEQ ID NO: 45522 - DNA, 22 bp, Homo sapiens
gggatgaaccgaacgccgggtt

SEQ ID NO: 45523 - DNA, 16 bp, Homo sapiens
ggatgaaccgaacgcc

SEQ ID NO: 45524 - DNA, 18 bp, Homo sapiens
ggatgaaccgaacgccgg

SEQ ID NO: 45525 - DNA, 19 bp, Homo sapiens
ggatgaaccgaacgccggg

SEQ ID NO: 45526 - DNA, 20 bp, Homo sapiens
ggatgaaccgaacgccgggt

SEQ ID NO: 45527 - DNA, 21 bp, Homo sapiens
ggatgaaccgaacgccgggtt

SEQ ID NO: 45528 - DNA, 24 bp, Homo sapiens
ggatgaaccgaacgccgggttaag

SEQ ID NO: 45529 - DNA, 25 bp, Homo sapiens
ggatgaaccgaacgccgggttaagg

SEQ ID NO: 45530 - DNA, 16 bp, Homo sapiens
gatgaaccgaacgccg

SEQ ID NO: 45531 - DNA, 17 bp, Homo sapiens
gatgaaccgaacgccgg

SEQ ID NO: 45532 - DNA, 18 bp, Homo sapiens
gatgaaccgaacgccggg

SEQ ID NO: 45533 - DNA, 19 bp, Homo sapiens
gatgaaccgaacgccgggt

SEQ ID NO: 45534 - DNA, 20 bp, Homo sapiens
gatgaaccgaacgccgggtt

SEQ ID NO: 45535 - DNA, 21 bp, Homo sapiens
gatgaaccgaacgccgggtta

SEQ ID NO: 45536 - DNA, 23 bp, Homo sapiens
gatgaaccgaacgccgggttaag

SEQ ID NO: 45537 - DNA, 24 bp, Homo sapiens
gatgaaccgaacgccgggttaagg

SEQ ID NO: 45538 - DNA, 16 bp, Homo sapiens
atgaaccgaacgccgg

SEQ ID NO: 45539 - DNA, 17 bp, Homo sapiens
atgaaccgaacgccggg

SEQ ID NO: 45540 - DNA, 18 bp, Homo sapiens
atgaaccgaacgccgggt

SEQ ID NO: 45541 - DNA, 19 bp, Homo sapiens
atgaaccgaacgccgggtt

SEQ ID NO: 45542 - DNA, 20 bp, Homo sapiens
atgaaccgaacgccgggtta

SEQ ID NO: 45543 - DNA, 22 bp, Homo sapiens
atgaaccgaacgccgggttaag

SEQ ID NO: 45544 - DNA, 23 bp, Homo sapiens
atgaaccgaacgccgggttaagg

SEQ ID NO: 45545 - DNA, 29 bp, Homo sapiens
atgaaccgaacgccgggttaaggcgcccg

SEQ ID NO: 45546 - DNA, 16 bp, Homo sapiens
tgaaccgaacgccggg

SEQ ID NO: 45547 - DNA, 18 bp, Homo sapiens
tgaaccgaacgccgggtt

SEQ ID NO: 45548 - DNA, 20 bp, Homo sapiens
tgaaccgaacgccgggttaa

SEQ ID NO: 45549 - DNA, 21 bp, Homo sapiens
tgaaccgaacgccgggttaag

SEQ ID NO: 45550 - DNA, 22 bp, Homo sapiens
tgaaccgaacgccgggttaagg

SEQ ID NO: 45551 - DNA, 20 bp, Homo sapiens
gaaccgaacgccgggttaag

SEQ ID NO: 45552 - DNA, 21 bp, Homo sapiens
gaaccgaacgccgggttaagg

SEQ ID NO: 45553 - DNA, 19 bp, Homo sapiens
aaccgaacgccgggttaag

SEQ ID NO: 45554 - DNA, 20 bp, Homo sapiens
aaccgaacgccgggttaagg

SEQ ID NO: 45555 - DNA, 18 bp, Homo sapiens
accgaacgccgggttaag

SEQ ID NO: 45556 - DNA, 19 bp, Homo sapiens
accgaacgccgggttaagg

SEQ ID NO: 45557 - DNA, 17 bp, Homo sapiens
ccgaacgccgggttaag

SEQ ID NO: 45558 - DNA, 18 bp, Homo sapiens
ccgaacgccgggttaagg

SEQ ID NO: 45559 - DNA, 16 bp, Homo sapiens
cgaacgccgggttaag

SEQ ID NO: 45560 - DNA, 17 bp, Homo sapiens
cgaacgccgggttaagg

SEQ ID NO: 45561 - DNA, 16 bp, Homo sapiens
gaacgccgggttaagg

SEQ ID NO: 45562 - DNA, 22 bp, Homo sapiens
cgggttaaggcgcccgatgccg

SEQ ID NO: 45563 - DNA, 23 bp, Homo sapiens
cgggttaaggcgcccgatgccga

SEQ ID NO: 45564 - DNA, 19 bp, Homo sapiens
aggcgcccgatgccgacgc

SEQ ID NO: 45565 - DNA, 24 bp, Homo sapiens
gcgcccgatgccgacgctcatcag

SEQ ID NO: 45566 - DNA, 29 bp, Homo sapiens
gcgcccgatgccgacgctcatcagacccc

SEQ ID NO: 45567 - DNA, 22 bp, Homo sapiens
gcccgatgccgacgctcatcag

SEQ ID NO: 45568 - DNA, 28 bp, Homo sapiens
cccgatgccgacgctcatcagaccccag

SEQ ID NO: 45569 - DNA, 23 bp, Homo sapiens
gatgccgacgctcatcagacccc

SEQ ID NO: 45570 - DNA, 25 bp, Homo sapiens
gatgccgacgctcatcagaccccag

SEQ ID NO: 45571 - DNA, 22 bp, Homo sapiens
atgccgacgctcatcagacccc

SEQ ID NO: 45572 - DNA, 23 bp, Homo sapiens
atgccgacgctcatcagacccca

SEQ ID NO: 45573 - DNA, 24 bp, Homo sapiens
atgccgacgctcatcagaccccag

SEQ ID NO: 45574 - DNA, 23 bp, Homo sapiens
tgccgacgctcatcagaccccag

SEQ ID NO: 45575 - DNA, 22 bp, Homo sapiens
gccgacgctcatcagaccccag

SEQ ID NO: 45576 - DNA, 21 bp, Homo sapiens
ccgacgctcatcagaccccag

SEQ ID NO: 45577 - DNA, 22 bp, Homo sapiens
ccgacgctcatcagaccccaga

SEQ ID NO: 45578 - DNA, 20 bp, Homo sapiens
cgacgctcatcagaccccag

SEQ ID NO: 45579 - DNA, 19 bp, Homo sapiens
gacgctcatcagaccccag

SEQ ID NO: 45580 - DNA, 18 bp, Homo sapiens
acgctcatcagaccccag

SEQ ID NO: 45581 - DNA, 19 bp, Homo sapiens
acgctcatcagaccccaga

SEQ ID NO: 45582 - DNA, 17 bp, Homo sapiens
cgctcatcagaccccag

SEQ ID NO: 45583 - DNA, 16 bp, Homo sapiens
gctcatcagaccccag

SEQ ID NO: 45584 - DNA, 16 bp, Homo sapiens
ctcatcagaccccaga

SEQ ID NO: 45585 - DNA, 20 bp, Homo sapiens
ctcatcagaccccagaaaag

SEQ ID NO: 45586 - DNA, 21 bp, Homo sapiens
ctcatcagaccccagaaaagg

SEQ ID NO: 45587 - DNA, 22 bp, Homo sapiens
ctcatcagaccccagaaaaggt

SEQ ID NO: 45588 - DNA, 23 bp, Homo sapiens
ctcatcagaccccagaaaaggtg

SEQ ID NO: 45589 - DNA, 18 bp, Homo sapiens
catcagaccccagaaaag

SEQ ID NO: 45590 - DNA, 19 bp, Homo sapiens
catcagaccccagaaaagg

SEQ ID NO: 45591 - DNA, 24 bp, Homo sapiens
catcagaccccagaaaaggtgttg

SEQ ID NO: 45592 - DNA, 25 bp, Homo sapiens
catcagaccccagaaaaggtgttgg

SEQ ID NO: 45593 - DNA, 17 bp, Homo sapiens
tcagaccccagaaaagg

SEQ ID NO: 45594 - DNA, 20 bp, Homo sapiens
gaccccagaaaaggtgttgg

SEQ ID NO: 45595 - DNA, 19 bp, Homo sapiens
accccagaaaaggtgttgg

SEQ ID NO: 45596 - DNA, 28 bp, Homo sapiens
accccagaaaaggtgttggttgatatag

SEQ ID NO: 45597 - DNA, 17 bp, Homo sapiens
ccccagaaaaggtgttg

SEQ ID NO: 45598 - DNA, 18 bp, Homo sapiens
ccccagaaaaggtgttgg

SEQ ID NO: 45599 - DNA, 21 bp, Homo sapiens
ccccagaaaaggtgttggttg

SEQ ID NO: 45600 - DNA, 23 bp, Homo sapiens
ccccagaaaaggtgttggttgat

SEQ ID NO: 45601 - DNA, 25 bp, Homo sapiens
ccccagaaaaggtgttggttgatat

SEQ ID NO: 45602 - DNA, 27 bp, Homo sapiens
ccccagaaaaggtgttggttgatatag

SEQ ID NO: 45603 - DNA, 28 bp, Homo sapiens
ccccagaaaaggtgttggttgatataga

SEQ ID NO: 45604 - DNA, 16 bp, Homo sapiens
cccagaaaaggtgttg

SEQ ID NO: 45605 - DNA, 17 bp, Homo sapiens
cccagaaaaggtgttgg

SEQ ID NO: 45606 - DNA, 26 bp, Homo sapiens
cccagaaaaggtgttggttgatatag

SEQ ID NO: 45607 - DNA, 16 bp, Homo sapiens
ccagaaaaggtgttgg

SEQ ID NO: 45608 - DNA, 19 bp, Homo sapiens
ccagaaaaggtgttggttg

SEQ ID NO: 45609 - DNA, 20 bp, Homo sapiens
ccagaaaaggtgttggttga

SEQ ID NO: 45610 - DNA, 21 bp, Homo sapiens
ccagaaaaggtgttggttgat

SEQ ID NO: 45611 - DNA, 22 bp, Homo sapiens
ccagaaaaggtgttggttgata

SEQ ID NO: 45612 - DNA, 23 bp, Homo sapiens
ccagaaaaggtgttggttgatat

SEQ ID NO: 45613 - DNA, 25 bp, Homo sapiens
ccagaaaaggtgttggttgatatag

SEQ ID NO: 45614 - DNA, 24 bp, Homo sapiens
cagaaaaggtgttggttgatatag

SEQ ID NO: 45615 - DNA, 25 bp, Homo sapiens
cagaaaaggtgttggttgatataga

SEQ ID NO: 45616 - DNA, 24 bp, Homo sapiens
agaaaaggtgttggttgatataga

SEQ ID NO: 45617 - DNA, 22 bp, Homo sapiens
gaaaaggtgttggttgatatag

SEQ ID NO: 45618 - DNA, 23 bp, Homo sapiens
gaaaaggtgttggttgatataga

SEQ ID NO: 45619 - DNA, 19 bp, Homo sapiens
aaaaggtgttggttgatat

SEQ ID NO: 45620 - DNA, 21 bp, Homo sapiens
aaaaggtgttggttgatatag

SEQ ID NO: 45621 - DNA, 22 bp, Homo sapiens
aaaaggtgttggttgatataga

SEQ ID NO: 45622 - DNA, 20 bp, Homo sapiens
aaaggtgttggttgatatag

SEQ ID NO: 45623 - DNA, 21 bp, Homo sapiens
aaaggtgttggttgatataga

SEQ ID NO: 45624 - DNA, 23 bp, Homo sapiens
aaaggtgttggttgatatagaca

SEQ ID NO: 45625 - DNA, 26 bp, Homo sapiens
aaaggtgttggttgatatagacagca

SEQ ID NO: 45626 - DNA, 19 bp, Homo sapiens
aaggtgttggttgatatag

SEQ ID NO: 45627 - DNA, 20 bp, Homo sapiens
aaggtgttggttgatataga

SEQ ID NO: 45628 - DNA, 22 bp, Homo sapiens
aaggtgttggttgatatagaca

SEQ ID NO: 45629 - DNA, 25 bp, Homo sapiens
aaggtgttggttgatatagacagca

SEQ ID NO: 45630 - DNA, 26 bp, Homo sapiens
aaggtgttggttgatatagacagcag

SEQ ID NO: 45631 - DNA, 28 bp, Homo sapiens
aaggtgttggttgatatagacagcagga

SEQ ID NO: 45632 - DNA, 30 bp, Homo sapiens
cgtcctgctgtctatatcaaccaacacctt

SEQ ID NO: 45633 - DNA, 18 bp, Homo sapiens
aggtgttggttgatatag

SEQ ID NO: 45634 - DNA, 19 bp, Homo sapiens
aggtgttggttgatataga

SEQ ID NO: 45635 - DNA, 24 bp, Homo sapiens
aggtgttggttgatatagacagca

SEQ ID NO: 45636 - DNA, 18 bp, Homo sapiens
ggtgttggttgatataga

SEQ ID NO: 45637 - DNA, 23 bp, Homo sapiens
ggtgttggttgatatagacagca

SEQ ID NO: 45638 - DNA, 18 bp, Homo sapiens
ggttgatatagacagcag

SEQ ID NO: 45639 - DNA, 19 bp, Homo sapiens
ggttgatatagacagcagg

SEQ ID NO: 45640 - DNA, 20 bp, Homo sapiens
ggttgatatagacagcagga

SEQ ID NO: 45641 - DNA, 22 bp, Homo sapiens
ggttgatatagacagcaggacg

SEQ ID NO: 45642 - DNA, 24 bp, Homo sapiens
ggttgatatagacagcaggacggt

SEQ ID NO: 45643 - DNA, 20 bp, Homo sapiens
gatatagacagcaggacggt

SEQ ID NO: 45644 - DNA, 21 bp, Homo sapiens
gatatagacagcaggacggtg

SEQ ID NO: 45645 - DNA, 21 bp, Homo sapiens
atatagacagcaggacggtgg

SEQ ID NO: 45646 - DNA, 20 bp, Homo sapiens
tatagacagcaggacggtgg

SEQ ID NO: 45647 - DNA, 19 bp, Homo sapiens
atagacagcaggacggtgg

SEQ ID NO: 45648 - DNA, 22 bp, Homo sapiens
atagacagcaggacggtggcca

SEQ ID NO: 45649 - DNA, 18 bp, Homo sapiens
tagacagcaggacggtgg

SEQ ID NO: 45650 - DNA, 21 bp, Homo sapiens
tagacagcaggacggtggcca

SEQ ID NO: 45651 - DNA, 22 bp, Homo sapiens
tagacagcaggacggtggccat

SEQ ID NO: 45652 - DNA, 21 bp, Homo sapiens
agacagcaggacggtggccat

SEQ ID NO: 45653 - DNA, 19 bp, Homo sapiens
acagcaggacggtggccat

SEQ ID NO: 45654 - DNA, 20 bp, Homo sapiens
acagcaggacggtggccatg

SEQ ID NO: 45655 - DNA, 21 bp, Homo sapiens
acagcaggacggtggccatgg

SEQ ID NO: 45656 - DNA, 29 bp, Homo sapiens
acagcaggacggtggccatggaagtcgga

SEQ ID NO: 45657 - DNA, 27 bp, Homo sapiens
cagcaggacggtggccatggaagtcgg

SEQ ID NO: 45658 - DNA, 28 bp, Homo sapiens
cagcaggacggtggccatggaagtcgga

SEQ ID NO: 45659 - DNA, 23 bp, Homo sapiens
agcaggacggtggccatggaagt

SEQ ID NO: 45660 - DNA, 26 bp, Homo sapiens
agcaggacggtggccatggaagtcgg

SEQ ID NO: 45661 - DNA, 27 bp, Homo sapiens
agcaggacggtggccatggaagtcgga

SEQ ID NO: 45662 - DNA, 28 bp, Homo sapiens
agcaggacggtggccatggaagtcggaa

SEQ ID NO: 45663 - DNA, 24 bp, Homo sapiens
gcaggacggtggccatggaagtcg

SEQ ID NO: 45664 - DNA, 25 bp, Homo sapiens
gcaggacggtggccatggaagtcgg

SEQ ID NO: 45665 - DNA, 26 bp, Homo sapiens
gcaggacggtggccatggaagtcgga

SEQ ID NO: 45666 - DNA, 27 bp, Homo sapiens
gcaggacggtggccatggaagtcggaa

SEQ ID NO: 45667 - DNA, 28 bp, Homo sapiens
gcaggacggtggccatggaagtcggaat

SEQ ID NO: 45668 - DNA, 29 bp, Homo sapiens
gcaggacggtggccatggaagtcggaatc

SEQ ID NO: 45669 - DNA, 30 bp, Homo sapiens; identical to SEQ ID NO: 4661

SEQ ID NO: 45670 - DNA, 23 bp, Homo sapiens
caggacggtggccatggaagtcg

SEQ ID NO: 45671 - DNA, 24 bp, Homo sapiens
caggacggtggccatggaagtcgg

SEQ ID NO: 45672 - DNA, 25 bp, Homo sapiens
caggacggtggccatggaagtcgga

SEQ ID NO: 45673 - DNA, 26 bp, Homo sapiens
caggacggtggccatggaagtcggaa

SEQ ID NO: 45674 - DNA, 27 bp, Homo sapiens
caggacggtggccatggaagtcggaat

SEQ ID NO: 45675 - DNA, 28 bp, Homo sapiens
caggacggtggccatggaagtcggaatc

SEQ ID NO: 45676 - DNA, 29 bp, Homo sapiens
caggacggtggccatggaagtcggaatcc

SEQ ID NO: 45677 - DNA, 30 bp, Homo sapiens; identical to SEQ ID NO: 29844

SEQ ID NO: 45678 - DNA, 22 bp, Homo sapiens
aggacggtggccatggaagtcg

SEQ ID NO: 45679 - DNA, 23 bp, Homo sapiens
aggacggtggccatggaagtcgg

SEQ ID NO: 45680 - DNA, 24 bp, Homo sapiens
aggacggtggccatggaagtcgga

SEQ ID NO: 45681 - DNA, 25 bp, Homo sapiens
aggacggtggccatggaagtcggaa

SEQ ID NO: 45682 - DNA, 26 bp, Homo sapiens
aggacggtggccatggaagtcggaat

SEQ ID NO: 45683 - DNA, 27 bp, Homo sapiens
aggacggtggccatggaagtcggaatc

SEQ ID NO: 45684 - DNA, 28 bp, Homo sapiens
aggacggtggccatggaagtcggaatcc

SEQ ID NO: 45685 - DNA, 29 bp, Homo sapiens
aggacggtggccatggaagtcggaatccg

SEQ ID NO: 45686 - DNA, 30 bp, Homo sapiens; identical to SEQ ID NO: 29847

SEQ ID NO: 45687 - DNA, 21 bp, Homo sapiens
ggacggtggccatggaagtcg

SEQ ID NO: 45688 - DNA, 22 bp, Homo sapiens
ggacggtggccatggaagtcgg

SEQ ID NO: 45689 - DNA, 23 bp, Homo sapiens
ggacggtggccatggaagtcgga

SEQ ID NO: 45690 - DNA, 24 bp, Homo sapiens
ggacggtggccatggaagtcggaa

SEQ ID NO: 45691 - DNA, 25 bp, Homo sapiens
ggacggtggccatggaagtcggaat

SEQ ID NO: 45692 - DNA, 26 bp, Homo sapiens
ggacggtggccatggaagtcggaatc

SEQ ID NO: 45693 - DNA, 27 bp, Homo sapiens
ggacggtggccatggaagtcggaatcc

SEQ ID NO: 45694 - DNA, 28 bp, Homo sapiens
ggacggtggccatggaagtcggaatccg

SEQ ID NO: 45695 - DNA, 29 bp, Homo sapiens
ggacggtggccatggaagtcggaatccgc

SEQ ID NO: 45696 - DNA, 30 bp, Homo sapiens; identical to SEQ ID NO: 29851

SEQ ID NO: 45697 - DNA, 20 bp, Homo sapiens
gacggtggccatggaagtcg

SEQ ID NO: 45698 - DNA, 21 bp, Homo sapiens
gacggtggccatggaagtcgg

SEQ ID NO: 45699 - DNA, 22 bp, Homo sapiens
gacggtggccatggaagtcgga

SEQ ID NO: 45700 - DNA, 23 bp, Homo sapiens
gacggtggccatggaagtcggaa

SEQ ID NO: 45701 - DNA, 24 bp, Homo sapiens
gacggtggccatggaagtcggaat

SEQ ID NO: 45702 - DNA, 25 bp, Homo sapiens
gacggtggccatggaagtcggaatc

SEQ ID NO: 45703 - DNA, 26 bp, Homo sapiens
gacggtggccatggaagtcggaatcc

SEQ ID NO: 45704 - DNA, 27 bp, Homo sapiens
gacggtggccatggaagtcggaatccg

SEQ ID NO: 45705 - DNA, 28 bp, Homo sapiens
gacggtggccatggaagtcggaatccgc

SEQ ID NO: 45706 - DNA, 29 bp, Homo sapiens
gacggtggccatggaagtcggaatccgct

SEQ ID NO: 45707 - DNA, 19 bp, Homo sapiens
acggtggccatggaagtcg

SEQ ID NO: 45708 - DNA, 20 bp, Homo sapiens
acggtggccatggaagtcgg

SEQ ID NO: 45709 - DNA, 21 bp, Homo sapiens
acggtggccatggaagtcgga

SEQ ID NO: 45710 - DNA, 22 bp, Homo sapiens
acggtggccatggaagtcggaa

SEQ ID NO: 45711 - DNA, 23 bp, Homo sapiens
acggtggccatggaagtcggaat

SEQ ID NO: 45712 - DNA, 24 bp, Homo sapiens
acggtggccatggaagtcggaatc

SEQ ID NO: 45713 - DNA, 25 bp, Homo sapiens
acggtggccatggaagtcggaatcc

SEQ ID NO: 45714 - DNA, 26 bp, Homo sapiens
acggtggccatggaagtcggaatccg

SEQ ID NO: 45715 - DNA, 27 bp, Homo sapiens
acggtggccatggaagtcggaatccgc

SEQ ID NO: 45716 - DNA, 28 bp, Homo sapiens
acggtggccatggaagtcggaatccgct

SEQ ID NO: 45717 - DNA, 29 bp, Homo sapiens
acggtggccatggaagtcggaatccgcta

SEQ ID NO: 45718 - DNA, 18 bp, Homo sapiens
cggtggccatggaagtcg

SEQ ID NO: 45719 - DNA, 19 bp, Homo sapiens
cggtggccatggaagtcgg

SEQ ID NO: 45720 - DNA, 20 bp, Homo sapiens
cggtggccatggaagtcgga

SEQ ID NO: 45721 - DNA, 21 bp, Homo sapiens
cggtggccatggaagtcggaa

SEQ ID NO: 45722 - DNA, 22 bp, Homo sapiens
cggtggccatggaagtcggaat

SEQ ID NO: 45723 - DNA, 23 bp, Homo sapiens
cggtggccatggaagtcggaatc

SEQ ID NO: 45724 - DNA, 24 bp, Homo sapiens
cggtggccatggaagtcggaatcc

SEQ ID NO: 45725 - DNA, 25 bp, Homo sapiens
cggtggccatggaagtcggaatccg

SEQ ID NO: 45726 - DNA, 26 bp, Homo sapiens
cggtggccatggaagtcggaatccgc

SEQ ID NO: 45727 - DNA, 27 bp, Homo sapiens
cggtggccatggaagtcggaatccgct

SEQ ID NO: 45728 - DNA, 28 bp, Homo sapiens
cggtggccatggaagtcggaatccgcta

SEQ ID NO: 45729 - DNA, 29 bp, Homo sapiens
cggtggccatggaagtcggaatccgctaa

SEQ ID NO: 45730 - DNA, 30 bp, Homo sapiens
cggtggccatggaagtcggaatccgctaag

SEQ ID NO: 45731 - DNA, 18 bp, Homo sapiens
ggtggccatggaagtcgg

SEQ ID NO: 45732 - DNA, 19 bp, Homo sapiens
ggtggccatggaagtcgga

SEQ ID NO: 45733 - DNA, 20 bp, Homo sapiens
ggtggccatggaagtcggaa

SEQ ID NO: 45734 - DNA, 21 bp, Homo sapiens
ggtggccatggaagtcggaat

SEQ ID NO: 45735 - DNA, 24 bp, Homo sapiens
ggtggccatggaagtcggaatccg

SEQ ID NO: 45736 - DNA, 26 bp, Homo sapiens
ggtggccatggaagtcggaatccgct

SEQ ID NO: 45737 - DNA, 17 bp, Homo sapiens
gtggccatggaagtcgg

SEQ ID NO: 45738 - DNA, 19 bp, Homo sapiens
gtggccatggaagtcggaa

SEQ ID NO: 45739 - DNA, 20 bp, Homo sapiens
gtggccatggaagtcggaat

SEQ ID NO: 45740 - DNA, 22 bp, Homo sapiens
gtggccatggaagtcggaatcc

SEQ ID NO: 45741 - DNA, 25 bp, Homo sapiens
gtggccatggaagtcggaatccgct

SEQ ID NO: 45742 - DNA, 18 bp, Homo sapiens
ggccatggaagtcggaat

SEQ ID NO: 45743 - DNA, 20 bp, Homo sapiens
gccatggaagtcggaatccg

SEQ ID NO: 45744 - DNA, 21 bp, Homo sapiens
gccatggaagtcggaatccgc

SEQ ID NO: 45745 - DNA, 22 bp, Homo sapiens
gccatggaagtcggaatccgct

SEQ ID NO: 45746 - DNA, 25 bp, Homo sapiens
gccatggaagtcggaatccgctaag

SEQ ID NO: 45747 - DNA, 19 bp, Homo sapiens
ccatggaagtcggaatccg

SEQ ID NO: 45748 - DNA, 20 bp, Homo sapiens
ccatggaagtcggaatccgc

SEQ ID NO: 45749 - DNA, 21 bp, Homo sapiens
ccatggaagtcggaatccgct

SEQ ID NO: 45750 - DNA, 22 bp, Homo sapiens
ccatggaagtcggaatccgcta

SEQ ID NO: 45751 - DNA, 23 bp, Homo sapiens
ccatggaagtcggaatccgctaa

SEQ ID NO: 45752 - DNA, 24 bp, Homo sapiens
ccatggaagtcggaatccgctaag

SEQ ID NO: 45753 - DNA, 23 bp, Homo sapiens
catggaagtcggaatccgctaag

SEQ ID NO: 45754 - DNA, 22 bp, Homo sapiens
atggaagtcggaatccgctaag

SEQ ID NO: 45755 - DNA, 21 bp, Homo sapiens
tggaagtcggaatccgctaag

SEQ ID NO: 45756 - DNA, 20 bp, Homo sapiens
ggaagtcggaatccgctaag

SEQ ID NO: 45757 - DNA, 19 bp, Homo sapiens
gaagtcggaatccgctaag

SEQ ID NO: 45758 - DNA, 18 bp, Homo sapiens
aagtcggaatccgctaag

SEQ ID NO: 45759 - DNA, 19 bp, Homo sapiens
aagtcggaatccgctaagg

SEQ ID NO: 45760 - DNA, 20 bp, Homo sapiens
aagtcggaatccgctaagga

SEQ ID NO: 45761 - DNA, 21 bp, Homo sapiens
aagtcggaatccgctaaggag

SEQ ID NO: 45762 - DNA, 22 bp, Homo sapiens
aagtcggaatccgctaaggagt

SEQ ID NO: 45763 - DNA, 23 bp, Homo sapiens
aagtcggaatccgctaaggagtg

SEQ ID NO: 45764 - DNA, 24 bp, Homo sapiens
aagtcggaatccgctaaggagtgt

SEQ ID NO: 45765 - DNA, 25 bp, Homo sapiens
aagtcggaatccgctaaggagtgtg

SEQ ID NO: 45766 - DNA, 26 bp, Homo sapiens
aagtcggaatccgctaaggagtgtgt

SEQ ID NO: 45767 - DNA, 27 bp, Homo sapiens
aagtcggaatccgctaaggagtgtgta

SEQ ID NO: 45768 - DNA, 17 bp, Homo sapiens
agtcggaatccgctaag

SEQ ID NO: 45769 - DNA, 24 bp, Homo sapiens
agtcggaatccgctaaggagtgtg

SEQ ID NO: 45770 - DNA, 26 bp, Homo sapiens
agtcggaatccgctaaggagtgtgta

SEQ ID NO: 45771 - DNA, 16 bp, Homo sapiens
gtcggaatccgctaag

SEQ ID NO: 45772 - DNA, 20 bp, Homo sapiens
gtcggaatccgctaaggagt

SEQ ID NO: 45773 - DNA, 22 bp, Homo sapiens
gtcggaatccgctaaggagtgt

SEQ ID NO: 45774 - DNA, 23 bp, Homo sapiens
gtcggaatccgctaaggagtgtg

SEQ ID NO: 45775 - DNA, 25 bp, Homo sapiens
gtcggaatccgctaaggagtgtgta

SEQ ID NO: 45776 - DNA, 22 bp, Homo sapiens
tcggaatccgctaaggagtgtg

SEQ ID NO: 45777 - DNA, 21 bp, Homo sapiens
cggaatccgctaaggagtgtg

SEQ ID NO: 45778 - DNA, 22 bp, Homo sapiens
cggaatccgctaaggagtgtgt

SEQ ID NO: 45779 - DNA, 21 bp, Homo sapiens
ggaatccgctaaggagtgtgt

SEQ ID NO: 45780 - DNA, 21 bp, Homo sapiens
atccgctaaggagtgtgtaac

SEQ ID NO: 45781 - DNA, 20 bp, Homo sapiens
tccgctaaggagtgtgtaac

SEQ ID NO: 45782 - DNA, 19 bp, Homo sapiens
ccgctaaggagtgtgtaac

SEQ ID NO: 45783 - DNA, 18 bp, Homo sapiens
cgctaaggagtgtgtaac

SEQ ID NO: 45784 - DNA, 22 bp, Homo sapiens
gtgtgtaacaactcacctgccg

SEQ ID NO: 45785 - DNA, 17 bp, Homo sapiens
gtgtaacaactcacctg

SEQ ID NO: 45786 - DNA, 20 bp, Homo sapiens
gtgtaacaactcacctgccg

SEQ ID NO: 45787 - DNA, 16 bp, Homo sapiens
gtaacaactcacctgc

SEQ ID NO: 45788 - DNA, 17 bp, Homo sapiens
gtaacaactcacctgcc

SEQ ID NO: 45789 - DNA, 18 bp, Homo sapiens
gtaacaactcacctgccg

SEQ ID NO: 45790 - DNA, 26 bp, Homo sapiens
gtaacaactcacctgccgaatcaact

SEQ ID NO: 45791 - DNA, 19 bp, Homo sapiens
aacaactcacctgccgaat

SEQ ID NO: 45792 - DNA, 22 bp, Homo sapiens
caactcacctgccgaatcaact

SEQ ID NO: 45793 - DNA, 23 bp, Homo sapiens
caactcacctgccgaatcaacta

SEQ ID NO: 45794 - DNA, 21 bp, Homo sapiens
ctcacctgccgaatcaactag

SEQ ID NO: 45795 - DNA, 21 bp, Homo sapiens
tcacctgccgaatcaactagc

SEQ ID NO: 45796 - DNA, 17 bp, Homo sapiens
cacctgccgaatcaact

SEQ ID NO: 45797 - DNA, 19 bp, Homo sapiens
cacctgccgaatcaactag

SEQ ID NO: 45798 - DNA, 24 bp, Homo sapiens
cacctgccgaatcaactagccctg

SEQ ID NO: 45799 - DNA, 25 bp, Homo sapiens
cacctgccgaatcaactagccctga

SEQ ID NO: 45800 - DNA, 24 bp, Homo sapiens
acctgccgaatcaactagccctga

SEQ ID NO: 45801 - DNA, 28 bp, Homo sapiens
acctgccgaatcaactagccctgaaaat

SEQ ID NO: 45802 - DNA, 23 bp, Homo sapiens
cctgccgaatcaactagccctga

SEQ ID NO: 45803 - DNA, 27 bp, Homo sapiens
cctgccgaatcaactagccctgaaaat

SEQ ID NO: 45804 - DNA, 21 bp, Homo sapiens
ctgccgaatcaactagccctg

SEQ ID NO: 45805 - DNA, 22 bp, Homo sapiens
ctgccgaatcaactagccctga

SEQ ID NO: 45806 - DNA, 19 bp, Homo sapiens
ccgaatcaactagccctga

SEQ ID NO: 45807 - DNA, 20 bp, Homo sapiens
ccgaatcaactagccctgaa

SEQ ID NO: 45808 - DNA, 20 bp, Homo sapiens
ctagccctgaaaatggatgg

SEQ ID NO: 45809 - DNA, 30 bp, Homo sapiens
agccctgaaaatggatggcgctggagcgtc

SEQ ID NO: 45810 - DNA, 18 bp, Homo sapiens
gccctgaaaatggatggc

SEQ ID NO: 45811 - DNA, 30 bp, Homo sapiens
gccctgaaaatggatggcgctggagcgtcg

SEQ ID NO: 45812 - DNA, 16 bp, Homo sapiens
ccctgaaaatggatgg

SEQ ID NO: 45813 - DNA, 17 bp, Homo sapiens
ccctgaaaatggatggc

SEQ ID NO: 45814 - DNA, 18 bp, Homo sapiens
ccctgaaaatggatggcg

SEQ ID NO: 45815 - DNA, 19 bp, Homo sapiens
ccctgaaaatggatggcgc

SEQ ID NO: 45816 - DNA, 20 bp, Homo sapiens
ccctgaaaatggatggcgct

SEQ ID NO: 45817 - DNA, 21 bp, Homo sapiens
ccctgaaaatggatggcgctg

SEQ ID NO: 45818 - DNA, 22 bp, Homo sapiens
ccctgaaaatggatggcgctgg

SEQ ID NO: 45819 - DNA, 23 bp, Homo sapiens
ccctgaaaatggatggcgctgga

SEQ ID NO: 45820 - DNA, 24 bp, Homo sapiens
ccctgaaaatggatggcgctggag

SEQ ID NO: 45821 - DNA, 16 bp, Homo sapiens
cctgaaaatggatggc

SEQ ID NO: 45822 - DNA, 30 bp, Homo sapiens
cctgaaaatggatggcgctggagcgtcggg

SEQ ID NO: 45823 - DNA, 23 bp, Homo sapiens
ctgaaaatggatggcgctggagc

SEQ ID NO: 45824 - DNA, 28 bp, Homo sapiens
ctgaaaatggatggcgctggagcgtcgg

SEQ ID NO: 45825 - DNA, 30 bp, Homo sapiens
ctgaaaatggatggcgctggagcgtcgggc

SEQ ID NO: 45826 - DNA, 27 bp, Homo sapiens
tgaaaatggatggcgctggagcgtcgg

SEQ ID NO: 45827 - DNA, 20 bp, Homo sapiens
gaaaatggatggcgctggag

SEQ ID NO: 45828 - DNA, 24 bp, Homo sapiens
gaaaatggatggcgctggagcgtc

SEQ ID NO: 45829 - DNA, 26 bp, Homo sapiens
gaaaatggatggcgctggagcgtcgg

SEQ ID NO: 45830 - DNA, 19 bp, Homo sapiens
aaaatggatggcgctggag

SEQ ID NO: 45831 - DNA, 25 bp, Homo sapiens
aaaatggatggcgctggagcgtcgg

SEQ ID NO: 45832 - DNA, 29 bp, Homo sapiens
aaaatggatggcgctggagcgtcgggccc

SEQ ID NO: 45833 - DNA, 18 bp, Homo sapiens
aaatggatggcgctggag

SEQ ID NO: 45834 - DNA, 24 bp, Homo sapiens
aaatggatggcgctggagcgtcgg

SEQ ID NO: 45835 - DNA, 25 bp, Homo sapiens
aaatggatggcgctggagcgtcggg

SEQ ID NO: 45836 - DNA, 17 bp, Homo sapiens
aatggatggcgctggag

SEQ ID NO: 45837 - DNA, 23 bp, Homo sapiens
aatggatggcgctggagcgtcgg

SEQ ID NO: 45838 - DNA, 24 bp, Homo sapiens
aatggatggcgctggagcgtcggg

SEQ ID NO: 45839 - DNA, 25 bp, Homo sapiens
aatggatggcgctggagcgtcgggc

SEQ ID NO: 45840 - DNA, 26 bp, Homo sapiens
aatggatggcgctggagcgtcgggcc

SEQ ID NO: 45841 - DNA, 27 bp, Homo sapiens
aatggatggcgctggagcgtcgggccc

SEQ ID NO: 45842 - DNA, 28 bp, Homo sapiens
aatggatggcgctggagcgtcgggccca

SEQ ID NO: 45843 - DNA, 29 bp, Homo sapiens
aatggatggcgctggagcgtcgggcccat

SEQ ID NO: 45844 - DNA, 16 bp, Homo sapiens
atggatggcgctggag

SEQ ID NO: 45845 - DNA, 22 bp, Homo sapiens
atggatggcgctggagcgtcgg

SEQ ID NO: 45846 - DNA, 23 bp, Homo sapiens
atggatggcgctggagcgtcggg

SEQ ID NO: 45847 - DNA, 24 bp, Homo sapiens
atggatggcgctggagcgtcgggc

SEQ ID NO: 45848 - DNA, 25 bp, Homo sapiens
atggatggcgctggagcgtcgggcc

SEQ ID NO: 45849 - DNA, 26 bp, Homo sapiens
atggatggcgctggagcgtcgggccc

SEQ ID NO: 45850 - DNA, 27 bp, Homo sapiens
atggatggcgctggagcgtcgggccca

SEQ ID NO: 45851 - DNA, 28 bp, Homo sapiens
atggatggcgctggagcgtcgggcccat

SEQ ID NO: 45852 - DNA, 29 bp, Homo sapiens
atggatggcgctggagcgtcgggcccata

SEQ ID NO: 45853 - DNA, 21 bp, Homo sapiens
tggatggcgctggagcgtcgg

SEQ ID NO: 45854 - DNA, 22 bp, Homo sapiens
tggatggcgctggagcgtcggg

SEQ ID NO: 45855 - DNA, 23 bp, Homo sapiens
tggatggcgctggagcgtcgggc

SEQ ID NO: 45856 - DNA, 24 bp, Homo sapiens
tggatggcgctggagcgtcgggcc

SEQ ID NO: 45857 - DNA, 25 bp, Homo sapiens
tggatggcgctggagcgtcgggccc

SEQ ID NO: 45858 - DNA, 26 bp, Homo sapiens
tggatggcgctggagcgtcgggccca

SEQ ID NO: 45859 - DNA, 27 bp, Homo sapiens
tggatggcgctggagcgtcgggcccat

SEQ ID NO: 45860 - DNA, 28 bp, Homo sapiens
tggatggcgctggagcgtcgggcccata

SEQ ID NO: 45861 - DNA, 20 bp, Homo sapiens
ggatggcgctggagcgtcgg

SEQ ID NO: 45862 - DNA, 21 bp, Homo sapiens
ggatggcgctggagcgtcggg

SEQ ID NO: 45863 - DNA, 24 bp, Homo sapiens
ggatggcgctggagcgtcgggccc

SEQ ID NO: 45864 - DNA, 25 bp, Homo sapiens
ggatggcgctggagcgtcgggccca

SEQ ID NO: 45865 - DNA, 27 bp, Homo sapiens
ggatggcgctggagcgtcgggcccata

SEQ ID NO: 45866 - DNA, 19 bp, Homo sapiens
gatggcgctggagcgtcgg

SEQ ID NO: 45867 - DNA, 20 bp, Homo sapiens
gatggcgctggagcgtcggg

SEQ ID NO: 45868 - DNA, 21 bp, Homo sapiens
gatggcgctggagcgtcgggc

SEQ ID NO: 45869 - DNA, 22 bp, Homo sapiens
gatggcgctggagcgtcgggcc

SEQ ID NO: 45870 - DNA, 23 bp, Homo sapiens
gatggcgctggagcgtcgggccc

SEQ ID NO: 45871 - DNA, 24 bp, Homo sapiens
gatggcgctggagcgtcgggccca

SEQ ID NO: 45872 - DNA, 25 bp, Homo sapiens
gatggcgctggagcgtcgggcccat

SEQ ID NO: 45873 - DNA, 26 bp, Homo sapiens
gatggcgctggagcgtcgggcccata

SEQ ID NO: 45874 - DNA, 18 bp, Homo sapiens
atggcgctggagcgtcgg

SEQ ID NO: 45875 - DNA, 19 bp, Homo sapiens
atggcgctggagcgtcggg

SEQ ID NO: 45876 - DNA, 20 bp, Homo sapiens
atggcgctggagcgtcgggc

SEQ ID NO: 45877 - DNA, 21 bp, Homo sapiens
atggcgctggagcgtcgggcc

SEQ ID NO: 45878 - DNA, 22 bp, Homo sapiens
atggcgctggagcgtcgggccc

SEQ ID NO: 45879 - DNA, 23 bp, Homo sapiens
atggcgctggagcgtcgggccca

SEQ ID NO: 45880 - DNA, 24 bp, Homo sapiens
atggcgctggagcgtcgggcccat

SEQ ID NO: 45881 - DNA, 25 bp, Homo sapiens
atggcgctggagcgtcgggcccata

SEQ ID NO: 45882 - DNA, 30 bp, Homo sapiens
atggcgctggagcgtcgggcccatacccgg

SEQ ID NO: 45883 - DNA, 17 bp, Homo sapiens
tggcgctggagcgtcgg

SEQ ID NO: 45884 - DNA, 18 bp, Homo sapiens
tggcgctggagcgtcggg

SEQ ID NO: 45885 - DNA, 20 bp, Homo sapiens
tggcgctggagcgtcgggcc

SEQ ID NO: 45886 - DNA, 21 bp, Homo sapiens
tggcgctggagcgtcgggccc

SEQ ID NO: 45887 - DNA, 22 bp, Homo sapiens
tggcgctggagcgtcgggccca

SEQ ID NO: 45888 - DNA, 23 bp, Homo sapiens
tggcgctggagcgtcgggcccat

SEQ ID NO: 45889 - DNA, 24 bp, Homo sapiens
tggcgctggagcgtcgggcccata

SEQ ID NO: 45890 - DNA, 25 bp, Homo sapiens
tggcgctggagcgtcgggcccatac

SEQ ID NO: 45891 - DNA, 30 bp, Homo sapiens
tggcgctggagcgtcgggcccatacccggc

SEQ ID NO: 45892 - DNA, 16 bp, Homo sapiens
ggcgctggagcgtcgg

SEQ ID NO: 45893 - DNA, 17 bp, Homo sapiens
ggcgctggagcgtcggg

SEQ ID NO: 45894 - DNA, 18 bp, Homo sapiens
ggcgctggagcgtcgggc

SEQ ID NO: 45895 - DNA, 19 bp, Homo sapiens
ggcgctggagcgtcgggcc

SEQ ID NO: 45896 - DNA, 20 bp, Homo sapiens
ggcgctggagcgtcgggccc

SEQ ID NO: 45897 - DNA, 21 bp, Homo sapiens
ggcgctggagcgtcgggccca

SEQ ID NO: 45898 - DNA, 22 bp, Homo sapiens
ggcgctggagcgtcgggcccat

SEQ ID NO: 45899 - DNA, 23 bp, Homo sapiens
ggcgctggagcgtcgggcccata

SEQ ID NO: 45900 - DNA, 24 bp, Homo sapiens
ggcgctggagcgtcgggcccatac

SEQ ID NO: 45901 - DNA, 28 bp, Homo sapiens
ggcgctggagcgtcgggcccatacccgg

SEQ ID NO: 45902 - DNA, 29 bp, Homo sapiens
ggcgctggagcgtcgggcccatacccggc

SEQ ID NO: 45903 - DNA, 16 bp, Homo sapiens
gcgctggagcgtcggg

SEQ ID NO: 45904 - DNA, 17 bp, Homo sapiens
gcgctggagcgtcgggc

SEQ ID NO: 45905 - DNA, 18 bp, Homo sapiens
gcgctggagcgtcgggcc

SEQ ID NO: 45906 - DNA, 19 bp, Homo sapiens
gcgctggagcgtcgggccc

SEQ ID NO: 45907 - DNA, 20 bp, Homo sapiens
gcgctggagcgtcgggccca

SEQ ID NO: 45908 - DNA, 21 bp, Homo sapiens
gcgctggagcgtcgggcccat

SEQ ID NO: 45909 - DNA, 22 bp, Homo sapiens
gcgctggagcgtcgggcccata

SEQ ID NO: 45910 - DNA, 23 bp, Homo sapiens
gcgctggagcgtcgggcccatac

SEQ ID NO: 45911 - DNA, 24 bp, Homo sapiens
gcgctggagcgtcgggcccatacc

SEQ ID NO: 45912 - DNA, 16 bp, Homo sapiens
cgctggagcgtcgggc

SEQ ID NO: 45913 - DNA, 17 bp, Homo sapiens
cgctggagcgtcgggcc

SEQ ID NO: 45914 - DNA, 18 bp, Homo sapiens
cgctggagcgtcgggccc

SEQ ID NO: 45915 - DNA, 19 bp, Homo sapiens
cgctggagcgtcgggccca

SEQ ID NO: 45916 - DNA, 20 bp, Homo sapiens
cgctggagcgtcgggcccat

SEQ ID NO: 45917 - DNA, 21 bp, Homo sapiens
cgctggagcgtcgggcccata

SEQ ID NO: 45918 - DNA, 22 bp, Homo sapiens
cgctggagcgtcgggcccatac

SEQ ID NO: 45919 - DNA, 23 bp, Homo sapiens
cgctggagcgtcgggcccatacc

SEQ ID NO: 45920 - DNA, 24 bp, Homo sapiens
cgctggagcgtcgggcccataccc

SEQ ID NO: 45921 - DNA, 27 bp, Homo sapiens
cgctggagcgtcgggcccatacccggc

SEQ ID NO: 45922 - DNA, 16 bp, Homo sapiens
gctggagcgtcgggcc

SEQ ID NO: 45923 - DNA, 17 bp, Homo sapiens
gctggagcgtcgggccc

SEQ ID NO: 45924 - DNA, 18 bp, Homo sapiens
gctggagcgtcgggccca

SEQ ID NO: 45925 - DNA, 19 bp, Homo sapiens
gctggagcgtcgggcccat

SEQ ID NO: 45926 - DNA, 20 bp, Homo sapiens
gctggagcgtcgggcccata

SEQ ID NO: 45927 - DNA, 21 bp, Homo sapiens
gctggagcgtcgggcccatac

SEQ ID NO: 45928 - DNA, 22 bp, Homo sapiens
gctggagcgtcgggcccatacc

SEQ ID NO: 45929 - DNA, 23 bp, Homo sapiens
gctggagcgtcgggcccataccc

SEQ ID NO: 45930 - DNA, 25 bp, Homo sapiens
gctggagcgtcgggcccatacccgg

SEQ ID NO: 45931 - DNA, 26 bp, Homo sapiens
gctggagcgtcgggcccatacccggc

SEQ ID NO: 45932 - DNA, 16 bp, Homo sapiens
ctggagcgtcgggccc

SEQ ID NO: 45933 - DNA, 17 bp, Homo sapiens
ctggagcgtcgggccca

SEQ ID NO: 45934 - DNA, 18 bp, Homo sapiens
ctggagcgtcgggcccat

SEQ ID NO: 45935 - DNA, 19 bp, Homo sapiens
ctggagcgtcgggcccata

SEQ ID NO: 45936 - DNA, 20 bp, Homo sapiens
ctggagcgtcgggcccatac

SEQ ID NO: 45937 - DNA, 21 bp, Homo sapiens
ctggagcgtcgggcccatacc

SEQ ID NO: 45938 - DNA, 22 bp, Homo sapiens
ctggagcgtcgggcccataccc

SEQ ID NO: 45939 - DNA, 23 bp, Homo sapiens
ctggagcgtcgggcccatacccg

SEQ ID NO: 45940 - DNA, 24 bp, Homo sapiens
ctggagcgtcgggcccatacccgg

SEQ ID NO: 45941 - DNA, 25 bp, Homo sapiens
ctggagcgtcgggcccatacccggc

SEQ ID NO: 45942 - DNA, 30 bp, Homo sapiens
ctggagcgtcgggcccatacccggccgtcg

SEQ ID NO: 45943 - DNA, 16 bp, Homo sapiens
tggagcgtcgggccca

SEQ ID NO: 45944 - DNA, 17 bp, Homo sapiens
tggagcgtcgggcccat

SEQ ID NO: 45945 - DNA, 18 bp, Homo sapiens
tggagcgtcgggcccata

SEQ ID NO: 45946 - DNA, 19 bp, Homo sapiens
tggagcgtcgggcccatac

SEQ ID NO: 45947 - DNA, 20 bp, Homo sapiens
tggagcgtcgggcccatacc

SEQ ID NO: 45948 - DNA, 21 bp, Homo sapiens
tggagcgtcgggcccataccc

SEQ ID NO: 45949 - DNA, 23 bp, Homo sapiens
tggagcgtcgggcccatacccgg

SEQ ID NO: 45950 - DNA, 24 bp, Homo sapiens
tggagcgtcgggcccatacccggc

SEQ ID NO: 45951 - DNA, 30 bp, Homo sapiens
tggagcgtcgggcccatacccggccgtcgc

SEQ ID NO: 45952 - DNA, 17 bp, Homo sapiens
ggagcgtcgggcccata

SEQ ID NO: 45953 - DNA, 18 bp, Homo sapiens
ggagcgtcgggcccatac

SEQ ID NO: 45954 - DNA, 19 bp, Homo sapiens
ggagcgtcgggcccatacc

SEQ ID NO: 45955 - DNA, 20 bp, Homo sapiens
ggagcgtcgggcccataccc

SEQ ID NO: 45956 - DNA, 22 bp, Homo sapiens
ggagcgtcgggcccatacccgg

SEQ ID NO: 45957 - DNA, 23 bp, Homo sapiens
ggagcgtcgggcccatacccggc

SEQ ID NO: 45958 - DNA, 30 bp, Homo sapiens
ggagcgtcgggcccatacccggccgtcgcc

SEQ ID NO: 45959 - DNA, 16 bp, Homo sapiens
gagcgtcgggcccata

SEQ ID NO: 45960 - DNA, 18 bp, Homo sapiens
gagcgtcgggcccatacc

SEQ ID NO: 45961 - DNA, 19 bp, Homo sapiens
gagcgtcgggcccataccc

SEQ ID NO: 45962 - DNA, 21 bp, Homo sapiens
gagcgtcgggcccatacccgg

SEQ ID NO: 45963 - DNA, 22 bp, Homo sapiens
gagcgtcgggcccatacccggc

SEQ ID NO: 45964 - DNA, 17 bp, Homo sapiens
agcgtcgggcccatacc

SEQ ID NO: 45965 - DNA, 20 bp, Homo sapiens
agcgtcgggcccatacccgg

SEQ ID NO: 45966 - DNA, 21 bp, Homo sapiens
agcgtcgggcccatacccggc

SEQ ID NO: 45967 - DNA, 28 bp, Homo sapiens
cgtcgggcccatacccggccgtcgccgg

SEQ ID NO: 45968 - DNA, 24 bp, Homo sapiens
cgggcccatacccggccgtcgccg

SEQ ID NO: 45969 - DNA, 25 bp, Homo sapiens
cgggcccatacccggccgtcgccgg

SEQ ID NO: 45970 - DNA, 30 bp, Homo sapiens; identical to SEQ ID NO: 22001

SEQ ID NO: 45971 - DNA, 23 bp, Homo sapiens
ggcccatacccggccgtcgccgg

SEQ ID NO: 45972 - DNA, 17 bp, Homo sapiens
cccatacccggccgtcg

SEQ ID NO: 45973 - DNA, 18 bp, Homo sapiens
cccatacccggccgtcgc

SEQ ID NO: 45974 - DNA, 19 bp, Homo sapiens
cccatacccggccgtcgcc

SEQ ID NO: 45975 - DNA, 20 bp, Homo sapiens
cccatacccggccgtcgccg

SEQ ID NO: 45976 - DNA, 21 bp, Homo sapiens
cccatacccggccgtcgccgg

SEQ ID NO: 45977 - DNA, 29 bp, Homo sapiens
cccatacccggccgtcgccggcagtcgag

SEQ ID NO: 45978 - DNA, 18 bp, Homo sapiens
ccatacccggccgtcgcc

SEQ ID NO: 45979 - DNA, 19 bp, Homo sapiens
ccatacccggccgtcgccg

SEQ ID NO: 45980 - DNA, 21 bp, Homo sapiens
ccatacccggccgtcgccggc

SEQ ID NO: 45981 - DNA, 23 bp, Homo sapiens
ccatacccggccgtcgccggcag

SEQ ID NO: 45982 - DNA, 28 bp, Homo sapiens
ccatacccggccgtcgccggcagtcgag

SEQ ID NO: 45983 - DNA, 29 bp, Homo sapiens
ccatacccggccgtcgccggcagtcgaga

SEQ ID NO: 45984 - DNA, 16 bp, Homo sapiens
catacccggccgtcgc

SEQ ID NO: 45985 - DNA, 17 bp, Homo sapiens
catacccggccgtcgcc

SEQ ID NO: 45986 - DNA, 18 bp, Homo sapiens
catacccggccgtcgccg

SEQ ID NO: 45987 - DNA, 20 bp, Homo sapiens
catacccggccgtcgccggc

SEQ ID NO: 45988 - DNA, 25 bp, Homo sapiens
catacccggccgtcgccggcagtcg

SEQ ID NO: 45989 - DNA, 26 bp, Homo sapiens
catacccggccgtcgccggcagtcga

SEQ ID NO: 45990 - DNA, 27 bp, Homo sapiens
catacccggccgtcgccggcagtcgag

SEQ ID NO: 45991 - DNA, 28 bp, Homo sapiens
catacccggccgtcgccggcagtcgaga

SEQ ID NO: 45992 - DNA, 29 bp, Homo sapiens
catacccggccgtcgccggcagtcgagag

SEQ ID NO: 45993 - DNA, 16 bp, Homo sapiens
atacccggccgtcgcc

SEQ ID NO: 45994 - DNA, 19 bp, Homo sapiens
atacccggccgtcgccggc

SEQ ID NO: 45995 - DNA, 24 bp, Homo sapiens
atacccggccgtcgccggcagtcg

SEQ ID NO: 45996 - DNA, 25 bp, Homo sapiens
atacccggccgtcgccggcagtcga

SEQ ID NO: 45997 - DNA, 26 bp, Homo sapiens
atacccggccgtcgccggcagtcgag

SEQ ID NO: 45998 - DNA, 27 bp, Homo sapiens
atacccggccgtcgccggcagtcgaga

SEQ ID NO: 45999 - DNA, 23 bp, Homo sapiens
tacccggccgtcgccggcagtcg

SEQ ID NO: 46000 - DNA, 24 bp, Homo sapiens
tacccggccgtcgccggcagtcga

SEQ ID NO: 46001 - DNA, 25 bp, Homo sapiens
tacccggccgtcgccggcagtcgag

SEQ ID NO: 46002 - DNA, 26 bp, Homo sapiens
tacccggccgtcgccggcagtcgaga

SEQ ID NO: 46003 - DNA, 22 bp, Homo sapiens
cccggccgtcgccggcagtcga

SEQ ID NO: 46004 - DNA, 23 bp, Homo sapiens
cccggccgtcgccggcagtcgag

SEQ ID NO: 46005 - DNA, 24 bp, Homo sapiens
cccggccgtcgccggcagtcgaga

SEQ ID NO: 46006 - DNA, 19 bp, Homo sapiens
cggccgtcgccggcagtcg

SEQ ID NO: 46007 - DNA, 20 bp, Homo sapiens
cggccgtcgccggcagtcga

SEQ ID NO: 46008 - DNA, 21 bp, Homo sapiens
cggccgtcgccggcagtcgag

SEQ ID NO: 46009 - DNA, 22 bp, Homo sapiens
cggccgtcgccggcagtcgaga

SEQ ID NO: 46010 - DNA, 22 bp, Homo sapiens
ggccgtcgccggcagtcgagag

SEQ ID NO: 46011 - DNA, 23 bp, Homo sapiens
ggccgtcgccggcagtcgagagt

SEQ ID NO: 46012 - DNA, 24 bp, Homo sapiens
ggccgtcgccggcagtcgagagtg

SEQ ID NO: 46013 - DNA, 19 bp, Homo sapiens
gccgtcgccggcagtcgag

SEQ ID NO: 46014 - DNA, 20 bp, Homo sapiens
gccgtcgccggcagtcgaga

SEQ ID NO: 46015 - DNA, 16 bp, Homo sapiens
ccgtcgccggcagtcg

SEQ ID NO: 46016 - DNA, 17 bp, Homo sapiens
ccgtcgccggcagtcga

SEQ ID NO: 46017 - DNA, 18 bp, Homo sapiens
ccgtcgccggcagtcgag

SEQ ID NO: 46018 - DNA, 19 bp, Homo sapiens
ccgtcgccggcagtcgaga

SEQ ID NO: 46019 - DNA, 20 bp, Homo sapiens
ccgtcgccggcagtcgagag

SEQ ID NO: 46020 - DNA, 21 bp, Homo sapiens
ccgtcgccggcagtcgagagt

SEQ ID NO: 46021 - DNA, 23 bp, Homo sapiens
ccgtcgccggcagtcgagagtgg

SEQ ID NO: 46022 - DNA, 24 bp, Homo sapiens
ccgtcgccggcagtcgagagtgga

SEQ ID NO: 46023 - DNA, 27 bp, Homo sapiens
ccgtcgccggcagtcgagagtggacgg

SEQ ID NO: 46024 - DNA, 28 bp, Homo sapiens
ccgtcgccggcagtcgagagtggacggg

SEQ ID NO: 46025 - DNA, 16 bp, Homo sapiens
cgtcgccggcagtcga

SEQ ID NO: 46026 - DNA, 17 bp, Homo sapiens
cgtcgccggcagtcgag

SEQ ID NO: 46027 - DNA, 18 bp, Homo sapiens
cgtcgccggcagtcgaga

SEQ ID NO: 46028 - DNA, 19 bp, Homo sapiens
cgtcgccggcagtcgagag

SEQ ID NO: 46029 - DNA, 23 bp, Homo sapiens
cgtcgccggcagtcgagagtgga

SEQ ID NO: 46030 - DNA, 26 bp, Homo sapiens
cgtcgccggcagtcgagagtggacgg

SEQ ID NO: 46031 - DNA, 27 bp, Homo sapiens
cgtcgccggcagtcgagagtggacggg

SEQ ID NO: 46032 - DNA, 16 bp, Homo sapiens
gtcgccggcagtcgag

SEQ ID NO: 46033 - DNA, 17 bp, Homo sapiens
gtcgccggcagtcgaga

SEQ ID NO: 46034 - DNA, 18 bp, Homo sapiens
gtcgccggcagtcgagag

SEQ ID NO: 46035 - DNA, 19 bp, Homo sapiens
gtcgccggcagtcgagagt

SEQ ID NO: 46036 - DNA, 20 bp, Homo sapiens
gtcgccggcagtcgagagtg

SEQ ID NO: 46037 - DNA, 21 bp, Homo sapiens
gtcgccggcagtcgagagtgg

SEQ ID NO: 46038 - DNA, 22 bp, Homo sapiens
gtcgccggcagtcgagagtgga

SEQ ID NO: 46039 - DNA, 24 bp, Homo sapiens
gtcgccggcagtcgagagtggacg

SEQ ID NO: 46040 - DNA, 25 bp, Homo sapiens
gtcgccggcagtcgagagtggacgg

SEQ ID NO: 46041 - DNA, 26 bp, Homo sapiens
gtcgccggcagtcgagagtggacggg

SEQ ID NO: 46042 - DNA, 20 bp, Homo sapiens
tcgccggcagtcgagagtgg

SEQ ID NO: 46043 - DNA, 21 bp, Homo sapiens
tcgccggcagtcgagagtgga

SEQ ID NO: 46044 - DNA, 20 bp, Homo sapiens
cgccggcagtcgagagtgga

SEQ ID NO: 46045 - DNA, 18 bp, Homo sapiens
ggcagtcgagagtggacg

SEQ ID NO: 46046 - DNA, 22 bp, Homo sapiens
ggcagtcgagagtggacgggag

SEQ ID NO: 46047 - DNA, 23 bp, Homo sapiens
ggcagtcgagagtggacgggagc

SEQ ID NO: 46048 - DNA, 25 bp, Homo sapiens
ggcagtcgagagtggacgggagcgg

SEQ ID NO: 46049 - DNA, 26 bp, Homo sapiens
ggcagtcgagagtggacgggagcggc

SEQ ID NO: 46050 - DNA, 27 bp, Homo sapiens
ggcagtcgagagtggacgggagcggcg

SEQ ID NO: 46051 - DNA, 17 bp, Homo sapiens
gcagtcgagagtggacg

SEQ ID NO: 46052 - DNA, 21 bp, Homo sapiens
gcagtcgagagtggacgggag

SEQ ID NO: 46053 - DNA, 22 bp, Homo sapiens
gcagtcgagagtggacgggagc

SEQ ID NO: 46054 - DNA, 25 bp, Homo sapiens
gcagtcgagagtggacgggagcggc

SEQ ID NO: 46055 - DNA, 26 bp, Homo sapiens
gcagtcgagagtggacgggagcggcg

SEQ ID NO: 46056 - DNA, 27 bp, Homo sapiens
gcagtcgagagtggacgggagcggcgg

SEQ ID NO: 46057 - DNA, 20 bp, Homo sapiens
cagtcgagagtggacgggag

SEQ ID NO: 46058 - DNA, 22 bp, Homo sapiens
agtcgagagtggacgggagcgg

SEQ ID NO: 46059 - DNA, 23 bp, Homo sapiens
agtcgagagtggacgggagcggc

SEQ ID NO: 46060 - DNA, 21 bp, Homo sapiens
gtcgagagtggacgggagcgg

SEQ ID NO: 46061 - DNA, 22 bp, Homo sapiens
gtcgagagtggacgggagcggc

SEQ ID NO: 46062 - DNA, 23 bp, Homo sapiens
gtcgagagtggacgggagcggcg

SEQ ID NO: 46063 - DNA, 17 bp, Homo sapiens
tcgagagtggacgggag

SEQ ID NO: 46064 - DNA, 22 bp, Homo sapiens
tcgagagtggacgggagcggcg

SEQ ID NO: 46065 - DNA, 19 bp, Homo sapiens
cgagagtggacgggagcgg

SEQ ID NO: 46066 - DNA, 20 bp, Homo sapiens
cgagagtggacgggagcggc

SEQ ID NO: 46067 - DNA, 16 bp, Homo sapiens
gagagtggacgggagc

SEQ ID NO: 46068 - DNA, 18 bp, Homo sapiens
gagagtggacgggagcgg

SEQ ID NO: 46069 - DNA, 19 bp, Homo sapiens
gagagtggacgggagcggc

SEQ ID NO: 46070 - DNA, 20 bp, Homo sapiens
gagagtggacgggagcggcg

SEQ ID NO: 46071 - DNA, 21 bp, Homo sapiens
gagagtggacgggagcggcgg

SEQ ID NO: 46072 - DNA, 20 bp, Homo sapiens
agagtggacgggagcggcgg

SEQ ID NO: 46073 - DNA, 25 bp, Homo sapiens
agtggacgggagcggcgggggcggc

SEQ ID NO: 46074 - DNA, 21 bp, Homo sapiens
ggacgggagcggcgggggcgg

SEQ ID NO: 46075 - DNA, 30 bp, Homo sapiens
ggacgggagcggcgggggcggcgcgcgcgc

SEQ ID NO: 46076 - DNA, 17 bp, Homo sapiens
gggagcggcgggggcgg

SEQ ID NO: 46077 - DNA, 18 bp, Homo sapiens
gggagcggcgggggcggc

SEQ ID NO: 46078 - DNA, 21 bp, Homo sapiens
gggagcggcgggggcggcgcg

SEQ ID NO: 46079 - DNA, 19 bp, Homo sapiens
ggcgggggcggcgcgcgcg

SEQ ID NO: 46080 - DNA, 20 bp, Homo sapiens
ggcgggggcggcgcgcgcgc

SEQ ID NO: 46081 - DNA, 21 bp, Homo sapiens
ggcgggggcggcgcgcgcgcg

SEQ ID NO: 46082 - DNA, 22 bp, Homo sapiens
ggcgggggcggcgcgcgcgcgc

SEQ ID NO: 46083 - DNA, 23 bp, Homo sapiens
ggcgggggcggcgcgcgcgcgcg

SEQ ID NO: 46084 - DNA, 19 bp, Homo sapiens
gcgggggcggcgcgcgcgc

SEQ ID NO: 46085 - DNA, 18 bp, Homo sapiens
cgggggcggcgcgcgcgc

SEQ ID NO: 46086 - DNA, 19 bp, Homo sapiens
cgggggcggcgcgcgcgcg

SEQ ID NO: 46087 - DNA, 20 bp, Homo sapiens
cgggggcggcgcgcgcgcgc

SEQ ID NO: 46088 - DNA, 21 bp, Homo sapiens
cgggggcggcgcgcgcgcgcg

SEQ ID NO: 46089 - DNA, 22 bp, Homo sapiens
cgggggcggcgcgcgcgcgcgc

SEQ ID NO: 46090 - DNA, 17 bp, Homo sapiens
gggggcggcgcgcgcgc

SEQ ID NO: 46091 - DNA, 18 bp, Homo sapiens
gggggcggcgcgcgcgcg

SEQ ID NO: 46092 - DNA, 19 bp, Homo sapiens
gggggcggcgcgcgcgcgc

SEQ ID NO: 46093 - DNA, 20 bp, Homo sapiens
gggggcggcgcgcgcgcgcg

SEQ ID NO: 46094 - DNA, 21 bp, Homo sapiens
gggggcggcgcgcgcgcgcgc

SEQ ID NO: 46095 - DNA, 22 bp, Homo sapiens
gggggcggcgcgcgcgcgcgcg

SEQ ID NO: 46096 - DNA, 23 bp, Homo sapiens
gggggcggcgcgcgcgcgcgcgc

SEQ ID NO: 46097 - DNA, 24 bp, Homo sapiens
gggggcggcgcgcgcgcgcgcgcg

SEQ ID NO: 46098 - DNA, 17 bp, Homo sapiens
ggggcggcgcgcgcgcg

SEQ ID NO: 46099 - DNA, 18 bp, Homo sapiens
ggggcggcgcgcgcgcgc

SEQ ID NO: 46100 - DNA, 19 bp, Homo sapiens
ggggcggcgcgcgcgcgcg

SEQ ID NO: 46101 - DNA, 20 bp, Homo sapiens
ggggcggcgcgcgcgcgcgc

SEQ ID NO: 46102 - DNA, 21 bp, Homo sapiens
ggggcggcgcgcgcgcgcgcg

SEQ ID NO: 46103 - DNA, 22 bp, Homo sapiens
ggggcggcgcgcgcgcgcgcgc

SEQ ID NO: 46104 - DNA, 23 bp, Homo sapiens
ggggcggcgcgcgcgcgcgcgcg

SEQ ID NO: 46105 - DNA, 18 bp, Homo sapiens
ggcggcgcgcgcgcgcgc

SEQ ID NO: 46106 - DNA, 19 bp, Homo sapiens
ggcggcgcgcgcgcgcgcg

SEQ ID NO: 46107 - DNA, 20 bp, Homo sapiens
ggcggcgcgcgcgcgcgcgc

SEQ ID NO: 46108 - DNA, 21 bp, Homo sapiens
ggcggcgcgcgcgcgcgcgcg

SEQ ID NO: 46109 - DNA, 20 bp, Homo sapiens
gcggcgcgcgcgcgcgcgcg

SEQ ID NO: 46110 - DNA, 30 bp, Homo sapiens
gcgcgcgcgcgcgcgcgtgtggtgtgcgtc

SEQ ID NO: 46111 - DNA, 30 bp, Homo sapiens
cgcgcgcgcgcgcgcgtgtggtgtgcgtcg

SEQ ID NO: 46112 - DNA, 30 bp, Homo sapiens
gcgcgcgcgcgcgcgtgtggtgtgcgtcgg

SEQ ID NO: 46113 - DNA, 29 bp, Homo sapiens
cgcgcgcgcgcgcgtgtggtgtgcgtcgg

SEQ ID NO: 46114 - DNA, 28 bp, Homo sapiens
gcgcgcgcgcgcgtgtggtgtgcgtcgg

SEQ ID NO: 46115 - DNA, 30 bp, Homo sapiens
gcgcgcgcgcgcgtgtggtgtgcgtcggag

SEQ ID NO: 46116 - DNA, 27 bp, Homo sapiens
cgcgcgcgcgcgtgtggtgtgcgtcgg

SEQ ID NO: 46117 - DNA, 28 bp, Homo sapiens
cgcgcgcgcgcgtgtggtgtgcgtcgga

SEQ ID NO: 46118 - DNA, 29 bp, Homo sapiens
cgcgcgcgcgcgtgtggtgtgcgtcggag

SEQ ID NO: 46119 - DNA, 30 bp, Homo sapiens
cgcgcgcgcgcgtgtggtgtgcgtcggagg

SEQ ID NO: 46120 - DNA, 20 bp, Homo sapiens
gcgcgcgcgcgtgtggtgtg

SEQ ID NO: 46121 - DNA, 21 bp, Homo sapiens
cgcgcgtgtggtgtgcgtcgg

SEQ ID NO: 46122 - DNA, 18 bp, Homo sapiens
gcgcgtgtggtgtgcgtc

SEQ ID NO: 46123 - DNA, 20 bp, Homo sapiens
gcgcgtgtggtgtgcgtcgg

SEQ ID NO: 46124 - DNA, 19 bp, Homo sapiens
cgcgtgtggtgtgcgtcgg

SEQ ID NO: 46125 - DNA, 20 bp, Homo sapiens
cgcgtgtggtgtgcgtcgga

SEQ ID NO: 46126 - DNA, 21 bp, Homo sapiens
cgcgtgtggtgtgcgtcggag

SEQ ID NO: 46127 - DNA, 22 bp, Homo sapiens
cgcgtgtggtgtgcgtcggagg

SEQ ID NO: 46128 - DNA, 23 bp, Homo sapiens
cgcgtgtggtgtgcgtcggaggg

SEQ ID NO: 46129 - DNA, 18 bp, Homo sapiens
gcgtgtggtgtgcgtcgg

SEQ ID NO: 46130 - DNA, 19 bp, Homo sapiens
gcgtgtggtgtgcgtcgga

SEQ ID NO: 46131 - DNA, 20 bp, Homo sapiens
gcgtgtggtgtgcgtcggag

SEQ ID NO: 46132 - DNA, 21 bp, Homo sapiens
gcgtgtggtgtgcgtcggagg

SEQ ID NO: 46133 - DNA, 22 bp, Homo sapiens
gcgtgtggtgtgcgtcggaggg

SEQ ID NO: 46134 - DNA, 16 bp, Homo sapiens
cgtgtggtgtgcgtcg

SEQ ID NO: 46135 - DNA, 17 bp, Homo sapiens
cgtgtggtgtgcgtcgg

SEQ ID NO: 46136 - DNA, 18 bp, Homo sapiens
cgtgtggtgtgcgtcgga

SEQ ID NO: 46137 - DNA, 19 bp, Homo sapiens
cgtgtggtgtgcgtcggag

SEQ ID NO: 46138 - DNA, 20 bp, Homo sapiens
cgtgtggtgtgcgtcggagg

SEQ ID NO: 46139 - DNA, 21 bp, Homo sapiens
cgtgtggtgtgcgtcggaggg

SEQ ID NO: 46140 - DNA, 22 bp, Homo sapiens
cgtgtggtgtgcgtcggagggc

SEQ ID NO: 46141 - DNA, 23 bp, Homo sapiens
cgtgtggtgtgcgtcggagggcg

SEQ ID NO: 46142 - DNA, 24 bp, Homo sapiens
cgtgtggtgtgcgtcggagggcgg

SEQ ID NO: 46143 - DNA, 25 bp, Homo sapiens
cgtgtggtgtgcgtcggagggcggc

SEQ ID NO: 46144 - DNA, 26 bp, Homo sapiens
cgtgtggtgtgcgtcggagggcggcg

SEQ ID NO: 46145 - DNA, 28 bp, Homo sapiens
cgtgtggtgtgcgtcggagggcggcggc

SEQ ID NO: 46146 - DNA, 30 bp, Homo sapiens
cgtgtggtgtgcgtcggagggcggcggcgg

SEQ ID NO: 46147 - DNA, 16 bp, Homo sapiens
gtgtggtgtgcgtcgg

SEQ ID NO: 46148 - DNA, 17 bp, Homo sapiens
gtgtggtgtgcgtcgga

SEQ ID NO: 46149 - DNA, 18 bp, Homo sapiens
gtgtggtgtgcgtcggag

SEQ ID NO: 46150 - DNA, 19 bp, Homo sapiens
gtgtggtgtgcgtcggagg

SEQ ID NO: 46151 - DNA, 20 bp, Homo sapiens
gtgtggtgtgcgtcggaggg

SEQ ID NO: 46152 - DNA, 21 bp, Homo sapiens
gtgtggtgtgcgtcggagggc

SEQ ID NO: 46153 - DNA, 22 bp, Homo sapiens
gtgtggtgtgcgtcggagggcg

SEQ ID NO: 46154 - DNA, 23 bp, Homo sapiens
gtgtggtgtgcgtcggagggcgg

SEQ ID NO: 46155 - DNA, 24 bp, Homo sapiens
gtgtggtgtgcgtcggagggcggc

SEQ ID NO: 46156 - DNA, 25 bp, Homo sapiens
gtgtggtgtgcgtcggagggcggcg

SEQ ID NO: 46157 - DNA, 27 bp, Homo sapiens
gtgtggtgtgcgtcggagggcggcggc

SEQ ID NO: 46158 - DNA, 16 bp, Homo sapiens
tgtggtgtgcgtcgga

SEQ ID NO: 46159 - DNA, 17 bp, Homo sapiens
tgtggtgtgcgtcggag

SEQ ID NO: 46160 - DNA, 18 bp, Homo sapiens
tgtggtgtgcgtcggagg

SEQ ID NO: 46161 - DNA, 19 bp, Homo sapiens
tgtggtgtgcgtcggaggg

SEQ ID NO: 46162 - DNA, 20 bp, Homo sapiens
tgtggtgtgcgtcggagggc

SEQ ID NO: 46163 - DNA, 21 bp, Homo sapiens
tgtggtgtgcgtcggagggcg

SEQ ID NO: 46164 - DNA, 22 bp, Homo sapiens
tgtggtgtgcgtcggagggcgg

SEQ ID NO: 46165 - DNA, 23 bp, Homo sapiens
tgtggtgtgcgtcggagggcggc

SEQ ID NO: 46166 - DNA, 24 bp, Homo sapiens
tgtggtgtgcgtcggagggcggcg

SEQ ID NO: 46167 - DNA, 26 bp, Homo sapiens
tgtggtgtgcgtcggagggcggcggc

SEQ ID NO: 46168 - DNA, 30 bp, Homo sapiens
tgtggtgtgcgtcggagggcggcggcggcg

SEQ ID NO: 46169 - DNA, 16 bp, Homo sapiens
gtggtgtgcgtcggag

SEQ ID NO: 46170 - DNA, 17 bp, Homo sapiens
gtggtgtgcgtcggagg

SEQ ID NO: 46171 - DNA, 18 bp, Homo sapiens
gtggtgtgcgtcggaggg

SEQ ID NO: 46172 - DNA, 19 bp, Homo sapiens
gtggtgtgcgtcggagggc

SEQ ID NO: 46173 - DNA, 20 bp, Homo sapiens
gtggtgtgcgtcggagggcg

SEQ ID NO: 46174 - DNA, 21 bp, Homo sapiens
gtggtgtgcgtcggagggcgg

SEQ ID NO: 46175 - DNA, 22 bp, Homo sapiens
gtggtgtgcgtcggagggcggc

SEQ ID NO: 46176 - DNA, 25 bp, Homo sapiens
gtggtgtgcgtcggagggcggcggc

SEQ ID NO: 46177 - DNA, 16 bp, Homo sapiens
tggtgtgcgtcggagg

SEQ ID NO: 46178 - DNA, 17 bp, Homo sapiens
tggtgtgcgtcggaggg

SEQ ID NO: 46179 - DNA, 18 bp, Homo sapiens
tggtgtgcgtcggagggc

SEQ ID NO: 46180 - DNA, 19 bp, Homo sapiens
tggtgtgcgtcggagggcg

SEQ ID NO: 46181 - DNA, 20 bp, Homo sapiens
tggtgtgcgtcggagggcgg

SEQ ID NO: 46182 - DNA, 21 bp, Homo sapiens
tggtgtgcgtcggagggcggc

SEQ ID NO: 46183 - DNA, 22 bp, Homo sapiens
tggtgtgcgtcggagggcggcg

SEQ ID NO: 46184 - DNA, 24 bp, Homo sapiens
tggtgtgcgtcggagggcggcggc

SEQ ID NO: 46185 - DNA, 27 bp, Homo sapiens
tggtgtgcgtcggagggcggcggcggc

SEQ ID NO: 46186 - DNA, 30 bp, Homo sapiens
tggtgtgcgtcggagggcggcggcggcggc

SEQ ID NO: 46187 - DNA, 16 bp, Homo sapiens
ggtgtgcgtcggaggg

SEQ ID NO: 46188 - DNA, 17 bp, Homo sapiens
ggtgtgcgtcggagggc

SEQ ID NO: 46189 - DNA, 18 bp, Homo sapiens
ggtgtgcgtcggagggcg

SEQ ID NO: 46190 - DNA, 19 bp, Homo sapiens
ggtgtgcgtcggagggcgg

SEQ ID NO: 46191 - DNA, 20 bp, Homo sapiens
ggtgtgcgtcggagggcggc

SEQ ID NO: 46192 - DNA, 21 bp, Homo sapiens
ggtgtgcgtcggagggcggcg

SEQ ID NO: 46193 - DNA, 22 bp, Homo sapiens
ggtgtgcgtcggagggcggcgg

SEQ ID NO: 46194 - DNA, 23 bp, Homo sapiens
ggtgtgcgtcggagggcggcggc

SEQ ID NO: 46195 - DNA, 24 bp, Homo sapiens
ggtgtgcgtcggagggcggcggcg

SEQ ID NO: 46196 - DNA, 25 bp, Homo sapiens
ggtgtgcgtcggagggcggcggcgg

SEQ ID NO: 46197 - DNA, 26 bp, Homo sapiens
ggtgtgcgtcggagggcggcggcggc

SEQ ID NO: 46198 - DNA, 30 bp, Homo sapiens
ggtgtgcgtcggagggcggcggcggcggcg

SEQ ID NO: 46199 - DNA, 16 bp, Homo sapiens
gtgtgcgtcggagggc

SEQ ID NO: 46200 - DNA, 17 bp, Homo sapiens
gtgtgcgtcggagggcg

SEQ ID NO: 46201 - DNA, 18 bp, Homo sapiens
gtgtgcgtcggagggcgg

SEQ ID NO: 46202 - DNA, 19 bp, Homo sapiens
gtgtgcgtcggagggcggc

SEQ ID NO: 46203 - DNA, 20 bp, Homo sapiens
gtgtgcgtcggagggcggcg

SEQ ID NO: 46204 - DNA, 22 bp, Homo sapiens
gtgtgcgtcggagggcggcggc

SEQ ID NO: 46205 - DNA, 25 bp, Homo sapiens
gtgtgcgtcggagggcggcggcggc

SEQ ID NO: 46206 - DNA, 26 bp, Homo sapiens
gtgtgcgtcggagggcggcggcggcg

SEQ ID NO: 46207 - DNA, 28 bp, Homo sapiens
gtgtgcgtcggagggcggcggcggcggc

SEQ ID NO: 46208 - DNA, 29 bp, Homo sapiens
gtgtgcgtcggagggcggcggcggcggcg

SEQ ID NO: 46209 - DNA, 30 bp, Homo sapiens
gtgtgcgtcggagggcggcggcggcggcgg

SEQ ID NO: 46210 - DNA, 16 bp, Homo sapiens
tgtgcgtcggagggcg

SEQ ID NO: 46211 - DNA, 17 bp, Homo sapiens
tgtgcgtcggagggcgg

SEQ ID NO: 46212 - DNA, 19 bp, Homo sapiens
tgtgcgtcggagggcggcg

SEQ ID NO: 46213 - DNA, 20 bp, Homo sapiens
tgtgcgtcggagggcggcgg

SEQ ID NO: 46214 - DNA, 21 bp, Homo sapiens
tgtgcgtcggagggcggcggc

SEQ ID NO: 46215 - DNA, 22 bp, Homo sapiens
tgtgcgtcggagggcggcggcg

SEQ ID NO: 46216 - DNA, 24 bp, Homo sapiens
tgtgcgtcggagggcggcggcggc

SEQ ID NO: 46217 - DNA, 25 bp, Homo sapiens
tgtgcgtcggagggcggcggcggcg

SEQ ID NO: 46218 - DNA, 26 bp, Homo sapiens
tgtgcgtcggagggcggcggcggcgg

SEQ ID NO: 46219 - DNA, 27 bp, Homo sapiens
tgtgcgtcggagggcggcggcggcggc

SEQ ID NO: 46220 - DNA, 28 bp, Homo sapiens
tgtgcgtcggagggcggcggcggcggcg

SEQ ID NO: 46221 - DNA, 29 bp, Homo sapiens
tgtgcgtcggagggcggcggcggcggcgg

SEQ ID NO: 46222 - DNA, 30 bp, Homo sapiens
tgtgcgtcggagggcggcggcggcggcggc

SEQ ID NO: 46223 - DNA, 20 bp, Homo sapiens
gtgcgtcggagggcggcggc

SEQ ID NO: 46224 - DNA, 23 bp, Homo sapiens
gtgcgtcggagggcggcggcggc

SEQ ID NO: 46225 - DNA, 26 bp, Homo sapiens
gtgcgtcggagggcggcggcggcggc

SEQ ID NO: 46226 - DNA, 30 bp, Homo sapiens
gtgcgtcggagggcggcggcggcggcggcg

SEQ ID NO: 46227 - DNA, 19 bp, Homo sapiens
tgcgtcggagggcggcggc

SEQ ID NO: 46228 - DNA, 22 bp, Homo sapiens
tgcgtcggagggcggcggcggc

SEQ ID NO: 46229 - DNA, 25 bp, Homo sapiens
tgcgtcggagggcggcggcggcggc

SEQ ID NO: 46230 - DNA, 26 bp, Homo sapiens
tgcgtcggagggcggcggcggcggcg

SEQ ID NO: 46231 - DNA, 30 bp, Homo sapiens
tgcgtcggagggcggcggcggcggcggcgg

SEQ ID NO: 46232 - DNA, 19 bp, Homo sapiens
gtcggagggcggcggcggc

SEQ ID NO: 46233 - DNA, 16 bp, Homo sapiens
cggagggcggcggcgg

SEQ ID NO: 46234 - DNA, 17 bp, Homo sapiens
cggagggcggcggcggc

SEQ ID NO: 46235 - DNA, 19 bp, Homo sapiens
cggagggcggcggcggcgg

SEQ ID NO: 46236 - DNA, 20 bp, Homo sapiens
cggagggcggcggcggcggc

SEQ ID NO: 46237 - DNA, 23 bp, Homo sapiens
cggagggcggcggcggcggcggc

SEQ ID NO: 46238 - DNA, 30 bp, Homo sapiens
cggagggcggcggcggcggcggcggcgggg

SEQ ID NO: 46239 - DNA, 19 bp, Homo sapiens
ggagggcggcggcggcggc

SEQ ID NO: 46240 - DNA, 22 bp, Homo sapiens
ggagggcggcggcggcggcggc

SEQ ID NO: 46241 - DNA, 23 bp, Homo sapiens
ggagggcggcggcggcggcggcg

SEQ ID NO: 46242 - DNA, 26 bp, Homo sapiens
ggagggcggcggcggcggcggcggcg

SEQ ID NO: 46243 - DNA, 17 bp, Homo sapiens
gagggcggcggcggcgg

SEQ ID NO: 46244 - DNA, 18 bp, Homo sapiens
gagggcggcggcggcggc

SEQ ID NO: 46245 - DNA, 20 bp, Homo sapiens
gagggcggcggcggcggcgg

SEQ ID NO: 46246 - DNA, 21 bp, Homo sapiens
gagggcggcggcggcggcggc

SEQ ID NO: 46247 - DNA, 22 bp, Homo sapiens
gagggcggcggcggcggcggcg

SEQ ID NO: 46248 - DNA, 23 bp, Homo sapiens
gagggcggcggcggcggcggcgg

SEQ ID NO: 46249 - DNA, 24 bp, Homo sapiens
gagggcggcggcggcggcggcggc

SEQ ID NO: 46250 - DNA, 25 bp, Homo sapiens
gagggcggcggcggcggcggcggcg

SEQ ID NO: 46251 - DNA, 26 bp, Homo sapiens
gagggcggcggcggcggcggcggcgg

SEQ ID NO: 46252 - DNA, 27 bp, Homo sapiens
gagggcggcggcggcggcggcggcggg

SEQ ID NO: 46253 - DNA, 30 bp, Homo sapiens
gagggcggcggcggcggcggcggcgggggt

SEQ ID NO: 46254 - DNA, 20 bp, Homo sapiens
agggcggcggcggcggcggc

SEQ ID NO: 46255 - DNA, 21 bp, Homo sapiens
agggcggcggcggcggcggcg

SEQ ID NO: 46256 - DNA, 22 bp, Homo sapiens
agggcggcggcggcggcggcgg

SEQ ID NO: 46257 - DNA, 24 bp, Homo sapiens
agggcggcggcggcggcggcggcg

SEQ ID NO: 46258 - DNA, 25 bp, Homo sapiens
agggcggcggcggcggcggcggcgg

SEQ ID NO: 46259 - DNA, 26 bp, Homo sapiens
agggcggcggcggcggcggcggcggg

SEQ ID NO: 46260 - DNA, 27 bp, Homo sapiens
agggcggcggcggcggcggcggcgggg

SEQ ID NO: 46261 - DNA, 19 bp, Homo sapiens
gggcggcggcggcggcggc

SEQ ID NO: 46262 - DNA, 20 bp, Homo sapiens
gggcggcggcggcggcggcg

SEQ ID NO: 46263 - DNA, 22 bp, Homo sapiens
gggcggcggcggcggcggcggc

SEQ ID NO: 46264 - DNA, 17 bp, Homo sapiens
ggcggcggcggcggcgg

SEQ ID NO: 46265 - DNA, 18 bp, Homo sapiens
ggcggcggcggcggcggc

SEQ ID NO: 46266 - DNA, 19 bp, Homo sapiens
ggcggcggcggcggcggcg

SEQ ID NO: 46267 - DNA, 20 bp, Homo sapiens
ggcggcggcggcggcggcgg

SEQ ID NO: 46268 - DNA, 21 bp, Homo sapiens
ggcggcggcggcggcggcggc

SEQ ID NO: 46269 - DNA, 22 bp, Homo sapiens
ggcggcggcggcggcggcggcg

SEQ ID NO: 46270 - DNA, 23 bp, Homo sapiens
ggcggcggcggcggcggcggcgg

SEQ ID NO: 46271 - DNA, 24 bp, Homo sapiens
ggcggcggcggcggcggcggcggg

SEQ ID NO: 46272 - DNA, 16 bp, Homo sapiens
gcggcggcggcggcgg

SEQ ID NO: 46273 - DNA, 17 bp, Homo sapiens
gcggcggcggcggcggc

SEQ ID NO: 46274 - DNA, 18 bp, Homo sapiens
gcggcggcggcggcggcg

SEQ ID NO: 46275 - DNA, 19 bp, Homo sapiens
gcggcggcggcggcggcgg

SEQ ID NO: 46276 - DNA, 20 bp, Homo sapiens
gcggcggcggcggcggcggc

SEQ ID NO: 46277 - DNA, 21 bp, Homo sapiens
gcggcggcggcggcggcggcg

SEQ ID NO: 46278 - DNA, 22 bp, Homo sapiens
gcggcggcggcggcggcggcgg

SEQ ID NO: 46279 - DNA, 25 bp, Homo sapiens
gcggcggcggcggcggcggcggggg

SEQ ID NO: 46280 - DNA, 30 bp, Homo sapiens
gcggcggcggcggcggcggcgggggtgtgg

SEQ ID NO: 46281 - DNA, 16 bp, Homo sapiens
cggcggcggcggcggc

SEQ ID NO: 46282 - DNA, 17 bp, Homo sapiens
cggcggcggcggcggcg

SEQ ID NO: 46283 - DNA, 18 bp, Homo sapiens
cggcggcggcggcggcgg

SEQ ID NO: 46284 - DNA, 19 bp, Homo sapiens
cggcggcggcggcggcggc

SEQ ID NO: 46285 - DNA, 20 bp, Homo sapiens
cggcggcggcggcggcggcg

SEQ ID NO: 46286 - DNA, 21 bp, Homo sapiens
cggcggcggcggcggcggcgg

SEQ ID NO: 46287 - DNA, 17 bp, Homo sapiens
ggcggcggcggcggcgg

SEQ ID NO: 46288 - DNA, 18 bp, Homo sapiens
ggcggcggcggcggcggc

SEQ ID NO: 46289 - DNA, 19 bp, Homo sapiens
ggcggcggcggcggcggcg

SEQ ID NO: 46290 - DNA, 20 bp, Homo sapiens
ggcggcggcggcggcggcgg

SEQ ID NO: 46291 - DNA, 21 bp, Homo sapiens
ggcggcggcggcggcggcggg

SEQ ID NO: 46292 - DNA, 16 bp, Homo sapiens
gcggcggcggcggcgg

SEQ ID NO: 46293 - DNA, 17 bp, Homo sapiens
gcggcggcggcggcggc

SEQ ID NO: 46294 - DNA, 18 bp, Homo sapiens
gcggcggcggcggcggcg

SEQ ID NO: 46295 - DNA, 19 bp, Homo sapiens
gcggcggcggcggcggcgg

SEQ ID NO: 46296 - DNA, 16 bp, Homo sapiens
cggcggcggcggcggc

SEQ ID NO: 46297 - DNA, 17 bp, Homo sapiens
cggcggcggcggcggcg

SEQ ID NO: 46298 - DNA, 18 bp, Homo sapiens
cggcggcggcggcggcgg

SEQ ID NO: 46299 - DNA, 17 bp, Homo sapiens
ggcggcggcggcggcgg

SEQ ID NO: 46300 - DNA, 18 bp, Homo sapiens
ggcggcggcggcggcggg

SEQ ID NO: 46301 - DNA, 19 bp, Homo sapiens
ggcggcggcggcggcgggg

SEQ ID NO: 46302 - DNA, 20 bp, Homo sapiens
ggcggcggcggcggcggggg

SEQ ID NO: 46303 - DNA, 21 bp, Homo sapiens
ggcggcggcggcggcgggggt

SEQ ID NO: 46304 - DNA, 25 bp, Homo sapiens
ggcggcggcggcggcgggggtgtgg

SEQ ID NO: 46305 - DNA, 16 bp, Homo sapiens
gcggcggcggcggcgg

SEQ ID NO: 46306 - DNA, 23 bp, Homo sapiens
gcggcggcggcggcgggggtgtg

SEQ ID NO: 46307 - DNA, 24 bp, Homo sapiens
gcggcggcggcggcgggggtgtgg

SEQ ID NO: 46308 - DNA, 26 bp, Homo sapiens
gcggcggcggcggcgggggtgtgggg

SEQ ID NO: 46309 - DNA, 27 bp, Homo sapiens
gcggcggcggcggcgggggtgtggggt

SEQ ID NO: 46310 - DNA, 23 bp, Homo sapiens
cggcggcggcggcgggggtgtgg

SEQ ID NO: 46311 - DNA, 18 bp, Homo sapiens
ggcggcggcggcgggggt

SEQ ID NO: 46312 - DNA, 19 bp, Homo sapiens
ggcggcggcggcgggggtg

SEQ ID NO: 46313 - DNA, 20 bp, Homo sapiens
ggcggcggcggcgggggtgt

SEQ ID NO: 46314 - DNA, 22 bp, Homo sapiens
ggcggcggcggcgggggtgtgg

SEQ ID NO: 46315 - DNA, 20 bp, Homo sapiens
gcggcggcggcgggggtgtg

SEQ ID NO: 46316 - DNA, 21 bp, Homo sapiens
gcggcggcggcgggggtgtgg

SEQ ID NO: 46317 - DNA, 22 bp, Homo sapiens
gcggcggcggcgggggtgtggg

SEQ ID NO: 46318 - DNA, 23 bp, Homo sapiens
gcggcggcggcgggggtgtgggg

SEQ ID NO: 46319 - DNA, 20 bp, Homo sapiens
cggcggcggcgggggtgtgg

SEQ ID NO: 46320 - DNA, 21 bp, Homo sapiens
cggcggcggcgggggtgtggg

SEQ ID NO: 46321 - DNA, 19 bp, Homo sapiens
ggcggcggcgggggtgtgg

SEQ ID NO: 46322 - DNA, 20 bp, Homo sapiens
ggcggcggcgggggtgtggg

SEQ ID NO: 46323 - DNA, 21 bp, Homo sapiens
ggcggcggcgggggtgtgggg

SEQ ID NO: 46324 - DNA, 22 bp, Homo sapiens
ggcggcggcgggggtgtggggt

SEQ ID NO: 46325 - DNA, 23 bp, Homo sapiens
ggcggcggcgggggtgtggggtc

SEQ ID NO: 46326 - DNA, 17 bp, Homo sapiens
gcggcggcgggggtgtg

SEQ ID NO: 46327 - DNA, 18 bp, Homo sapiens
gcggcggcgggggtgtgg

SEQ ID NO: 46328 - DNA, 19 bp, Homo sapiens
gcggcggcgggggtgtggg

SEQ ID NO: 46329 - DNA, 20 bp, Homo sapiens
gcggcggcgggggtgtgggg

SEQ ID NO: 46330 - DNA, 21 bp, Homo sapiens
gcggcggcgggggtgtggggt

SEQ ID NO: 46331 - DNA, 22 bp, Homo sapiens
gcggcggcgggggtgtggggtc

SEQ ID NO: 46332 - DNA, 23 bp, Homo sapiens
gcggcggcgggggtgtggggtcc

SEQ ID NO: 46333 - DNA, 24 bp, Homo sapiens
gcggcggcgggggtgtggggtcct

SEQ ID NO: 46334 - DNA, 17 bp, Homo sapiens
cggcggcgggggtgtgg

SEQ ID NO: 46335 - DNA, 19 bp, Homo sapiens
cggcggcgggggtgtgggg

SEQ ID NO: 46336 - DNA, 20 bp, Homo sapiens
cggcggcgggggtgtggggt

SEQ ID NO: 46337 - DNA, 16 bp, Homo sapiens
ggcggcgggggtgtgg

SEQ ID NO: 46338 - DNA, 17 bp, Homo sapiens
ggcggcgggggtgtggg

SEQ ID NO: 46339 - DNA, 18 bp, Homo sapiens
ggcggcgggggtgtgggg

SEQ ID NO: 46340 - DNA, 19 bp, Homo sapiens
ggcggcgggggtgtggggt

SEQ ID NO: 46341 - DNA, 20 bp, Homo sapiens
ggcggcgggggtgtggggtc

SEQ ID NO: 46342 - DNA, 21 bp, Homo sapiens
ggcggcgggggtgtggggtcc

SEQ ID NO: 46343 - DNA, 16 bp, Homo sapiens
gcggcgggggtgtggg

SEQ ID NO: 46344 - DNA, 17 bp, Homo sapiens
gcggcgggggtgtgggg

SEQ ID NO: 46345 - DNA, 18 bp, Homo sapiens
gcggcgggggtgtggggt

SEQ ID NO: 46346 - DNA, 19 bp, Homo sapiens
gcggcgggggtgtggggtc

SEQ ID NO: 46347 - DNA, 20 bp, Homo sapiens
gcggcgggggtgtggggtcc

SEQ ID NO: 46348 - DNA, 21 bp, Homo sapiens
gcggcgggggtgtggggtcct

SEQ ID NO: 46349 - DNA, 16 bp, Homo sapiens
cggcgggggtgtgggg

SEQ ID NO: 46350 - DNA, 16 bp, Homo sapiens
ggcgggggtgtggggt

SEQ ID NO: 46351 - DNA, 17 bp, Homo sapiens
ggcgggggtgtggggtc

SEQ ID NO: 46352 - DNA, 16 bp, Homo sapiens
gcgggggtgtggggtc

SEQ ID NO: 46353 - DNA, 17 bp, Homo sapiens
gcgggggtgtggggtcc

SEQ ID NO: 46354 - DNA, 16 bp, Homo sapiens
ggtccttcccccgccc

SEQ ID NO: 46355 - DNA, 17 bp, Homo sapiens
ggtccttcccccgcccc

SEQ ID NO: 46356 - DNA, 18 bp, Homo sapiens
ggtccttcccccgccccc

SEQ ID NO: 46357 - DNA, 19 bp, Homo sapiens
ggtccttcccccgcccccc

SEQ ID NO: 46358 - DNA, 20 bp, Homo sapiens
ggtccttcccccgccccccc

SEQ ID NO: 46359 - DNA, 21 bp, Homo sapiens
ggtccttcccccgcccccccc

SEQ ID NO: 46360 - DNA, 22 bp, Homo sapiens
ggtccttcccccgccccccccc

SEQ ID NO: 46361 - DNA, 20 bp, Homo sapiens
cccacgcctcctcccctcct

SEQ ID NO: 46362 - DNA, 22 bp, Homo sapiens
cccacgcctcctcccctcctcc

SEQ ID NO: 46363 - DNA, 18 bp, Homo sapiens
ccacgcctcctcccctcc

SEQ ID NO: 46364 - DNA, 19 bp, Homo sapiens
ccacgcctcctcccctcct

SEQ ID NO: 46365 - DNA, 20 bp, Homo sapiens
ccacgcctcctcccctcctc

SEQ ID NO: 46366 - DNA, 21 bp, Homo sapiens
ccacgcctcctcccctcctcc

SEQ ID NO: 46367 - DNA, 20 bp, Homo sapiens
cacgcctcctcccctcctcc

SEQ ID NO: 46368 - DNA, 16 bp, Homo sapiens
acgcctcctcccctcc

SEQ ID NO: 46369 - DNA, 17 bp, Homo sapiens
acgcctcctcccctcct

SEQ ID NO: 46370 - DNA, 18 bp, Homo sapiens
acgcctcctcccctcctc

SEQ ID NO: 46371 - DNA, 19 bp, Homo sapiens
acgcctcctcccctcctcc

SEQ ID NO: 46372 - DNA, 20 bp, Homo sapiens
acgcctcctcccctcctccc

SEQ ID NO: 46373 - DNA, 21 bp, Homo sapiens
acgcctcctcccctcctcccg

SEQ ID NO: 46374 - DNA, 22 bp, Homo sapiens
acgcctcctcccctcctcccgc

SEQ ID NO: 46375 - DNA, 16 bp, Homo sapiens
cgcctcctcccctcct

SEQ ID NO: 46376 - DNA, 17 bp, Homo sapiens
cgcctcctcccctcctc

SEQ ID NO: 46377 - DNA, 18 bp, Homo sapiens
cgcctcctcccctcctcc

SEQ ID NO: 46378 - DNA, 19 bp, Homo sapiens
cgcctcctcccctcctccc

SEQ ID NO: 46379 - DNA, 20 bp, Homo sapiens
cgcctcctcccctcctcccg

SEQ ID NO: 46380 - DNA, 21 bp, Homo sapiens
cgcctcctcccctcctcccgc

SEQ ID NO: 46381 - DNA, 22 bp, Homo sapiens
cgcctcctcccctcctcccgcc

SEQ ID NO: 46382 - DNA, 23 bp, Homo sapiens
cgcctcctcccctcctcccgccc

SEQ ID NO: 46383 - DNA, 16 bp, Homo sapiens
gcctcctcccctcctc

SEQ ID NO: 46384 - DNA, 17 bp, Homo sapiens
gcctcctcccctcctcc

SEQ ID NO: 46385 - DNA, 18 bp, Homo sapiens
gcctcctcccctcctccc

SEQ ID NO: 46386 - DNA, 19 bp, Homo sapiens
gcctcctcccctcctcccg

SEQ ID NO: 46387 - DNA, 20 bp, Homo sapiens
gcctcctcccctcctcccgc

SEQ ID NO: 46388 - DNA, 21 bp, Homo sapiens
gcctcctcccctcctcccgcc

SEQ ID NO: 46389 - DNA, 22 bp, Homo sapiens
gcctcctcccctcctcccgccc

SEQ ID NO: 46390 - DNA, 16 bp, Homo sapiens
cctcctcccctcctcc

SEQ ID NO: 46391 - DNA, 19 bp, Homo sapiens
cctcctcccctcctcccgc

SEQ ID NO: 46392 - DNA, 17 bp, Homo sapiens
ctcctcccctcctcccg

SEQ ID NO: 46393 - DNA, 18 bp, Homo sapiens
ctcctcccctcctcccgc

SEQ ID NO: 46394 - DNA, 19 bp, Homo sapiens
ctcctcccctcctcccgcc

SEQ ID NO: 46395 - DNA, 20 bp, Homo sapiens
ctcctcccctcctcccgccc

SEQ ID NO: 46396 - DNA, 21 bp, Homo sapiens
ctcctcccctcctcccgccca

SEQ ID NO: 46397 - DNA, 23 bp, Homo sapiens
ctcctcccctcctcccgcccacg

SEQ ID NO: 46398 - DNA, 24 bp, Homo sapiens
ctcctcccctcctcccgcccacgc

SEQ ID NO: 46399 - DNA, 26 bp, Homo sapiens
ctcctcccctcctcccgcccacgccc

SEQ ID NO: 46400 - DNA, 16 bp, Homo sapiens
cctcccctcctcccgc

SEQ ID NO: 46401 - DNA, 17 bp, Homo sapiens
cctcccctcctcccgcc

SEQ ID NO: 46402 - DNA, 21 bp, Homo sapiens
cctcccctcctcccgcccacg

SEQ ID NO: 46403 - DNA, 22 bp, Homo sapiens
cctcccctcctcccgcccacgc

SEQ ID NO: 46404 - DNA, 16 bp, Homo sapiens
ctcccctcctcccgcc

SEQ ID NO: 46405 - DNA, 20 bp, Homo sapiens
ctcccctcctcccgcccacg

SEQ ID NO: 46406 - DNA, 21 bp, Homo sapiens
ctcccctcctcccgcccacgc

SEQ ID NO: 46407 - DNA, 22 bp, Homo sapiens
ctcccctcctcccgcccacgcc

SEQ ID NO: 46408 - DNA, 23 bp, Homo sapiens
ctcccctcctcccgcccacgccc

SEQ ID NO: 46409 - DNA, 24 bp, Homo sapiens
ctcccctcctcccgcccacgcccc

SEQ ID NO: 46410 - DNA, 19 bp, Homo sapiens
cccctcctcccgcccacgc

SEQ ID NO: 46411 - DNA, 20 bp, Homo sapiens
cccctcctcccgcccacgcc

SEQ ID NO: 46412 - DNA, 24 bp, Homo sapiens
cccctcctcccgcccacgccccgc

SEQ ID NO: 46413 - DNA, 23 bp, Homo sapiens
ccctcctcccgcccacgccccgc

SEQ ID NO: 46414 - DNA, 21 bp, Homo sapiens
ctcctcccgcccacgccccgc

SEQ ID NO: 46415 - DNA, 20 bp, Homo sapiens
tcctcccgcccacgccccgc

SEQ ID NO: 46416 - DNA, 19 bp, Homo sapiens
cctcccgcccacgccccgc

SEQ ID NO: 46417 - DNA, 17 bp, Homo sapiens
tcccgcccacgccccgc

SEQ ID NO: 46418 - DNA, 16 bp, Homo sapiens
cccgcccacgccccgc

SEQ ID NO: 46419 - DNA, 19 bp, Homo sapiens
cccgcccacgccccgctcc

SEQ ID NO: 46420 - DNA, 20 bp, Homo sapiens
cccgcccacgccccgctccc

SEQ ID NO: 46421 - DNA, 21 bp, Homo sapiens
cccgcccacgccccgctcccc

SEQ ID NO: 46422 - DNA, 23 bp, Homo sapiens
cccgcccacgccccgctccccgc

SEQ ID NO: 46423 - DNA, 24 bp, Homo sapiens
cccgcccacgccccgctccccgcc

SEQ ID NO: 46424 - DNA, 19 bp, Homo sapiens
ccgcccacgccccgctccc

SEQ ID NO: 46425 - DNA, 22 bp, Homo sapiens
ccgcccacgccccgctccccgc

SEQ ID NO: 46426 - DNA, 23 bp, Homo sapiens
ccgcccacgccccgctccccgcc

SEQ ID NO: 46427 - DNA, 18 bp, Homo sapiens
cgcccacgccccgctccc

SEQ ID NO: 46428 - DNA, 19 bp, Homo sapiens
cgcccacgccccgctcccc

SEQ ID NO: 46429 - DNA, 21 bp, Homo sapiens
cgcccacgccccgctccccgc

SEQ ID NO: 46430 - DNA, 22 bp, Homo sapiens
cgcccacgccccgctccccgcc

SEQ ID NO: 46431 - DNA, 20 bp, Homo sapiens
gcccacgccccgctccccgc

SEQ ID NO: 46432 - DNA, 21 bp, Homo sapiens
gcccacgccccgctccccgcc

SEQ ID NO: 46433 - DNA, 16 bp, Homo sapiens
cgccccgctccccgcc

SEQ ID NO: 46434 - DNA, 17 bp, Homo sapiens
cgccccgctccccgccc

SEQ ID NO: 46435 - DNA, 18 bp, Homo sapiens
cgccccgctccccgcccc

SEQ ID NO: 46436 - DNA, 19 bp, Homo sapiens
cgccccgctccccgccccc

SEQ ID NO: 46437 - DNA, 20 bp, Homo sapiens
cgccccgctccccgcccccg

SEQ ID NO: 46438 - DNA, 21 bp, Homo sapiens
cgccccgctccccgcccccgg

SEQ ID NO: 46439 - DNA, 22 bp, Homo sapiens
cgccccgctccccgcccccgga

SEQ ID NO: 46440 - DNA, 24 bp, Homo sapiens
cgccccgctccccgcccccggagc

SEQ ID NO: 46441 - DNA, 25 bp, Homo sapiens
cgccccgctccccgcccccggagcc

SEQ ID NO: 46442 - DNA, 17 bp, Homo sapiens
gccccgctccccgcccc

SEQ ID NO: 46443 - DNA, 18 bp, Homo sapiens
gccccgctccccgccccc

SEQ ID NO: 46444 - DNA, 20 bp, Homo sapiens
gccccgctccccgcccccgg

SEQ ID NO: 46445 - DNA, 21 bp, Homo sapiens
gccccgctccccgcccccgga

SEQ ID NO: 46446 - DNA, 19 bp, Homo sapiens
ccccgctccccgcccccgg

SEQ ID NO: 46447 - DNA, 20 bp, Homo sapiens
ccccgctccccgcccccgga

SEQ ID NO: 46448 - DNA, 17 bp, Homo sapiens
cccgctccccgcccccg

SEQ ID NO: 46449 - DNA, 18 bp, Homo sapiens
cccgctccccgcccccgg

SEQ ID NO: 46450 - DNA, 19 bp, Homo sapiens
cccgctccccgcccccgga

SEQ ID NO: 46451 - DNA, 21 bp, Homo sapiens
cccgctccccgcccccggagc

SEQ ID NO: 46452 - DNA, 22 bp, Homo sapiens
cccgctccccgcccccggagcc

SEQ ID NO: 46453 - DNA, 17 bp, Homo sapiens
ccgctccccgcccccgg

SEQ ID NO: 46454 - DNA, 18 bp, Homo sapiens
ccgctccccgcccccgga

SEQ ID NO: 46455 - DNA, 19 bp, Homo sapiens
ccgctccccgcccccggag

SEQ ID NO: 46456 - DNA, 20 bp, Homo sapiens
ccgctccccgcccccggagc

SEQ ID NO: 46457 - DNA, 19 bp, Homo sapiens
cgctccccgcccccggagc

SEQ ID NO: 46458 - DNA, 16 bp, Homo sapiens
gctccccgcccccgga

SEQ ID NO: 46459 - DNA, 18 bp, Homo sapiens
gctccccgcccccggagc

SEQ ID NO: 46460 - DNA, 19 bp, Homo sapiens
gctccccgcccccggagcc

SEQ ID NO: 46461 - DNA, 20 bp, Homo sapiens
gctccccgcccccggagccc

SEQ ID NO: 46462 - DNA, 23 bp, Homo sapiens
gctccccgcccccggagccccgc

SEQ ID NO: 46463 - DNA, 24 bp, Homo sapiens
gctccccgcccccggagccccgcg

SEQ ID NO: 46464 - DNA, 26 bp, Homo sapiens
gctccccgcccccggagccccgcgga

SEQ ID NO: 46465 - DNA, 18 bp, Homo sapiens
ctccccgcccccggagcc

SEQ ID NO: 46466 - DNA, 20 bp, Homo sapiens
ctccccgcccccggagcccc

SEQ ID NO: 46467 - DNA, 21 bp, Homo sapiens
ctccccgcccccggagccccg

SEQ ID NO: 46468 - DNA, 22 bp, Homo sapiens
ctccccgcccccggagccccgc

SEQ ID NO: 46469 - DNA, 23 bp, Homo sapiens
ctccccgcccccggagccccgcg

SEQ ID NO: 46470 - DNA, 22 bp, Homo sapiens
tccccgcccccggagccccgcg

SEQ ID NO: 46471 - DNA, 20 bp, Homo sapiens
ccccgcccccggagccccgc

SEQ ID NO: 46472 - DNA, 21 bp, Homo sapiens
ccccgcccccggagccccgcg

SEQ ID NO: 46473 - DNA, 22 bp, Homo sapiens
ccccgcccccggagccccgcgg

SEQ ID NO: 46474 - DNA, 26 bp, Homo sapiens
ccccgcccccggagccccgcggacgc

SEQ ID NO: 46475 - DNA, 16 bp, Homo sapiens
cccgcccccggagccc

SEQ ID NO: 46476 - DNA, 17 bp, Homo sapiens
cccgcccccggagcccc

SEQ ID NO: 46477 - DNA, 18 bp, Homo sapiens
cccgcccccggagccccg

SEQ ID NO: 46478 - DNA, 19 bp, Homo sapiens
cccgcccccggagccccgc

SEQ ID NO: 46479 - DNA, 20 bp, Homo sapiens
cccgcccccggagccccgcg

SEQ ID NO: 46480 - DNA, 21 bp, Homo sapiens
cccgcccccggagccccgcgg

SEQ ID NO: 46481 - DNA, 22 bp, Homo sapiens
cccgcccccggagccccgcgga

SEQ ID NO: 46482 - DNA, 18 bp, Homo sapiens
ccgcccccggagccccgc

SEQ ID NO: 46483 - DNA, 19 bp, Homo sapiens
ccgcccccggagccccgcg

SEQ ID NO: 46484 - DNA, 20 bp, Homo sapiens
ccgcccccggagccccgcgg

SEQ ID NO: 46485 - DNA, 21 bp, Homo sapiens
ccgcccccggagccccgcgga

SEQ ID NO: 46486 - DNA, 22 bp, Homo sapiens
ccgcccccggagccccgcggac

SEQ ID NO: 46487 - DNA, 24 bp, Homo sapiens
ccgcccccggagccccgcggacgc

SEQ ID NO: 46488 - DNA, 17 bp, Homo sapiens
cgcccccggagccccgc

SEQ ID NO: 46489 - DNA, 18 bp, Homo sapiens
cgcccccggagccccgcg

SEQ ID NO: 46490 - DNA, 19 bp, Homo sapiens
cgcccccggagccccgcgg

SEQ ID NO: 46491 - DNA, 20 bp, Homo sapiens
cgcccccggagccccgcgga

SEQ ID NO: 46492 - DNA, 22 bp, Homo sapiens
cgcccccggagccccgcggacg

SEQ ID NO: 46493 - DNA, 23 bp, Homo sapiens
cgcccccggagccccgcggacgc

SEQ ID NO: 46494 - DNA, 17 bp, Homo sapiens
gcccccggagccccgcg

SEQ ID NO: 46495 - DNA, 18 bp, Homo sapiens
gcccccggagccccgcgg

SEQ ID NO: 46496 - DNA, 20 bp, Homo sapiens
gcccccggagccccgcggac

SEQ ID NO: 46497 - DNA, 21 bp, Homo sapiens
gcccccggagccccgcggacg

SEQ ID NO: 46498 - DNA, 22 bp, Homo sapiens
gcccccggagccccgcggacgc

SEQ ID NO: 46499 - DNA, 19 bp, Homo sapiens
cccccggagccccgcggac

SEQ ID NO: 46500 - DNA, 20 bp, Homo sapiens
cccccggagccccgcggacg

SEQ ID NO: 46501 - DNA, 21 bp, Homo sapiens
cccccggagccccgcggacgc

SEQ ID NO: 46502 - DNA, 22 bp, Homo sapiens
cccccggagccccgcggacgct

SEQ ID NO: 46503 - DNA, 20 bp, Homo sapiens
cccggagccccgcggacgct

SEQ ID NO: 46504 - DNA, 17 bp, Homo sapiens
ccggagccccgcggacg

SEQ ID NO: 46505 - DNA, 18 bp, Homo sapiens
ccggagccccgcggacgc

SEQ ID NO: 46506 - DNA, 19 bp, Homo sapiens
ccggagccccgcggacgct

SEQ ID NO: 46507 - DNA, 22 bp, Homo sapiens
ccggagccccgcggacgctacg

SEQ ID NO: 46508 - DNA, 16 bp, Homo sapiens
cggagccccgcggacg

SEQ ID NO: 46509 - DNA, 18 bp, Homo sapiens
cggagccccgcggacgct

SEQ ID NO: 46510 - DNA, 16 bp, Homo sapiens
ggagccccgcggacgc

SEQ ID NO: 46511 - DNA, 17 bp, Homo sapiens
ggagccccgcggacgct

SEQ ID NO: 46512 - DNA, 20 bp, Homo sapiens
ggagccccgcggacgctacg

SEQ ID NO: 46513 - DNA, 22 bp, Homo sapiens
ggagccccgcggacgctacgcc

SEQ ID NO: 46514 - DNA, 18 bp, Homo sapiens
ccccgcggacgctacgcc

SEQ ID NO: 46515 - DNA, 24 bp, Homo sapiens
ccccgcggacgctacgccgcgacg

SEQ ID NO: 46516 - DNA, 26 bp, Homo sapiens
ccccgcggacgctacgccgcgacgag

SEQ ID NO: 46517 - DNA, 30 bp, Homo sapiens
ccccgcggacgctacgccgcgacgagtagg

SEQ ID NO: 46518 - DNA, 17 bp, Homo sapiens
cccgcggacgctacgcc

SEQ ID NO: 46519 - DNA, 22 bp, Homo sapiens
cccgcggacgctacgccgcgac

SEQ ID NO: 46520 - DNA, 23 bp, Homo sapiens
cccgcggacgctacgccgcgacg

SEQ ID NO: 46521 - DNA, 25 bp, Homo sapiens
cccgcggacgctacgccgcgacgag

SEQ ID NO: 46522 - DNA, 29 bp, Homo sapiens
cccgcggacgctacgccgcgacgagtagg

SEQ ID NO: 46523 - DNA, 19 bp, Homo sapiens
cggacgctacgccgcgacg

SEQ ID NO: 46524 - DNA, 24 bp, Homo sapiens
cggacgctacgccgcgacgagtag

SEQ ID NO: 46525 - DNA, 30 bp, Homo sapiens
cggacgctacgccgcgacgagtaggagggc

SEQ ID NO: 46526 - DNA, 17 bp, Homo sapiens
ggacgctacgccgcgac

SEQ ID NO: 46527 - DNA, 18 bp, Homo sapiens
ggacgctacgccgcgacg

SEQ ID NO: 46528 - DNA, 19 bp, Homo sapiens
ggacgctacgccgcgacga

SEQ ID NO: 46529 - DNA, 20 bp, Homo sapiens
ggacgctacgccgcgacgag

SEQ ID NO: 46530 - DNA, 21 bp, Homo sapiens
ggacgctacgccgcgacgagt

SEQ ID NO: 46531 - DNA, 22 bp, Homo sapiens
ggacgctacgccgcgacgagta

SEQ ID NO: 46532 - DNA, 23 bp, Homo sapiens
ggacgctacgccgcgacgagtag

SEQ ID NO: 46533 - DNA, 25 bp, Homo sapiens
ggacgctacgccgcgacgagtagga

SEQ ID NO: 46534 - DNA, 26 bp, Homo sapiens
ggacgctacgccgcgacgagtaggag

SEQ ID NO: 46535 - DNA, 27 bp, Homo sapiens
ggacgctacgccgcgacgagtaggagg

SEQ ID NO: 46536 - DNA, 28 bp, Homo sapiens
ggacgctacgccgcgacgagtaggaggg

SEQ ID NO: 46537 - DNA, 30 bp, Homo sapiens
ggacgctacgccgcgacgagtaggagggcc

SEQ ID NO: 46538 - DNA, 20 bp, Homo sapiens
gacgctacgccgcgacgagt

SEQ ID NO: 46539 - DNA, 22 bp, Homo sapiens
gacgctacgccgcgacgagtag

SEQ ID NO: 46540 - DNA, 23 bp, Homo sapiens
gacgctacgccgcgacgagtagg

SEQ ID NO: 46541 - DNA, 24 bp, Homo sapiens
gacgctacgccgcgacgagtagga

SEQ ID NO: 46542 - DNA, 25 bp, Homo sapiens
gacgctacgccgcgacgagtaggag

SEQ ID NO: 46543 - DNA, 26 bp, Homo sapiens
gacgctacgccgcgacgagtaggagg

SEQ ID NO: 46544 - DNA, 30 bp, Homo sapiens
gacgctacgccgcgacgagtaggagggccg

SEQ ID NO: 46545 - DNA, 18 bp, Homo sapiens
acgctacgccgcgacgag

SEQ ID NO: 46546 - DNA, 19 bp, Homo sapiens
acgctacgccgcgacgagt

SEQ ID NO: 46547 - DNA, 21 bp, Homo sapiens
acgctacgccgcgacgagtag

SEQ ID NO: 46548 - DNA, 22 bp, Homo sapiens
acgctacgccgcgacgagtagg

SEQ ID NO: 46549 - DNA, 23 bp, Homo sapiens
acgctacgccgcgacgagtagga

SEQ ID NO: 46550 - DNA, 20 bp, Homo sapiens
cgctacgccgcgacgagtag

SEQ ID NO: 46551 - DNA, 21 bp, Homo sapiens
cgctacgccgcgacgagtagg

SEQ ID NO: 46552 - DNA, 22 bp, Homo sapiens
cgctacgccgcgacgagtagga

SEQ ID NO: 46553 - DNA, 30 bp, Homo sapiens
cgctacgccgcgacgagtaggagggccgct

SEQ ID NO: 46554 - DNA, 19 bp, Homo sapiens
gctacgccgcgacgagtag

SEQ ID NO: 46555 - DNA, 20 bp, Homo sapiens
gctacgccgcgacgagtagg

SEQ ID NO: 46556 - DNA, 21 bp, Homo sapiens
gctacgccgcgacgagtagga

SEQ ID NO: 46557 - DNA, 18 bp, Homo sapiens
ctacgccgcgacgagtag

SEQ ID NO: 46558 - DNA, 19 bp, Homo sapiens
ctacgccgcgacgagtagg

SEQ ID NO: 46559 - DNA, 20 bp, Homo sapiens
ctacgccgcgacgagtagga

SEQ ID NO: 46560 - DNA, 21 bp, Homo sapiens
ctacgccgcgacgagtaggag

SEQ ID NO: 46561 - DNA, 24 bp, Homo sapiens
ctacgccgcgacgagtaggagggc

SEQ ID NO: 46562 - DNA, 17 bp, Homo sapiens
tacgccgcgacgagtag

SEQ ID NO: 46563 - DNA, 18 bp, Homo sapiens
tacgccgcgacgagtagg

SEQ ID NO: 46564 - DNA, 19 bp, Homo sapiens
tacgccgcgacgagtagga

SEQ ID NO: 46565 - DNA, 16 bp, Homo sapiens
acgccgcgacgagtag

SEQ ID NO: 46566 - DNA, 17 bp, Homo sapiens
acgccgcgacgagtagg

SEQ ID NO: 46567 - DNA, 18 bp, Homo sapiens
acgccgcgacgagtagga

SEQ ID NO: 46568 - DNA, 20 bp, Homo sapiens
acgccgcgacgagtaggagg

SEQ ID NO: 46569 - DNA, 19 bp, Homo sapiens
gtaggagggccgctgcggt

SEQ ID NO: 46570 - DNA, 22 bp, Homo sapiens
gtaggagggccgctgcggtgag

SEQ ID NO: 46571 - DNA, 17 bp, Homo sapiens
aggagggccgctgcggt

SEQ ID NO: 46572 - DNA, 21 bp, Homo sapiens
aggagggccgctgcggtgagc

SEQ ID NO: 46573 - DNA, 20 bp, Homo sapiens
ggagggccgctgcggtgagc

SEQ ID NO: 46574 - DNA, 18 bp, Homo sapiens
gagggccgctgcggtgag

SEQ ID NO: 46575 - DNA, 19 bp, Homo sapiens
gagggccgctgcggtgagc

SEQ ID NO: 46576 - DNA, 18 bp, Homo sapiens
agggccgctgcggtgagc

SEQ ID NO: 46577 - DNA, 17 bp, Homo sapiens
gggccgctgcggtgagc

SEQ ID NO: 46578 - DNA, 29 bp, Homo sapiens
gggccgctgcggtgagccttgaagcctag

SEQ ID NO: 46579 - DNA, 30 bp, Homo sapiens
gggccgctgcggtgagccttgaagcctagg

SEQ ID NO: 46580 - DNA, 16 bp, Homo sapiens
ggccgctgcggtgagc

SEQ ID NO: 46581 - DNA, 17 bp, Homo sapiens
ggccgctgcggtgagcc

SEQ ID NO: 46582 - DNA, 20 bp, Homo sapiens
ggccgctgcggtgagccttg

SEQ ID NO: 46583 - DNA, 23 bp, Homo sapiens
ggccgctgcggtgagccttgaag

SEQ ID NO: 46584 - DNA, 24 bp, Homo sapiens
ggccgctgcggtgagccttgaagc

SEQ ID NO: 46585 - DNA, 25 bp, Homo sapiens
ggccgctgcggtgagccttgaagcc

SEQ ID NO: 46586 - DNA, 26 bp, Homo sapiens
ggccgctgcggtgagccttgaagcct

SEQ ID NO: 46587 - DNA, 27 bp, Homo sapiens
ggccgctgcggtgagccttgaagccta

SEQ ID NO: 46588 - DNA, 28 bp, Homo sapiens
ggccgctgcggtgagccttgaagcctag

SEQ ID NO: 46589 - DNA, 29 bp, Homo sapiens
ggccgctgcggtgagccttgaagcctagg

SEQ ID NO: 46590 - DNA, 30 bp, Homo sapiens
ggccgctgcggtgagccttgaagcctaggg

SEQ ID NO: 46591 - DNA, 30 bp, Homo sapiens
cgctgcggtgagccttgaagcctagggcgc

SEQ ID NO: 46592 - DNA, 19 bp, Homo sapiens
ctgcggtgagccttgaagc

SEQ ID NO: 46593 - DNA, 23 bp, Homo sapiens
ctgcggtgagccttgaagcctag

SEQ ID NO: 46594 - DNA, 24 bp, Homo sapiens
ctgcggtgagccttgaagcctagg

SEQ ID NO: 46595 - DNA, 22 bp, Homo sapiens
tgcggtgagccttgaagcctag

SEQ ID NO: 46596 - DNA, 21 bp, Homo sapiens
gcggtgagccttgaagcctag

SEQ ID NO: 46597 - DNA, 19 bp, Homo sapiens
ggtgagccttgaagcctag

SEQ ID NO: 46598 - DNA, 20 bp, Homo sapiens
ggtgagccttgaagcctagg

SEQ ID NO: 46599 - DNA, 18 bp, Homo sapiens
gtgagccttgaagcctag

SEQ ID NO: 46600 - DNA, 19 bp, Homo sapiens
gtgagccttgaagcctagg

SEQ ID NO: 46601 - DNA, 20 bp, Homo sapiens
gtgagccttgaagcctaggg

SEQ ID NO: 46602 - DNA, 21 bp, Homo sapiens
gtgagccttgaagcctagggc

SEQ ID NO: 46603 - DNA, 24 bp, Homo sapiens
gtgagccttgaagcctagggcgcg

SEQ ID NO: 46604 - DNA, 17 bp, Homo sapiens
gagccttgaagcctagg

SEQ ID NO: 46605 - DNA, 18 bp, Homo sapiens
gagccttgaagcctaggg

SEQ ID NO: 46606 - DNA, 20 bp, Homo sapiens
ccttgaagcctagggcgcgg

SEQ ID NO: 46607 - DNA, 23 bp, Homo sapiens
tagggcgcgggcccgggtggagc

SEQ ID NO: 46608 - DNA, 17 bp, Homo sapiens
ggcgcgggcccgggtgg

SEQ ID NO: 46609 - DNA, 18 bp, Homo sapiens
ggcgcgggcccgggtgga

SEQ ID NO: 46610 - DNA, 19 bp, Homo sapiens
ggcgcgggcccgggtggag

SEQ ID NO: 46611 - DNA, 20 bp, Homo sapiens
ggcgcgggcccgggtggagc

SEQ ID NO: 46612 - DNA, 21 bp, Homo sapiens
ggcgcgggcccgggtggagcc

SEQ ID NO: 46613 - DNA, 23 bp, Homo sapiens
ggcgcgggcccgggtggagccgc

SEQ ID NO: 46614 - DNA, 24 bp, Homo sapiens
ggcgcgggcccgggtggagccgcc

SEQ ID NO: 46615 - DNA, 30 bp, Homo sapiens
ggcgcgggcccgggtggagccgccgcaggt

SEQ ID NO: 46616 - DNA, 17 bp, Homo sapiens
gcgcgggcccgggtgga

SEQ ID NO: 46617 - DNA, 18 bp, Homo sapiens
gcgcgggcccgggtggag

SEQ ID NO: 46618 - DNA, 19 bp, Homo sapiens
gcgcgggcccgggtggagc

SEQ ID NO: 46619 - DNA, 20 bp, Homo sapiens
gcgcgggcccgggtggagcc

SEQ ID NO: 46620 - DNA, 21 bp, Homo sapiens
gcgcgggcccgggtggagccg

SEQ ID NO: 46621 - DNA, 22 bp, Homo sapiens
gcgcgggcccgggtggagccgc

SEQ ID NO: 46622 - DNA, 23 bp, Homo sapiens
gcgcgggcccgggtggagccgcc

SEQ ID NO: 46623 - DNA, 30 bp, Homo sapiens
gcgcgggcccgggtggagccgccgcaggtg

SEQ ID NO: 46624 - DNA, 17 bp, Homo sapiens
cgcgggcccgggtggag

SEQ ID NO: 46625 - DNA, 18 bp, Homo sapiens
cgcgggcccgggtggagc

SEQ ID NO: 46626 - DNA, 30 bp, Homo sapiens
cgcgggcccgggtggagccgccgcaggtgc

SEQ ID NO: 46627 - DNA, 16 bp, Homo sapiens
gcgggcccgggtggag

SEQ ID NO: 46628 - DNA, 17 bp, Homo sapiens
gcgggcccgggtggagc

SEQ ID NO: 46629 - DNA, 23 bp, Homo sapiens
gcccgggtggagccgccgcaggt

SEQ ID NO: 46630 - DNA, 22 bp, Homo sapiens
cgggtggagccgccgcaggtgc

SEQ ID NO: 46631 - DNA, 20 bp, Homo sapiens
tggagccgccgcaggtgcag

SEQ ID NO: 46632 - DNA, 19 bp, Homo sapiens
ggagccgccgcaggtgcag

SEQ ID NO: 46633 - DNA, 20 bp, Homo sapiens
ggagccgccgcaggtgcaga

SEQ ID NO: 46634 - DNA, 21 bp, Homo sapiens
ggagccgccgcaggtgcagat

SEQ ID NO: 46635 - DNA, 24 bp, Homo sapiens
gagccgccgcaggtgcagatcttg

SEQ ID NO: 46636 - DNA, 25 bp, Homo sapiens
gagccgccgcaggtgcagatcttgg

SEQ ID NO: 46637 - DNA, 24 bp, Homo sapiens
agccgccgcaggtgcagatcttgg

SEQ ID NO: 46638 - DNA, 23 bp, Homo sapiens
gccgccgcaggtgcagatcttgg

SEQ ID NO: 46639 - DNA, 22 bp, Homo sapiens
ccgccgcaggtgcagatcttgg

SEQ ID NO: 46640 - DNA, 28 bp, Homo sapiens
ccgccgcaggtgcagatcttggtggtag

SEQ ID NO: 46641 - DNA, 29 bp, Homo sapiens
ccgccgcaggtgcagatcttggtggtagt

SEQ ID NO: 46642 - DNA, 21 bp, Homo sapiens
cgccgcaggtgcagatcttgg

SEQ ID NO: 46643 - DNA, 27 bp, Homo sapiens
cgccgcaggtgcagatcttggtggtag

SEQ ID NO: 46644 - DNA, 28 bp, Homo sapiens
cgccgcaggtgcagatcttggtggtagt

SEQ ID NO: 46645 - DNA, 20 bp, Homo sapiens
gccgcaggtgcagatcttgg

SEQ ID NO: 46646 - DNA, 26 bp, Homo sapiens
gccgcaggtgcagatcttggtggtag

SEQ ID NO: 46647 - DNA, 27 bp, Homo sapiens
gccgcaggtgcagatcttggtggtagt

SEQ ID NO: 46648 - DNA, 19 bp, Homo sapiens
ccgcaggtgcagatcttgg

SEQ ID NO: 46649 - DNA, 25 bp, Homo sapiens
ccgcaggtgcagatcttggtggtag

SEQ ID NO: 46650 - DNA, 26 bp, Homo sapiens
ccgcaggtgcagatcttggtggtagt

SEQ ID NO: 46651 - DNA, 24 bp, Homo sapiens
cgcaggtgcagatcttggtggtag

SEQ ID NO: 46652 - DNA, 25 bp, Homo sapiens
cgcaggtgcagatcttggtggtagt

SEQ ID NO: 46653 - DNA, 29 bp, Homo sapiens
cgcaggtgcagatcttggtggtagtagca

SEQ ID NO: 46654 - DNA, 21 bp, Homo sapiens
gcaggtgcagatcttggtggt

SEQ ID NO: 46655 - DNA, 22 bp, Homo sapiens
gcaggtgcagatcttggtggta

SEQ ID NO: 46656 - DNA, 23 bp, Homo sapiens
gcaggtgcagatcttggtggtag

SEQ ID NO: 46657 - DNA, 24 bp, Homo sapiens
gcaggtgcagatcttggtggtagt

SEQ ID NO: 46658 - DNA, 27 bp, Homo sapiens
gcaggtgcagatcttggtggtagtagc

SEQ ID NO: 46659 - DNA, 28 bp, Homo sapiens
gcaggtgcagatcttggtggtagtagca

SEQ ID NO: 46660 - DNA, 29 bp, Homo sapiens
gcaggtgcagatcttggtggtagtagcaa

SEQ ID NO: 46661 - DNA, 16 bp, Homo sapiens
caggtgcagatcttgg

SEQ ID NO: 46662 - DNA, 19 bp, Homo sapiens
caggtgcagatcttggtgg

SEQ ID NO: 46663 - DNA, 20 bp, Homo sapiens
caggtgcagatcttggtggt

SEQ ID NO: 46664 - DNA, 21 bp, Homo sapiens
caggtgcagatcttggtggta

SEQ ID NO: 46665 - DNA, 22 bp, Homo sapiens
caggtgcagatcttggtggtag

SEQ ID NO: 46666 - DNA, 23 bp, Homo sapiens
caggtgcagatcttggtggtagt

SEQ ID NO: 46667 - DNA, 27 bp, Homo sapiens
caggtgcagatcttggtggtagtagca

SEQ ID NO: 46668 - DNA, 28 bp, Homo sapiens
caggtgcagatcttggtggtagtagcaa

SEQ ID NO: 46669 - DNA, 29 bp, Homo sapiens
caggtgcagatcttggtggtagtagcaaa

SEQ ID NO: 46670 - DNA, 20 bp, Homo sapiens
aggtgcagatcttggtggta

SEQ ID NO: 46671 - DNA, 21 bp, Homo sapiens
aggtgcagatcttggtggtag

SEQ ID NO: 46672 - DNA, 22 bp, Homo sapiens
aggtgcagatcttggtggtagt

SEQ ID NO: 46673 - DNA, 26 bp, Homo sapiens
aggtgcagatcttggtggtagtagca

SEQ ID NO: 46674 - DNA, 27 bp, Homo sapiens
aggtgcagatcttggtggtagtagcaa

SEQ ID NO: 46675 - DNA, 28 bp, Homo sapiens
aggtgcagatcttggtggtagtagcaaa

SEQ ID NO: 46676 - DNA, 29 bp, Homo sapiens
aggtgcagatcttggtggtagtagcaaat

SEQ ID NO: 46677 - DNA, 17 bp, Homo sapiens
ggtgcagatcttggtgg

SEQ ID NO: 46678 - DNA, 18 bp, Homo sapiens
ggtgcagatcttggtggt

SEQ ID NO: 46679 - DNA, 19 bp, Homo sapiens
ggtgcagatcttggtggta

SEQ ID NO: 46680 - DNA, 20 bp, Homo sapiens
ggtgcagatcttggtggtag

SEQ ID NO: 46681 - DNA, 21 bp, Homo sapiens
ggtgcagatcttggtggtagt

SEQ ID NO: 46682 - DNA, 23 bp, Homo sapiens
ggtgcagatcttggtggtagtag

SEQ ID NO: 46683 - DNA, 24 bp, Homo sapiens
ggtgcagatcttggtggtagtagc

SEQ ID NO: 46684 - DNA, 25 bp, Homo sapiens
ggtgcagatcttggtggtagtagca

SEQ ID NO: 46685 - DNA, 26 bp, Homo sapiens
ggtgcagatcttggtggtagtagcaa

SEQ ID NO: 46686 - DNA, 27 bp, Homo sapiens
ggtgcagatcttggtggtagtagcaaa

SEQ ID NO: 46687 - DNA, 28 bp, Homo sapiens
ggtgcagatcttggtggtagtagcaaat

SEQ ID NO: 46688 - DNA, 29 bp, Homo sapiens
ggtgcagatcttggtggtagtagcaaata

SEQ ID NO: 46689 - DNA, 16 bp, Homo sapiens
gtgcagatcttggtgg

SEQ ID NO: 46690 - DNA, 17 bp, Homo sapiens
gtgcagatcttggtggt

SEQ ID NO: 46691 - DNA, 18 bp, Homo sapiens
gtgcagatcttggtggta

SEQ ID NO: 46692 - DNA, 19 bp, Homo sapiens
gtgcagatcttggtggtag

SEQ ID NO: 46693 - DNA, 20 bp, Homo sapiens
gtgcagatcttggtggtagt

SEQ ID NO: 46694 - DNA, 21 bp, Homo sapiens
gtgcagatcttggtggtagta

SEQ ID NO: 46695 - DNA, 22 bp, Homo sapiens
gtgcagatcttggtggtagtag

SEQ ID NO: 46696 - DNA, 23 bp, Homo sapiens
gtgcagatcttggtggtagtagc

SEQ ID NO: 46697 - DNA, 24 bp, Homo sapiens
gtgcagatcttggtggtagtagca

SEQ ID NO: 46698 - DNA, 25 bp, Homo sapiens
gtgcagatcttggtggtagtagcaa

SEQ ID NO: 46699 - DNA, 26 bp, Homo sapiens
gtgcagatcttggtggtagtagcaaa

SEQ ID NO: 46700 - DNA, 27 bp, Homo sapiens
gtgcagatcttggtggtagtagcaaat

SEQ ID NO: 46701 - DNA, 28 bp, Homo sapiens
gtgcagatcttggtggtagtagcaaata

SEQ ID NO: 46702 - DNA, 30 bp, Homo sapiens
gtgcagatcttggtggtagtagcaaatatt

SEQ ID NO: 46703 - DNA, 16 bp, Homo sapiens
tgcagatcttggtggt

SEQ ID NO: 46704 - DNA, 17 bp, Homo sapiens
tgcagatcttggtggta

SEQ ID NO: 46705 - DNA, 18 bp, Homo sapiens
tgcagatcttggtggtag

SEQ ID NO: 46706 - DNA, 19 bp, Homo sapiens
tgcagatcttggtggtagt

SEQ ID NO: 46707 - DNA, 20 bp, Homo sapiens
tgcagatcttggtggtagta

SEQ ID NO: 46708 - DNA, 21 bp, Homo sapiens
tgcagatcttggtggtagtag

SEQ ID NO: 46709 - DNA, 22 bp, Homo sapiens
tgcagatcttggtggtagtagc

SEQ ID NO: 46710 - DNA, 23 bp, Homo sapiens
tgcagatcttggtggtagtagca

SEQ ID NO: 46711 - DNA, 24 bp, Homo sapiens
tgcagatcttggtggtagtagcaa

SEQ ID NO: 46712 - DNA, 25 bp, Homo sapiens
tgcagatcttggtggtagtagcaaa

SEQ ID NO: 46713 - DNA, 26 bp, Homo sapiens
tgcagatcttggtggtagtagcaaat

SEQ ID NO: 46714 - DNA, 27 bp, Homo sapiens
tgcagatcttggtggtagtagcaaata

SEQ ID NO: 46715 - DNA, 29 bp, Homo sapiens
tgcagatcttggtggtagtagcaaatatt

SEQ ID NO: 46716 - DNA, 30 bp, Homo sapiens
tgcagatcttggtggtagtagcaaatattc

SEQ ID NO: 46717 - DNA, 17 bp, Homo sapiens
gcagatcttggtggtag

SEQ ID NO: 46718 - DNA, 18 bp, Homo sapiens
gcagatcttggtggtagt

SEQ ID NO: 46719 - DNA, 20 bp, Homo sapiens
gcagatcttggtggtagtag

SEQ ID NO: 46720 - DNA, 21 bp, Homo sapiens
gcagatcttggtggtagtagc

SEQ ID NO: 46721 - DNA, 22 bp, Homo sapiens
gcagatcttggtggtagtagca

SEQ ID NO: 46722 - DNA, 23 bp, Homo sapiens
gcagatcttggtggtagtagcaa

SEQ ID NO: 46723 - DNA, 24 bp, Homo sapiens
gcagatcttggtggtagtagcaaa

SEQ ID NO: 46724 - DNA, 25 bp, Homo sapiens
gcagatcttggtggtagtagcaaat

SEQ ID NO: 46725 - DNA, 26 bp, Homo sapiens
gcagatcttggtggtagtagcaaata

SEQ ID NO: 46726 - DNA, 28 bp, Homo sapiens
gcagatcttggtggtagtagcaaatatt

SEQ ID NO: 46727 - DNA, 29 bp, Homo sapiens
gcagatcttggtggtagtagcaaatattc

SEQ ID NO: 46728 - DNA, 16 bp, Homo sapiens
cagatcttggtggtag

SEQ ID NO: 46729 - DNA, 17 bp, Homo sapiens
cagatcttggtggtagt

SEQ ID NO: 46730 - DNA, 19 bp, Homo sapiens
cagatcttggtggtagtag

SEQ ID NO: 46731 - DNA, 20 bp, Homo sapiens
cagatcttggtggtagtagc

SEQ ID NO: 46732 - DNA, 21 bp, Homo sapiens
cagatcttggtggtagtagca

SEQ ID NO: 46733 - DNA, 22 bp, Homo sapiens
cagatcttggtggtagtagcaa

SEQ ID NO: 46734 - DNA, 23 bp, Homo sapiens
cagatcttggtggtagtagcaaa

SEQ ID NO: 46735 - DNA, 24 bp, Homo sapiens
cagatcttggtggtagtagcaaat

SEQ ID NO: 46736 - DNA, 25 bp, Homo sapiens
cagatcttggtggtagtagcaaata

SEQ ID NO: 46737 - DNA, 26 bp, Homo sapiens
cagatcttggtggtagtagcaaatat

SEQ ID NO: 46738 - DNA, 27 bp, Homo sapiens
cagatcttggtggtagtagcaaatatt

SEQ ID NO: 46739 - DNA, 29 bp, Homo sapiens
cagatcttggtggtagtagcaaatattca

SEQ ID NO: 46740 - DNA, 16 bp, Homo sapiens
agatcttggtggtagt

SEQ ID NO: 46741 - DNA, 17 bp, Homo sapiens
agatcttggtggtagta

SEQ ID NO: 46742 - DNA, 18 bp, Homo sapiens
agatcttggtggtagtag

SEQ ID NO: 46743 - DNA, 19 bp, Homo sapiens
agatcttggtggtagtagc

SEQ ID NO: 46744 - DNA, 20 bp, Homo sapiens
agatcttggtggtagtagca

SEQ ID NO: 46745 - DNA, 21 bp, Homo sapiens
agatcttggtggtagtagcaa

SEQ ID NO: 46746 - DNA, 22 bp, Homo sapiens
agatcttggtggtagtagcaaa

SEQ ID NO: 46747 - DNA, 23 bp, Homo sapiens
agatcttggtggtagtagcaaat

SEQ ID NO: 46748 - DNA, 24 bp, Homo sapiens
agatcttggtggtagtagcaaata

SEQ ID NO: 46749 - DNA, 18 bp, Homo sapiens
gatcttggtggtagtagc

SEQ ID NO: 46750 - DNA, 19 bp, Homo sapiens
gatcttggtggtagtagca

SEQ ID NO: 46751 - DNA, 20 bp, Homo sapiens
gatcttggtggtagtagcaa

SEQ ID NO: 46752 - DNA, 21 bp, Homo sapiens
gatcttggtggtagtagcaaa

SEQ ID NO: 46753 - DNA, 22 bp, Homo sapiens
gatcttggtggtagtagcaaat

SEQ ID NO: 46754 - DNA, 23 bp, Homo sapiens
gatcttggtggtagtagcaaata

SEQ ID NO: 46755 - DNA, 25 bp, Homo sapiens
gatcttggtggtagtagcaaatatt

SEQ ID NO: 46756 - DNA, 29 bp, Homo sapiens
gtagtagcaaatattcaaacgagaacttt

SEQ ID NO: 46757 - DNA, 30 bp, Homo sapiens
gtagcaaatattcaaacgagaactttgaag

SEQ ID NO: 46758 - DNA, 22 bp, Homo sapiens
aatattcaaacgagaactttga

SEQ ID NO: 46759 - DNA, 26 bp, Homo sapiens
aatattcaaacgagaactttgaaggc

SEQ ID NO: 46760 - DNA, 29 bp, Homo sapiens
aatattcaaacgagaactttgaaggccga

SEQ ID NO: 46761 - DNA, 20 bp, Homo sapiens
atattcaaacgagaactttg

SEQ ID NO: 46762 - DNA, 21 bp, Homo sapiens
atattcaaacgagaactttga

SEQ ID NO: 46763 - DNA, 23 bp, Homo sapiens
atattcaaacgagaactttgaag

SEQ ID NO: 46764 - DNA, 25 bp, Homo sapiens
atattcaaacgagaactttgaaggc

SEQ ID NO: 46765 - DNA, 26 bp, Homo sapiens
atattcaaacgagaactttgaaggcc

SEQ ID NO: 46766 - DNA, 27 bp, Homo sapiens
atattcaaacgagaactttgaaggccg

SEQ ID NO: 46767 - DNA, 28 bp, Homo sapiens
atattcaaacgagaactttgaaggccga

SEQ ID NO: 46768 - DNA, 30 bp, Homo sapiens; identical to SEQ ID NO: 4751

SEQ ID NO: 46769 - DNA, 19 bp, Homo sapiens
tattcaaacgagaactttg

SEQ ID NO: 46770 - DNA, 20 bp, Homo sapiens
tattcaaacgagaactttga

SEQ ID NO: 46771 - DNA, 24 bp, Homo sapiens
tattcaaacgagaactttgaaggc

SEQ ID NO: 46772 - DNA, 25 bp, Homo sapiens
tattcaaacgagaactttgaaggcc

SEQ ID NO: 46773 - DNA, 26 bp, Homo sapiens
tattcaaacgagaactttgaaggccg

SEQ ID NO: 46774 - DNA, 27 bp, Homo sapiens
tattcaaacgagaactttgaaggccga

SEQ ID NO: 46775 - DNA, 30 bp, Homo sapiens; identical to SEQ ID NO: 22303

SEQ ID NO: 46776 - DNA, 17 bp, Homo sapiens
attcaaacgagaacttt

SEQ ID NO: 46777 - DNA, 18 bp, Homo sapiens
attcaaacgagaactttg

SEQ ID NO: 46778 - DNA, 19 bp, Homo sapiens
attcaaacgagaactttga

SEQ ID NO: 46779 - DNA, 20 bp, Homo sapiens
attcaaacgagaactttgaa

SEQ ID NO: 46780 - DNA, 21 bp, Homo sapiens
attcaaacgagaactttgaag

SEQ ID NO: 46781 - DNA, 22 bp, Homo sapiens
attcaaacgagaactttgaagg

SEQ ID NO: 46782 - DNA, 23 bp, Homo sapiens
attcaaacgagaactttgaaggc

SEQ ID NO: 46783 - DNA, 24 bp, Homo sapiens
attcaaacgagaactttgaaggcc

SEQ ID NO: 46784 - DNA, 25 bp, Homo sapiens
attcaaacgagaactttgaaggccg

SEQ ID NO: 46785 - DNA, 26 bp, Homo sapiens
attcaaacgagaactttgaaggccga

SEQ ID NO: 46786 - DNA, 27 bp, Homo sapiens
attcaaacgagaactttgaaggccgaa

SEQ ID NO: 46787 - DNA, 28 bp, Homo sapiens
attcaaacgagaactttgaaggccgaag

SEQ ID NO: 46788 - DNA, 30 bp, Homo sapiens; identical to SEQ ID NO: 4759

SEQ ID NO: 46789 - DNA, 17 bp, Homo sapiens
ttcaaacgagaactttg

SEQ ID NO: 46790 - DNA, 18 bp, Homo sapiens
ttcaaacgagaactttga

SEQ ID NO: 46791 - DNA, 19 bp, Homo sapiens
ttcaaacgagaactttgaa

SEQ ID NO: 46792 - DNA, 20 bp, Homo sapiens
ttcaaacgagaactttgaag

SEQ ID NO: 46793 - DNA, 21 bp, Homo sapiens
ttcaaacgagaactttgaagg

SEQ ID NO: 46794 - DNA, 22 bp, Homo sapiens
ttcaaacgagaactttgaaggc

SEQ ID NO: 46795 - DNA, 23 bp, Homo sapiens
ttcaaacgagaactttgaaggcc

SEQ ID NO: 46796 - DNA, 24 bp, Homo sapiens
ttcaaacgagaactttgaaggccg

SEQ ID NO: 46797 - DNA, 25 bp, Homo sapiens
ttcaaacgagaactttgaaggccga

SEQ ID NO: 46798 - DNA, 26 bp, Homo sapiens
ttcaaacgagaactttgaaggccgaa

SEQ ID NO: 46799 - DNA, 27 bp, Homo sapiens
ttcaaacgagaactttgaaggccgaag

SEQ ID NO: 46800 - DNA, 30 bp, Homo sapiens; identical to SEQ ID NO: 22327

SEQ ID NO: 46801 - DNA, 16 bp, Homo sapiens
tcaaacgagaactttg

SEQ ID NO: 46802 - DNA, 17 bp, Homo sapiens
tcaaacgagaactttga

SEQ ID NO: 46803 - DNA, 18 bp, Homo sapiens
tcaaacgagaactttgaa

SEQ ID NO: 46804 - DNA, 19 bp, Homo sapiens
tcaaacgagaactttgaag

SEQ ID NO: 46805 - DNA, 20 bp, Homo sapiens
tcaaacgagaactttgaagg

SEQ ID NO: 46806 - DNA, 21 bp, Homo sapiens
tcaaacgagaactttgaaggc

SEQ ID NO: 46807 - DNA, 22 bp, Homo sapiens
tcaaacgagaactttgaaggcc

SEQ ID NO: 46808 - DNA, 23 bp, Homo sapiens
tcaaacgagaactttgaaggccg

SEQ ID NO: 46809 - DNA, 24 bp, Homo sapiens
tcaaacgagaactttgaaggccga

SEQ ID NO: 46810 - DNA, 25 bp, Homo sapiens
tcaaacgagaactttgaaggccgaa

SEQ ID NO: 46811 - DNA, 26 bp, Homo sapiens
tcaaacgagaactttgaaggccgaag

SEQ ID NO: 46812 - DNA, 29 bp, Homo sapiens
tcaaacgagaactttgaaggccgaagtgg

SEQ ID NO: 46813 - DNA, 16 bp, Homo sapiens
caaacgagaactttga

SEQ ID NO: 46814 - DNA, 17 bp, Homo sapiens
caaacgagaactttgaa

SEQ ID NO: 46815 - DNA, 18 bp, Homo sapiens
caaacgagaactttgaag

SEQ ID NO: 46816 - DNA, 19 bp, Homo sapiens
caaacgagaactttgaagg

SEQ ID NO: 46817 - DNA, 20 bp, Homo sapiens
caaacgagaactttgaaggc

SEQ ID NO: 46818 - DNA, 21 bp, Homo sapiens
caaacgagaactttgaaggcc

SEQ ID NO: 46819 - DNA, 22 bp, Homo sapiens
caaacgagaactttgaaggccg

SEQ ID NO: 46820 - DNA, 23 bp, Homo sapiens
caaacgagaactttgaaggccga

SEQ ID NO: 46821 - DNA, 24 bp, Homo sapiens
caaacgagaactttgaaggccgaa

SEQ ID NO: 46822 - DNA, 25 bp, Homo sapiens
caaacgagaactttgaaggccgaag

SEQ ID NO: 46823 - DNA, 26 bp, Homo sapiens
caaacgagaactttgaaggccgaagt

SEQ ID NO: 46824 - DNA, 27 bp, Homo sapiens
caaacgagaactttgaaggccgaagtg

SEQ ID NO: 46825 - DNA, 28 bp, Homo sapiens
caaacgagaactttgaaggccgaagtgg

SEQ ID NO: 46826 - DNA, 29 bp, Homo sapiens
caaacgagaactttgaaggccgaagtgga

SEQ ID NO: 46827 - DNA, 30 bp, Homo sapiens; identical to SEQ ID NO: 22365

SEQ ID NO: 46828 - DNA, 16 bp, Homo sapiens
aaacgagaactttgaa

SEQ ID NO: 46829 - DNA, 17 bp, Homo sapiens
aaacgagaactttgaag

SEQ ID NO: 46830 - DNA, 18 bp, Homo sapiens
aaacgagaactttgaagg

SEQ ID NO: 46831 - DNA, 19 bp, Homo sapiens
aaacgagaactttgaaggc

SEQ ID NO: 46832 - DNA, 20 bp, Homo sapiens
aaacgagaactttgaaggcc

SEQ ID NO: 46833 - DNA, 21 bp, Homo sapiens
aaacgagaactttgaaggccg

SEQ ID NO: 46834 - DNA, 22 bp, Homo sapiens
aaacgagaactttgaaggccga

SEQ ID NO: 46835 - DNA, 23 bp, Homo sapiens
aaacgagaactttgaaggccgaa

SEQ ID NO: 46836 - DNA, 24 bp, Homo sapiens
aaacgagaactttgaaggccgaag

SEQ ID NO: 46837 - DNA, 27 bp, Homo sapiens
aaacgagaactttgaaggccgaagtgg

SEQ ID NO: 46838 - DNA, 28 bp, Homo sapiens
aaacgagaactttgaaggccgaagtgga

SEQ ID NO: 46839 - DNA, 29 bp, Homo sapiens
aaacgagaactttgaaggccgaagtggag

SEQ ID NO: 46840 - DNA, 16 bp, Homo sapiens
aacgagaactttgaag

SEQ ID NO: 46841 - DNA, 17 bp, Homo sapiens
aacgagaactttgaagg

SEQ ID NO: 46842 - DNA, 18 bp, Homo sapiens
aacgagaactttgaaggc

SEQ ID NO: 46843 - DNA, 19 bp, Homo sapiens
aacgagaactttgaaggcc

SEQ ID NO: 46844 - DNA, 20 bp, Homo sapiens
aacgagaactttgaaggccg

SEQ ID NO: 46845 - DNA, 21 bp, Homo sapiens
aacgagaactttgaaggccga

SEQ ID NO: 46846 - DNA, 22 bp, Homo sapiens
aacgagaactttgaaggccgaa

SEQ ID NO: 46847 - DNA, 23 bp, Homo sapiens
aacgagaactttgaaggccgaag

SEQ ID NO: 46848 - DNA, 25 bp, Homo sapiens
aacgagaactttgaaggccgaagtg

SEQ ID NO: 46849 - DNA, 26 bp, Homo sapiens
aacgagaactttgaaggccgaagtgg

SEQ ID NO: 46850 - DNA, 27 bp, Homo sapiens
aacgagaactttgaaggccgaagtgga

SEQ ID NO: 46851 - DNA, 28 bp, Homo sapiens
aacgagaactttgaaggccgaagtggag

SEQ ID NO: 46852 - DNA, 29 bp, Homo sapiens
aacgagaactttgaaggccgaagtggaga

SEQ ID NO: 46853 - DNA, 30 bp, Homo sapiens; identical to SEQ ID NO: 4826

SEQ ID NO: 46854 - DNA, 16 bp, Homo sapiens
acgagaactttgaagg

SEQ ID NO: 46855 - DNA, 17 bp, Homo sapiens
acgagaactttgaaggc

SEQ ID NO: 46856 - DNA, 18 bp, Homo sapiens
acgagaactttgaaggcc

SEQ ID NO: 46857 - DNA, 19 bp, Homo sapiens
acgagaactttgaaggccg

SEQ ID NO: 46858 - DNA, 20 bp, Homo sapiens
acgagaactttgaaggccga

SEQ ID NO: 46859 - DNA, 21 bp, Homo sapiens
acgagaactttgaaggccgaa

SEQ ID NO: 46860 - DNA, 22 bp, Homo sapiens
acgagaactttgaaggccgaag

SEQ ID NO: 46861 - DNA, 23 bp, Homo sapiens
acgagaactttgaaggccgaagt

SEQ ID NO: 46862 - DNA, 24 bp, Homo sapiens
acgagaactttgaaggccgaagtg

SEQ ID NO: 46863 - DNA, 25 bp, Homo sapiens
acgagaactttgaaggccgaagtgg

SEQ ID NO: 46864 - DNA, 26 bp, Homo sapiens
acgagaactttgaaggccgaagtgga

SEQ ID NO: 46865 - DNA, 27 bp, Homo sapiens
acgagaactttgaaggccgaagtggag

SEQ ID NO: 46866 - DNA, 28 bp, Homo sapiens
acgagaactttgaaggccgaagtggaga

SEQ ID NO: 46867 - DNA, 29 bp, Homo sapiens
acgagaactttgaaggccgaagtggagaa

SEQ ID NO: 46868 - DNA, 30 bp, Homo sapiens; identical to SEQ ID NO: 4843

SEQ ID NO: 46869 - DNA, 16 bp, Homo sapiens
cgagaactttgaaggc

SEQ ID NO: 46870 - DNA, 17 bp, Homo sapiens
cgagaactttgaaggcc

SEQ ID NO: 46871 - DNA, 18 bp, Homo sapiens
cgagaactttgaaggccg

SEQ ID NO: 46872 - DNA, 19 bp, Homo sapiens
cgagaactttgaaggccga

SEQ ID NO: 46873 - DNA, 20 bp, Homo sapiens
cgagaactttgaaggccgaa

SEQ ID NO: 46874 - DNA, 21 bp, Homo sapiens
cgagaactttgaaggccgaag

SEQ ID NO: 46875 - DNA, 22 bp, Homo sapiens
cgagaactttgaaggccgaagt

SEQ ID NO: 46876 - DNA, 23 bp, Homo sapiens
cgagaactttgaaggccgaagtg

SEQ ID NO: 46877 - DNA, 24 bp, Homo sapiens
cgagaactttgaaggccgaagtgg

SEQ ID NO: 46878 - DNA, 25 bp, Homo sapiens
cgagaactttgaaggccgaagtgga

SEQ ID NO: 46879 - DNA, 26 bp, Homo sapiens
cgagaactttgaaggccgaagtggag

SEQ ID NO: 46880 - DNA, 27 bp, Homo sapiens
cgagaactttgaaggccgaagtggaga

SEQ ID NO: 46881 - DNA, 28 bp, Homo sapiens
cgagaactttgaaggccgaagtggagaa

SEQ ID NO: 46882 - DNA, 29 bp, Homo sapiens
cgagaactttgaaggccgaagtggagaag

SEQ ID NO: 46883 - DNA, 30 bp, Homo sapiens; identical to SEQ ID NO: 4856

SEQ ID NO: 46884 - DNA, 16 bp, Homo sapiens
gagaactttgaaggcc

SEQ ID NO: 46885 - DNA, 17 bp, Homo sapiens
gagaactttgaaggccg

SEQ ID NO: 46886 - DNA, 18 bp, Homo sapiens
gagaactttgaaggccga

SEQ ID NO: 46887 - DNA, 19 bp, Homo sapiens
gagaactttgaaggccgaa

SEQ ID NO: 46888 - DNA, 20 bp, Homo sapiens
gagaactttgaaggccgaag

SEQ ID NO: 46889 - DNA, 21 bp, Homo sapiens
gagaactttgaaggccgaagt

SEQ ID NO: 46890 - DNA, 22 bp, Homo sapiens
gagaactttgaaggccgaagtg

SEQ ID NO: 46891 - DNA, 23 bp, Homo sapiens
gagaactttgaaggccgaagtgg

SEQ ID NO: 46892 - DNA, 24 bp, Homo sapiens
gagaactttgaaggccgaagtgga

SEQ ID NO: 46893 - DNA, 25 bp, Homo sapiens
gagaactttgaaggccgaagtggag

SEQ ID NO: 46894 - DNA, 26 bp, Homo sapiens
gagaactttgaaggccgaagtggaga

SEQ ID NO: 46895 - DNA, 27 bp, Homo sapiens
gagaactttgaaggccgaagtggagaa

SEQ ID NO: 46896 - DNA, 28 bp, Homo sapiens
gagaactttgaaggccgaagtggagaag

SEQ ID NO: 46897 - DNA, 29 bp, Homo sapiens
gagaactttgaaggccgaagtggagaagg

SEQ ID NO: 46898 - DNA, 30 bp, Homo sapiens
gagaactttgaaggccgaagtggagaaggg

SEQ ID NO: 46899 - DNA, 16 bp, Homo sapiens
agaactttgaaggccg

SEQ ID NO: 46900 - DNA, 17 bp, Homo sapiens
agaactttgaaggccga

SEQ ID NO: 46901 - DNA, 18 bp, Homo sapiens
agaactttgaaggccgaa

SEQ ID NO: 46902 - DNA, 19 bp, Homo sapiens
agaactttgaaggccgaag

SEQ ID NO: 46903 - DNA, 20 bp, Homo sapiens
agaactttgaaggccgaagt

SEQ ID NO: 46904 - DNA, 21 bp, Homo sapiens
agaactttgaaggccgaagtg

SEQ ID NO: 46905 - DNA, 22 bp, Homo sapiens
agaactttgaaggccgaagtgg

SEQ ID NO: 46906 - DNA, 23 bp, Homo sapiens
agaactttgaaggccgaagtgga

SEQ ID NO: 46907 - DNA, 24 bp, Homo sapiens
agaactttgaaggccgaagtggag

SEQ ID NO: 46908 - DNA, 25 bp, Homo sapiens
agaactttgaaggccgaagtggaga

SEQ ID NO: 46909 - DNA, 26 bp, Homo sapiens
agaactttgaaggccgaagtggagaa

SEQ ID NO: 46910 - DNA, 27 bp, Homo sapiens
agaactttgaaggccgaagtggagaag

SEQ ID NO: 46911 - DNA, 28 bp, Homo sapiens
agaactttgaaggccgaagtggagaagg

SEQ ID NO: 46912 - DNA, 29 bp, Homo sapiens
agaactttgaaggccgaagtggagaaggg

SEQ ID NO: 46913 - DNA, 30 bp, Homo sapiens; identical to SEQ ID NO: 4865

SEQ ID NO: 46914 - DNA, 16 bp, Homo sapiens
gaactttgaaggccga

SEQ ID NO: 46915 - DNA, 17 bp, Homo sapiens
gaactttgaaggccgaa

SEQ ID NO: 46916 - DNA, 18 bp, Homo sapiens
gaactttgaaggccgaag

SEQ ID NO: 46917 - DNA, 19 bp, Homo sapiens
gaactttgaaggccgaagt

SEQ ID NO: 46918 - DNA, 20 bp, Homo sapiens
gaactttgaaggccgaagtg

SEQ ID NO: 46919 - DNA, 21 bp, Homo sapiens
gaactttgaaggccgaagtgg

SEQ ID NO: 46920 - DNA, 22 bp, Homo sapiens
gaactttgaaggccgaagtgga

SEQ ID NO: 46921 - DNA, 23 bp, Homo sapiens
gaactttgaaggccgaagtggag

SEQ ID NO: 46922 - DNA, 24 bp, Homo sapiens
gaactttgaaggccgaagtggaga

SEQ ID NO: 46923 - DNA, 25 bp, Homo sapiens
gaactttgaaggccgaagtggagaa

SEQ ID NO: 46924 - DNA, 26 bp, Homo sapiens
gaactttgaaggccgaagtggagaag

SEQ ID NO: 46925 - DNA, 27 bp, Homo sapiens
gaactttgaaggccgaagtggagaagg

SEQ ID NO: 46926 - DNA, 28 bp, Homo sapiens
gaactttgaaggccgaagtggagaaggg

SEQ ID NO: 46927 - DNA, 30 bp, Homo sapiens
gaactttgaaggccgaagtggagaagggtt

SEQ ID NO: 46928 - DNA, 17 bp, Homo sapiens
aactttgaaggccgaag

SEQ ID NO: 46929 - DNA, 18 bp, Homo sapiens
aactttgaaggccgaagt

SEQ ID NO: 46930 - DNA, 20 bp, Homo sapiens
aactttgaaggccgaagtgg

SEQ ID NO: 46931 - DNA, 22 bp, Homo sapiens
aactttgaaggccgaagtggag

SEQ ID NO: 46932 - DNA, 16 bp, Homo sapiens
actttgaaggccgaag

SEQ ID NO: 46933 - DNA, 17 bp, Homo sapiens
actttgaaggccgaagt

SEQ ID NO: 46934 - DNA, 19 bp, Homo sapiens
actttgaaggccgaagtgg

SEQ ID NO: 46935 - DNA, 21 bp, Homo sapiens
actttgaaggccgaagtggag

SEQ ID NO: 46936 - DNA, 22 bp, Homo sapiens
actttgaaggccgaagtggaga

SEQ ID NO: 46937 - DNA, 16 bp, Homo sapiens
ctttgaaggccgaagt

SEQ ID NO: 46938 - DNA, 17 bp, Homo sapiens
ctttgaaggccgaagtg

SEQ ID NO: 46939 - DNA, 18 bp, Homo sapiens
ctttgaaggccgaagtgg

SEQ ID NO: 46940 - DNA, 20 bp, Homo sapiens
ctttgaaggccgaagtggag

SEQ ID NO: 46941 - DNA, 21 bp, Homo sapiens
ctttgaaggccgaagtggaga

SEQ ID NO: 46942 - DNA, 22 bp, Homo sapiens
ctttgaaggccgaagtggagaa

SEQ ID NO: 46943 - DNA, 23 bp, Homo sapiens
ctttgaaggccgaagtggagaag

SEQ ID NO: 46944 - DNA, 24 bp, Homo sapiens
ctttgaaggccgaagtggagaagg

SEQ ID NO: 46945 - DNA, 25 bp, Homo sapiens
ctttgaaggccgaagtggagaaggg

SEQ ID NO: 46946 - DNA, 26 bp, Homo sapiens
ctttgaaggccgaagtggagaagggt

SEQ ID NO: 46947 - DNA, 27 bp, Homo sapiens
ctttgaaggccgaagtggagaagggtt

SEQ ID NO: 46948 - DNA, 28 bp, Homo sapiens
ctttgaaggccgaagtggagaagggttc

SEQ ID NO: 46949 - DNA, 29 bp, Homo sapiens
ctttgaaggccgaagtggagaagggttcc

SEQ ID NO: 46950 - DNA, 21 bp, Homo sapiens
ttgaaggccgaagtggagaag

SEQ ID NO: 46951 - DNA, 22 bp, Homo sapiens
ttgaaggccgaagtggagaagg

SEQ ID NO: 46952 - DNA, 23 bp, Homo sapiens
ttgaaggccgaagtggagaaggg

SEQ ID NO: 46953 - DNA, 24 bp, Homo sapiens
ttgaaggccgaagtggagaagggt

SEQ ID NO: 46954 - DNA, 25 bp, Homo sapiens
ttgaaggccgaagtggagaagggtt

SEQ ID NO: 46955 - DNA, 20 bp, Homo sapiens
tgaaggccgaagtggagaag

SEQ ID NO: 46956 - DNA, 21 bp, Homo sapiens
tgaaggccgaagtggagaagg

SEQ ID NO: 46957 - DNA, 22 bp, Homo sapiens
tgaaggccgaagtggagaaggg

SEQ ID NO: 46958 - DNA, 23 bp, Homo sapiens
tgaaggccgaagtggagaagggt

SEQ ID NO: 46959 - DNA, 19 bp, Homo sapiens
gaaggccgaagtggagaag

SEQ ID NO: 46960 - DNA, 20 bp, Homo sapiens
gaaggccgaagtggagaagg

SEQ ID NO: 46961 - DNA, 21 bp, Homo sapiens
gaaggccgaagtggagaaggg

SEQ ID NO: 46962 - DNA, 22 bp, Homo sapiens
gaaggccgaagtggagaagggt

SEQ ID NO: 46963 - DNA, 23 bp, Homo sapiens
gaaggccgaagtggagaagggtt

SEQ ID NO: 46964 - DNA, 16 bp, Homo sapiens
aaggccgaagtggaga

SEQ ID NO: 46965 - DNA, 17 bp, Homo sapiens
aaggccgaagtggagaa

SEQ ID NO: 46966 - DNA, 18 bp, Homo sapiens
aaggccgaagtggagaag

SEQ ID NO: 46967 - DNA, 19 bp, Homo sapiens
aaggccgaagtggagaagg

SEQ ID NO: 46968 - DNA, 20 bp, Homo sapiens
aaggccgaagtggagaaggg

SEQ ID NO: 46969 - DNA, 21 bp, Homo sapiens
aaggccgaagtggagaagggt

SEQ ID NO: 46970 - DNA, 22 bp, Homo sapiens
aaggccgaagtggagaagggtt

SEQ ID NO: 46971 - DNA, 23 bp, Homo sapiens
aaggccgaagtggagaagggttc

SEQ ID NO: 46972 - DNA, 17 bp, Homo sapiens
aggccgaagtggagaag

SEQ ID NO: 46973 - DNA, 18 bp, Homo sapiens
aggccgaagtggagaagg

SEQ ID NO: 46974 - DNA, 19 bp, Homo sapiens
aggccgaagtggagaaggg

SEQ ID NO: 46975 - DNA, 20 bp, Homo sapiens
aggccgaagtggagaagggt

SEQ ID NO: 46976 - DNA, 21 bp, Homo sapiens
aggccgaagtggagaagggtt

SEQ ID NO: 46977 - DNA, 23 bp, Homo sapiens
aggccgaagtggagaagggttcc

SEQ ID NO: 46978 - DNA, 24 bp, Homo sapiens
aggccgaagtggagaagggttcca

SEQ ID NO: 46979 - DNA, 16 bp, Homo sapiens
ggccgaagtggagaag

SEQ ID NO: 46980 - DNA, 17 bp, Homo sapiens
ggccgaagtggagaagg

SEQ ID NO: 46981 - DNA, 18 bp, Homo sapiens
ggccgaagtggagaaggg

SEQ ID NO: 46982 - DNA, 19 bp, Homo sapiens
ggccgaagtggagaagggt

SEQ ID NO: 46983 - DNA, 20 bp, Homo sapiens
ggccgaagtggagaagggtt

SEQ ID NO: 46984 - DNA, 21 bp, Homo sapiens
ggccgaagtggagaagggttc

SEQ ID NO: 46985 - DNA, 22 bp, Homo sapiens
ggccgaagtggagaagggttcc

SEQ ID NO: 46986 - DNA, 23 bp, Homo sapiens
ggccgaagtggagaagggttcca

SEQ ID NO: 46987 - DNA, 20 bp, Homo sapiens
gccgaagtggagaagggttc

SEQ ID NO: 46988 - DNA, 24 bp, Homo sapiens
gccgaagtggagaagggttccatg

SEQ ID NO: 46989 - DNA, 30 bp, Homo sapiens
ccgaagtggagaagggttccatgtgaacag

SEQ ID NO: 46990 - DNA, 30 bp, Homo sapiens
cgaagtggagaagggttccatgtgaacagc

SEQ ID NO: 46991 - DNA, 18 bp, Homo sapiens
gtggagaagggttccatg

SEQ ID NO: 46992 - DNA, 20 bp, Homo sapiens
gtggagaagggttccatgtg

SEQ ID NO: 46993 - DNA, 25 bp, Homo sapiens
gtggagaagggttccatgtgaacag

SEQ ID NO: 46994 - DNA, 30 bp, Homo sapiens; identical to SEQ ID NO: 29992

SEQ ID NO: 46995 - DNA, 19 bp, Homo sapiens
tggagaagggttccatgtg

SEQ ID NO: 46996 - DNA, 24 bp, Homo sapiens
tggagaagggttccatgtgaacag

SEQ ID NO: 46997 - DNA, 30 bp, Homo sapiens
tggagaagggttccatgtgaacagcagttg

SEQ ID NO: 46998 - DNA, 20 bp, Homo sapiens
ggagaagggttccatgtgaa

SEQ ID NO: 46999 - DNA, 21 bp, Homo sapiens
ggagaagggttccatgtgaac

SEQ ID NO: 47000 - DNA, 23 bp, Homo sapiens
ggagaagggttccatgtgaacag

SEQ ID NO: 47001 - DNA, 24 bp, Homo sapiens
ggagaagggttccatgtgaacagc

SEQ ID NO: 47002 - DNA, 27 bp, Homo sapiens
ggagaagggttccatgtgaacagcagt

SEQ ID NO: 47003 - DNA, 28 bp, Homo sapiens
ggagaagggttccatgtgaacagcagtt

SEQ ID NO: 47004 - DNA, 22 bp, Homo sapiens
gagaagggttccatgtgaacag

SEQ ID NO: 47005 - DNA, 23 bp, Homo sapiens
gagaagggttccatgtgaacagc

SEQ ID NO: 47006 - DNA, 26 bp, Homo sapiens
gagaagggttccatgtgaacagcagt

SEQ ID NO: 47007 - DNA, 27 bp, Homo sapiens
gagaagggttccatgtgaacagcagtt

SEQ ID NO: 47008 - DNA, 29 bp, Homo sapiens
gagaagggttccatgtgaacagcagttga

SEQ ID NO: 47009 - DNA, 22 bp, Homo sapiens
agggttccatgtgaacagcagt

SEQ ID NO: 47010 - DNA, 25 bp, Homo sapiens
agggttccatgtgaacagcagttga

SEQ ID NO: 47011 - DNA, 30 bp, Homo sapiens
agggttccatgtgaacagcagttgaacatg

SEQ ID NO: 47012 - DNA, 20 bp, Homo sapiens
ctgctgttcacatggaaccc

SEQ ID NO: 47013 - DNA, 30 bp, Homo sapiens
gggttccatgtgaacagcagttgaacatgg

SEQ ID NO: 47014 - DNA, 30 bp, Homo sapiens
gttccatgtgaacagcagttgaacatgggt

SEQ ID NO: 47015 - DNA, 16 bp, Homo sapiens
ccatgtgaacagcagt

SEQ ID NO: 47016 - DNA, 17 bp, Homo sapiens
ccatgtgaacagcagtt

SEQ ID NO: 47017 - DNA, 18 bp, Homo sapiens
ccatgtgaacagcagttg

SEQ ID NO: 47018 - DNA, 19 bp, Homo sapiens
ccatgtgaacagcagttga

SEQ ID NO: 47019 - DNA, 20 bp, Homo sapiens
ccatgtgaacagcagttgaa

SEQ ID NO: 47020 - DNA, 21 bp, Homo sapiens
ccatgtgaacagcagttgaac

SEQ ID NO: 47021 - DNA, 22 bp, Homo sapiens
ccatgtgaacagcagttgaaca

SEQ ID NO: 47022 - DNA, 23 bp, Homo sapiens
ccatgtgaacagcagttgaacat

SEQ ID NO: 47023 - DNA, 24 bp, Homo sapiens
ccatgtgaacagcagttgaacatg

SEQ ID NO: 47024 - DNA, 30 bp, Homo sapiens
ccatgtgaacagcagttgaacatgggtcag

SEQ ID NO: 47025 - DNA, 17 bp, Homo sapiens
catgtgaacagcagttg

SEQ ID NO: 47026 - DNA, 18 bp, Homo sapiens
catgtgaacagcagttga

SEQ ID NO: 47027 - DNA, 20 bp, Homo sapiens
catgtgaacagcagttgaac

SEQ ID NO: 47028 - DNA, 21 bp, Homo sapiens
catgtgaacagcagttgaaca

SEQ ID NO: 47029 - DNA, 22 bp, Homo sapiens
catgtgaacagcagttgaacat

SEQ ID NO: 47030 - DNA, 23 bp, Homo sapiens
catgtgaacagcagttgaacatg

SEQ ID NO: 47031 - DNA, 24 bp, Homo sapiens
catgtgaacagcagttgaacatgg

SEQ ID NO: 47032 - DNA, 25 bp, Homo sapiens
catgtgaacagcagttgaacatggg

SEQ ID NO: 47033 - DNA, 30 bp, Homo sapiens
catgtgaacagcagttgaacatgggtcagt

SEQ ID NO: 47034 - DNA, 30 bp, Homo sapiens; identical to SEQ ID NO: 22550

SEQ ID NO: 47035 - DNA, 30 bp, Homo sapiens
tgtgaacagcagttgaacatgggtcagtcg

SEQ ID NO: 47036 - DNA, 30 bp, Homo sapiens
gtgaacagcagttgaacatgggtcagtcgg

SEQ ID NO: 47037 - DNA, 29 bp, Homo sapiens
tgaacagcagttgaacatgggtcagtcgg

SEQ ID NO: 47038 - DNA, 30 bp, Homo sapiens
tgaacagcagttgaacatgggtcagtcggt

SEQ ID NO: 47039 - DNA, 28 bp, Homo sapiens
gaacagcagttgaacatgggtcagtcgg

SEQ ID NO: 47040 - DNA, 30 bp, Homo sapiens
gaacagcagttgaacatgggtcagtcggtc

SEQ ID NO: 47041 - DNA, 27 bp, Homo sapiens
aacagcagttgaacatgggtcagtcgg

SEQ ID NO: 47042 - DNA, 30 bp, Homo sapiens
aacagcagttgaacatgggtcagtcggtcc

SEQ ID NO: 47043 - DNA, 26 bp, Homo sapiens
acagcagttgaacatgggtcagtcgg

SEQ ID NO: 47044 - DNA, 30 bp, Homo sapiens; identical to SEQ ID NO: 4869

SEQ ID NO: 47045 - DNA, 24 bp, Homo sapiens
cagcagttgaacatgggtcagtcg

SEQ ID NO: 47046 - DNA, 25 bp, Homo sapiens
cagcagttgaacatgggtcagtcgg

SEQ ID NO: 47047 - DNA, 26 bp, Homo sapiens
cagcagttgaacatgggtcagtcggt

SEQ ID NO: 47048 - DNA, 27 bp, Homo sapiens
cagcagttgaacatgggtcagtcggtc

SEQ ID NO: 47049 - DNA, 28 bp, Homo sapiens
cagcagttgaacatgggtcagtcggtcc

SEQ ID NO: 47050 - DNA, 29 bp, Homo sapiens
cagcagttgaacatgggtcagtcggtcct

SEQ ID NO: 47051 - DNA, 30 bp, Homo sapiens; identical to SEQ ID NO: 4872

SEQ ID NO: 47052 - DNA, 23 bp, Homo sapiens
agcagttgaacatgggtcagtcg

SEQ ID NO: 47053 - DNA, 24 bp, Homo sapiens
agcagttgaacatgggtcagtcgg

SEQ ID NO: 47054 - DNA, 25 bp, Homo sapiens
agcagttgaacatgggtcagtcggt

SEQ ID NO: 47055 - DNA, 26 bp, Homo sapiens
agcagttgaacatgggtcagtcggtc

SEQ ID NO: 47056 - DNA, 27 bp, Homo sapiens
agcagttgaacatgggtcagtcggtcc

SEQ ID NO: 47057 - DNA, 28 bp, Homo sapiens
agcagttgaacatgggtcagtcggtcct

SEQ ID NO: 47058 - DNA, 29 bp, Homo sapiens
agcagttgaacatgggtcagtcggtcctg

SEQ ID NO: 47059 - DNA, 30 bp, Homo sapiens
agcagttgaacatgggtcagtcggtcctga

SEQ ID NO: 47060 - DNA, 21 bp, Homo sapiens
gcagttgaacatgggtcagtc

SEQ ID NO: 47061 - DNA, 22 bp, Homo sapiens
gcagttgaacatgggtcagtcg

SEQ ID NO: 47062 - DNA, 23 bp, Homo sapiens
gcagttgaacatgggtcagtcgg

SEQ ID NO: 47063 - DNA, 24 bp, Homo sapiens
gcagttgaacatgggtcagtcggt

SEQ ID NO: 47064 - DNA, 25 bp, Homo sapiens
gcagttgaacatgggtcagtcggtc

SEQ ID NO: 47065 - DNA, 26 bp, Homo sapiens
gcagttgaacatgggtcagtcggtcc

SEQ ID NO: 47066 - DNA, 27 bp, Homo sapiens
gcagttgaacatgggtcagtcggtcct

SEQ ID NO: 47067 - DNA, 28 bp, Homo sapiens
gcagttgaacatgggtcagtcggtcctg

SEQ ID NO: 47068 - DNA, 29 bp, Homo sapiens
gcagttgaacatgggtcagtcggtcctga

SEQ ID NO: 47069 - DNA, 30 bp, Homo sapiens; identical to SEQ ID NO: 22586

SEQ ID NO: 47070 - DNA, 18 bp, Homo sapiens
cagttgaacatgggtcag

SEQ ID NO: 47071 - DNA, 21 bp, Homo sapiens
cagttgaacatgggtcagtcg

SEQ ID NO: 47072 - DNA, 22 bp, Homo sapiens
cagttgaacatgggtcagtcgg

SEQ ID NO: 47073 - DNA, 23 bp, Homo sapiens
cagttgaacatgggtcagtcggt

SEQ ID NO: 47074 - DNA, 24 bp, Homo sapiens
cagttgaacatgggtcagtcggtc

SEQ ID NO: 47075 - DNA, 25 bp, Homo sapiens
cagttgaacatgggtcagtcggtcc

SEQ ID NO: 47076 - DNA, 26 bp, Homo sapiens
cagttgaacatgggtcagtcggtcct

SEQ ID NO: 47077 - DNA, 27 bp, Homo sapiens
cagttgaacatgggtcagtcggtcctg

SEQ ID NO: 47078 - DNA, 28 bp, Homo sapiens
cagttgaacatgggtcagtcggtcctga

SEQ ID NO: 47079 - DNA, 29 bp, Homo sapiens
cagttgaacatgggtcagtcggtcctgag

SEQ ID NO: 47080 - DNA, 30 bp, Homo sapiens; identical to SEQ ID NO: 22595

SEQ ID NO: 47081 - DNA, 21 bp, Homo sapiens
agttgaacatgggtcagtcgg

SEQ ID NO: 47082 - DNA, 22 bp, Homo sapiens
agttgaacatgggtcagtcggt

SEQ ID NO: 47083 - DNA, 23 bp, Homo sapiens
agttgaacatgggtcagtcggtc

SEQ ID NO: 47084 - DNA, 30 bp, Homo sapiens
agttgaacatgggtcagtcggtcctgagag

SEQ ID NO: 47085 - DNA, 19 bp, Homo sapiens
gttgaacatgggtcagtcg

SEQ ID NO: 47086 - DNA, 20 bp, Homo sapiens
gttgaacatgggtcagtcgg

SEQ ID NO: 47087 - DNA, 21 bp, Homo sapiens
gttgaacatgggtcagtcggt

SEQ ID NO: 47088 - DNA, 22 bp, Homo sapiens
gttgaacatgggtcagtcggtc

SEQ ID NO: 47089 - DNA, 23 bp, Homo sapiens
gttgaacatgggtcagtcggtcc

SEQ ID NO: 47090 - DNA, 24 bp, Homo sapiens
gttgaacatgggtcagtcggtcct

SEQ ID NO: 47091 - DNA, 25 bp, Homo sapiens
gttgaacatgggtcagtcggtcctg

SEQ ID NO: 47092 - DNA, 26 bp, Homo sapiens
gttgaacatgggtcagtcggtcctga

SEQ ID NO: 47093 - DNA, 27 bp, Homo sapiens
gttgaacatgggtcagtcggtcctgag

SEQ ID NO: 47094 - DNA, 28 bp, Homo sapiens
gttgaacatgggtcagtcggtcctgaga

SEQ ID NO: 47095 - DNA, 29 bp, Homo sapiens
gttgaacatgggtcagtcggtcctgagag

SEQ ID NO: 47096 - DNA, 19 bp, Homo sapiens
ttgaacatgggtcagtcgg

SEQ ID NO: 47097 - DNA, 20 bp, Homo sapiens
ttgaacatgggtcagtcggt

SEQ ID NO: 47098 - DNA, 21 bp, Homo sapiens
ttgaacatgggtcagtcggtc

SEQ ID NO: 47099 - DNA, 22 bp, Homo sapiens
ttgaacatgggtcagtcggtcc

SEQ ID NO: 47100 - DNA, 23 bp, Homo sapiens
ttgaacatgggtcagtcggtcct

SEQ ID NO: 47101 - DNA, 28 bp, Homo sapiens
ttgaacatgggtcagtcggtcctgagag

SEQ ID NO: 47102 - DNA, 29 bp, Homo sapiens
ttgaacatgggtcagtcggtcctgagaga

SEQ ID NO: 47103 - DNA, 18 bp, Homo sapiens
tgaacatgggtcagtcgg

SEQ ID NO: 47104 - DNA, 19 bp, Homo sapiens
tgaacatgggtcagtcggt

SEQ ID NO: 47105 - DNA, 20 bp, Homo sapiens
tgaacatgggtcagtcggtc

SEQ ID NO: 47106 - DNA, 21 bp, Homo sapiens
tgaacatgggtcagtcggtcc

SEQ ID NO: 47107 - DNA, 22 bp, Homo sapiens
tgaacatgggtcagtcggtcct

SEQ ID NO: 47108 - DNA, 23 bp, Homo sapiens
tgaacatgggtcagtcggtcctg

SEQ ID NO: 47109 - DNA, 24 bp, Homo sapiens
tgaacatgggtcagtcggtcctga

SEQ ID NO: 47110 - DNA, 25 bp, Homo sapiens
tgaacatgggtcagtcggtcctgag

SEQ ID NO: 47111 - DNA, 26 bp, Homo sapiens
tgaacatgggtcagtcggtcctgaga

SEQ ID NO: 47112 - DNA, 27 bp, Homo sapiens
tgaacatgggtcagtcggtcctgagag

SEQ ID NO: 47113 - DNA, 28 bp, Homo sapiens
tgaacatgggtcagtcggtcctgagaga

SEQ ID NO: 47114 - DNA, 29 bp, Homo sapiens
tgaacatgggtcagtcggtcctgagagat

SEQ ID NO: 47115 - DNA, 30 bp, Homo sapiens
tgaacatgggtcagtcggtcctgagagatg

SEQ ID NO: 47116 - DNA, 17 bp, Homo sapiens
gaacatgggtcagtcgg

SEQ ID NO: 47117 - DNA, 18 bp, Homo sapiens
gaacatgggtcagtcggt

SEQ ID NO: 47118 - DNA, 19 bp, Homo sapiens
gaacatgggtcagtcggtc

SEQ ID NO: 47119 - DNA, 20 bp, Homo sapiens
gaacatgggtcagtcggtcc

SEQ ID NO: 47120 - DNA, 21 bp, Homo sapiens
gaacatgggtcagtcggtcct

SEQ ID NO: 47121 - DNA, 22 bp, Homo sapiens
gaacatgggtcagtcggtcctg

SEQ ID NO: 47122 - DNA, 23 bp, Homo sapiens
gaacatgggtcagtcggtcctga

SEQ ID NO: 47123 - DNA, 24 bp, Homo sapiens
gaacatgggtcagtcggtcctgag

SEQ ID NO: 47124 - DNA, 25 bp, Homo sapiens
gaacatgggtcagtcggtcctgaga

SEQ ID NO: 47125 - DNA, 26 bp, Homo sapiens
gaacatgggtcagtcggtcctgagag

SEQ ID NO: 47126 - DNA, 27 bp, Homo sapiens
gaacatgggtcagtcggtcctgagaga

SEQ ID NO: 47127 - DNA, 28 bp, Homo sapiens
gaacatgggtcagtcggtcctgagagat

SEQ ID NO: 47128 - DNA, 29 bp, Homo sapiens
gaacatgggtcagtcggtcctgagagatg

SEQ ID NO: 47129 - DNA, 30 bp, Homo sapiens; identical to SEQ ID NO: 30006

SEQ ID NO: 47130 - DNA, 16 bp, Homo sapiens
aacatgggtcagtcgg

SEQ ID NO: 47131 - DNA, 17 bp, Homo sapiens
aacatgggtcagtcggt

SEQ ID NO: 47132 - DNA, 18 bp, Homo sapiens
aacatgggtcagtcggtc

SEQ ID NO: 47133 - DNA, 19 bp, Homo sapiens
aacatgggtcagtcggtcc

SEQ ID NO: 47134 - DNA, 20 bp, Homo sapiens
aacatgggtcagtcggtcct

SEQ ID NO: 47135 - DNA, 21 bp, Homo sapiens
aacatgggtcagtcggtcctg

SEQ ID NO: 47136 - DNA, 22 bp, Homo sapiens
aacatgggtcagtcggtcctga

SEQ ID NO: 47137 - DNA, 23 bp, Homo sapiens
aacatgggtcagtcggtcctgag

SEQ ID NO: 47138 - DNA, 24 bp, Homo sapiens
aacatgggtcagtcggtcctgaga

SEQ ID NO: 47139 - DNA, 25 bp, Homo sapiens
aacatgggtcagtcggtcctgagag

SEQ ID NO: 47140 - DNA, 26 bp, Homo sapiens
aacatgggtcagtcggtcctgagaga

SEQ ID NO: 47141 - DNA, 27 bp, Homo sapiens
aacatgggtcagtcggtcctgagagat

SEQ ID NO: 47142 - DNA, 28 bp, Homo sapiens
aacatgggtcagtcggtcctgagagatg

SEQ ID NO: 47143 - DNA, 29 bp, Homo sapiens
aacatgggtcagtcggtcctgagagatgg

SEQ ID NO: 47144 - DNA, 30 bp, Homo sapiens; identical to SEQ ID NO: 30012

SEQ ID NO: 47145 - DNA, 16 bp, Homo sapiens
acatgggtcagtcggt

SEQ ID NO: 47146 - DNA, 17 bp, Homo sapiens
acatgggtcagtcggtc

SEQ ID NO: 47147 - DNA, 18 bp, Homo sapiens
acatgggtcagtcggtcc

SEQ ID NO: 47148 - DNA, 19 bp, Homo sapiens
acatgggtcagtcggtcct

SEQ ID NO: 47149 - DNA, 20 bp, Homo sapiens
acatgggtcagtcggtcctg

SEQ ID NO: 47150 - DNA, 21 bp, Homo sapiens
acatgggtcagtcggtcctga

SEQ ID NO: 47151 - DNA, 22 bp, Homo sapiens
acatgggtcagtcggtcctgag

SEQ ID NO: 47152 - DNA, 23 bp, Homo sapiens
acatgggtcagtcggtcctgaga

SEQ ID NO: 47153 - DNA, 24 bp, Homo sapiens
acatgggtcagtcggtcctgagag

SEQ ID NO: 47154 - DNA, 25 bp, Homo sapiens
acatgggtcagtcggtcctgagaga

SEQ ID NO: 47155 - DNA, 26 bp, Homo sapiens
acatgggtcagtcggtcctgagagat

SEQ ID NO: 47156 - DNA, 27 bp, Homo sapiens
acatgggtcagtcggtcctgagagatg

SEQ ID NO: 47157 - DNA, 28 bp, Homo sapiens
acatgggtcagtcggtcctgagagatgg

SEQ ID NO: 47158 - DNA, 29 bp, Homo sapiens
acatgggtcagtcggtcctgagagatggg

SEQ ID NO: 47159 - DNA, 30 bp, Homo sapiens; identical to SEQ ID NO: 22642

SEQ ID NO: 47160 - DNA, 16 bp, Homo sapiens
catgggtcagtcggtc

SEQ ID NO: 47161 - DNA, 17 bp, Homo sapiens
catgggtcagtcggtcc

SEQ ID NO: 47162 - DNA, 18 bp, Homo sapiens
catgggtcagtcggtcct

SEQ ID NO: 47163 - DNA, 19 bp, Homo sapiens
catgggtcagtcggtcctg

SEQ ID NO: 47164 - DNA, 20 bp, Homo sapiens
catgggtcagtcggtcctga

SEQ ID NO: 47165 - DNA, 21 bp, Homo sapiens
catgggtcagtcggtcctgag

SEQ ID NO: 47166 - DNA, 22 bp, Homo sapiens
catgggtcagtcggtcctgaga

SEQ ID NO: 47167 - DNA, 23 bp, Homo sapiens
catgggtcagtcggtcctgagag

SEQ ID NO: 47168 - DNA, 24 bp, Homo sapiens
catgggtcagtcggtcctgagaga

SEQ ID NO: 47169 - DNA, 25 bp, Homo sapiens
catgggtcagtcggtcctgagagat

SEQ ID NO: 47170 - DNA, 26 bp, Homo sapiens
catgggtcagtcggtcctgagagatg

SEQ ID NO: 47171 - DNA, 27 bp, Homo sapiens
catgggtcagtcggtcctgagagatgg

SEQ ID NO: 47172 - DNA, 28 bp, Homo sapiens
catgggtcagtcggtcctgagagatggg

SEQ ID NO: 47173 - DNA, 29 bp, Homo sapiens
catgggtcagtcggtcctgagagatgggc

SEQ ID NO: 47174 - DNA, 30 bp, Homo sapiens
catgggtcagtcggtcctgagagatgggcg

SEQ ID NO: 47175 - DNA, 16 bp, Homo sapiens
atgggtcagtcggtcc

SEQ ID NO: 47176 - DNA, 17 bp, Homo sapiens
atgggtcagtcggtcct

SEQ ID NO: 47177 - DNA, 18 bp, Homo sapiens
atgggtcagtcggtcctg

SEQ ID NO: 47178 - DNA, 19 bp, Homo sapiens
atgggtcagtcggtcctga

SEQ ID NO: 47179 - DNA, 20 bp, Homo sapiens
atgggtcagtcggtcctgag

SEQ ID NO: 47180 - DNA, 21 bp, Homo sapiens
atgggtcagtcggtcctgaga

SEQ ID NO: 47181 - DNA, 22 bp, Homo sapiens
atgggtcagtcggtcctgagag

SEQ ID NO: 47182 - DNA, 23 bp, Homo sapiens
atgggtcagtcggtcctgagaga

SEQ ID NO: 47183 - DNA, 24 bp, Homo sapiens
atgggtcagtcggtcctgagagat

SEQ ID NO: 47184 - DNA, 25 bp, Homo sapiens
atgggtcagtcggtcctgagagatg

SEQ ID NO: 47185 - DNA, 26 bp, Homo sapiens
atgggtcagtcggtcctgagagatgg

SEQ ID NO: 47186 - DNA, 27 bp, Homo sapiens
atgggtcagtcggtcctgagagatggg

SEQ ID NO: 47187 - DNA, 28 bp, Homo sapiens
atgggtcagtcggtcctgagagatgggc

SEQ ID NO: 47188 - DNA, 29 bp, Homo sapiens
atgggtcagtcggtcctgagagatgggcg

SEQ ID NO: 47189 - DNA, 30 bp, Homo sapiens
atgggtcagtcggtcctgagagatgggcga

SEQ ID NO: 47190 - DNA, 16 bp, Homo sapiens
tgggtcagtcggtcct

SEQ ID NO: 47191 - DNA, 17 bp, Homo sapiens
tgggtcagtcggtcctg

SEQ ID NO: 47192 - DNA, 18 bp, Homo sapiens
tgggtcagtcggtcctga

SEQ ID NO: 47193 - DNA, 19 bp, Homo sapiens
tgggtcagtcggtcctgag

SEQ ID NO: 47194 - DNA, 20 bp, Homo sapiens
tgggtcagtcggtcctgaga

SEQ ID NO: 47195 - DNA, 21 bp, Homo sapiens
tgggtcagtcggtcctgagag

SEQ ID NO: 47196 - DNA, 22 bp, Homo sapiens
tgggtcagtcggtcctgagaga

SEQ ID NO: 47197 - DNA, 23 bp, Homo sapiens
tgggtcagtcggtcctgagagat

SEQ ID NO: 47198 - DNA, 24 bp, Homo sapiens
tgggtcagtcggtcctgagagatg

SEQ ID NO: 47199 - DNA, 25 bp, Homo sapiens
tgggtcagtcggtcctgagagatgg

SEQ ID NO: 47200 - DNA, 26 bp, Homo sapiens
tgggtcagtcggtcctgagagatggg

SEQ ID NO: 47201 - DNA, 27 bp, Homo sapiens
tgggtcagtcggtcctgagagatgggc

SEQ ID NO: 47202 - DNA, 28 bp, Homo sapiens
tgggtcagtcggtcctgagagatgggcg

SEQ ID NO: 47203 - DNA, 29 bp, Homo sapiens
tgggtcagtcggtcctgagagatgggcga

SEQ ID NO: 47204 - DNA, 30 bp, Homo sapiens; identical to SEQ ID NO: 30041

SEQ ID NO: 47205 - DNA, 17 bp, Homo sapiens
gggtcagtcggtcctga

SEQ ID NO: 47206 - DNA, 18 bp, Homo sapiens
gggtcagtcggtcctgag

SEQ ID NO: 47207 - DNA, 19 bp, Homo sapiens
gggtcagtcggtcctgaga

SEQ ID NO: 47208 - DNA, 20 bp, Homo sapiens
gggtcagtcggtcctgagag

SEQ ID NO: 47209 - DNA, 21 bp, Homo sapiens
gggtcagtcggtcctgagaga

SEQ ID NO: 47210 - DNA, 22 bp, Homo sapiens
gggtcagtcggtcctgagagat

SEQ ID NO: 47211 - DNA, 23 bp, Homo sapiens
gggtcagtcggtcctgagagatg

SEQ ID NO: 47212 - DNA, 24 bp, Homo sapiens
gggtcagtcggtcctgagagatgg

SEQ ID NO: 47213 - DNA, 25 bp, Homo sapiens
gggtcagtcggtcctgagagatggg

SEQ ID NO: 47214 - DNA, 26 bp, Homo sapiens
gggtcagtcggtcctgagagatgggc

SEQ ID NO: 47215 - DNA, 27 bp, Homo sapiens
gggtcagtcggtcctgagagatgggcg

SEQ ID NO: 47216 - DNA, 28 bp, Homo sapiens
gggtcagtcggtcctgagagatgggcga

SEQ ID NO: 47217 - DNA, 29 bp, Homo sapiens
gggtcagtcggtcctgagagatgggcgag

SEQ ID NO: 47218 - DNA, 30 bp, Homo sapiens
gggtcagtcggtcctgagagatgggcgagc

SEQ ID NO: 47219 - DNA, 16 bp, Homo sapiens
ggtcagtcggtcctga

SEQ ID NO: 47220 - DNA, 17 bp, Homo sapiens
ggtcagtcggtcctgag

SEQ ID NO: 47221 - DNA, 18 bp, Homo sapiens
ggtcagtcggtcctgaga

SEQ ID NO: 47222 - DNA, 19 bp, Homo sapiens
ggtcagtcggtcctgagag

SEQ ID NO: 47223 - DNA, 20 bp, Homo sapiens
ggtcagtcggtcctgagaga

SEQ ID NO: 47224 - DNA, 21 bp, Homo sapiens
ggtcagtcggtcctgagagat

SEQ ID NO: 47225 - DNA, 22 bp, Homo sapiens
ggtcagtcggtcctgagagatg

SEQ ID NO: 47226 - DNA, 23 bp, Homo sapiens
ggtcagtcggtcctgagagatgg

SEQ ID NO: 47227 - DNA, 24 bp, Homo sapiens
ggtcagtcggtcctgagagatggg

SEQ ID NO: 47228 - DNA, 25 bp, Homo sapiens
ggtcagtcggtcctgagagatgggc

SEQ ID NO: 47229 - DNA, 26 bp, Homo sapiens
ggtcagtcggtcctgagagatgggcg

SEQ ID NO: 47230 - DNA, 27 bp, Homo sapiens
ggtcagtcggtcctgagagatgggcga

SEQ ID NO: 47231 - DNA, 28 bp, Homo sapiens
ggtcagtcggtcctgagagatgggcgag

SEQ ID NO: 47232 - DNA, 29 bp, Homo sapiens
ggtcagtcggtcctgagagatgggcgagc

SEQ ID NO: 47233 - DNA, 30 bp, Homo sapiens
ggtcagtcggtcctgagagatgggcgagcg

SEQ ID NO: 47234 - DNA, 16 bp, Homo sapiens
gtcagtcggtcctgag

SEQ ID NO: 47235 - DNA, 17 bp, Homo sapiens
gtcagtcggtcctgaga

SEQ ID NO: 47236 - DNA, 18 bp, Homo sapiens
gtcagtcggtcctgagag

SEQ ID NO: 47237 - DNA, 19 bp, Homo sapiens
gtcagtcggtcctgagaga

SEQ ID NO: 47238 - DNA, 20 bp, Homo sapiens
gtcagtcggtcctgagagat

SEQ ID NO: 47239 - DNA, 21 bp, Homo sapiens
gtcagtcggtcctgagagatg

SEQ ID NO: 47240 - DNA, 22 bp, Homo sapiens
gtcagtcggtcctgagagatgg

SEQ ID NO: 47241 - DNA, 23 bp, Homo sapiens
gtcagtcggtcctgagagatggg

SEQ ID NO: 47242 - DNA, 24 bp, Homo sapiens
gtcagtcggtcctgagagatgggc

SEQ ID NO: 47243 - DNA, 25 bp, Homo sapiens
gtcagtcggtcctgagagatgggcg

SEQ ID NO: 47244 - DNA, 28 bp, Homo sapiens
gtcagtcggtcctgagagatgggcgagc

SEQ ID NO: 47245 - DNA, 29 bp, Homo sapiens
gtcagtcggtcctgagagatgggcgagcg

SEQ ID NO: 47246 - DNA, 30 bp, Homo sapiens; identical to SEQ ID NO: 22678

SEQ ID NO: 47247 - DNA, 16 bp, Homo sapiens
tcagtcggtcctgaga

SEQ ID NO: 47248 - DNA, 17 bp, Homo sapiens
tcagtcggtcctgagag

SEQ ID NO: 47249 - DNA, 18 bp, Homo sapiens
tcagtcggtcctgagaga

SEQ ID NO: 47250 - DNA, 19 bp, Homo sapiens
tcagtcggtcctgagagat

SEQ ID NO: 47251 - DNA, 20 bp, Homo sapiens
tcagtcggtcctgagagatg

SEQ ID NO: 47252 - DNA, 21 bp, Homo sapiens
tcagtcggtcctgagagatgg

SEQ ID NO: 47253 - DNA, 22 bp, Homo sapiens
tcagtcggtcctgagagatggg

SEQ ID NO: 47254 - DNA, 23 bp, Homo sapiens
tcagtcggtcctgagagatgggc

SEQ ID NO: 47255 - DNA, 24 bp, Homo sapiens
tcagtcggtcctgagagatgggcg

SEQ ID NO: 47256 - DNA, 25 bp, Homo sapiens
tcagtcggtcctgagagatgggcga

SEQ ID NO: 47257 - DNA, 26 bp, Homo sapiens
tcagtcggtcctgagagatgggcgag

SEQ ID NO: 47258 - DNA, 27 bp, Homo sapiens
tcagtcggtcctgagagatgggcgagc

SEQ ID NO: 47259 - DNA, 28 bp, Homo sapiens
tcagtcggtcctgagagatgggcgagcg

SEQ ID NO: 47260 - DNA, 29 bp, Homo sapiens
tcagtcggtcctgagagatgggcgagcgc

SEQ ID NO: 47261 - DNA, 30 bp, Homo sapiens; identical to SEQ ID NO: 4901

SEQ ID NO: 47262 - DNA, 16 bp, Homo sapiens
cagtcggtcctgagag

SEQ ID NO: 47263 - DNA, 17 bp, Homo sapiens
cagtcggtcctgagaga

SEQ ID NO: 47264 - DNA, 18 bp, Homo sapiens
cagtcggtcctgagagat

SEQ ID NO: 47265 - DNA, 19 bp, Homo sapiens
cagtcggtcctgagagatg

SEQ ID NO: 47266 - DNA, 20 bp, Homo sapiens
cagtcggtcctgagagatgg

SEQ ID NO: 47267 - DNA, 21 bp, Homo sapiens
cagtcggtcctgagagatggg

SEQ ID NO: 47268 - DNA, 22 bp, Homo sapiens
cagtcggtcctgagagatgggc

SEQ ID NO: 47269 - DNA, 23 bp, Homo sapiens
cagtcggtcctgagagatgggcg

SEQ ID NO: 47270 - DNA, 24 bp, Homo sapiens
cagtcggtcctgagagatgggcga

SEQ ID NO: 47271 - DNA, 25 bp, Homo sapiens
cagtcggtcctgagagatgggcgag

SEQ ID NO: 47272 - DNA, 26 bp, Homo sapiens
cagtcggtcctgagagatgggcgagc

SEQ ID NO: 47273 - DNA, 27 bp, Homo sapiens
cagtcggtcctgagagatgggcgagcg

SEQ ID NO: 47274 - DNA, 28 bp, Homo sapiens
cagtcggtcctgagagatgggcgagcgc

SEQ ID NO: 47275 - DNA, 30 bp, Homo sapiens
cagtcggtcctgagagatgggcgagcgccg

SEQ ID NO: 47276 - DNA, 16 bp, Homo sapiens
agtcggtcctgagaga

SEQ ID NO: 47277 - DNA, 17 bp, Homo sapiens
agtcggtcctgagagat

SEQ ID NO: 47278 - DNA, 18 bp, Homo sapiens
agtcggtcctgagagatg

SEQ ID NO: 47279 - DNA, 20 bp, Homo sapiens
agtcggtcctgagagatggg

SEQ ID NO: 47280 - DNA, 21 bp, Homo sapiens
agtcggtcctgagagatgggc

SEQ ID NO: 47281 - DNA, 25 bp, Homo sapiens
agtcggtcctgagagatgggcgagc

SEQ ID NO: 47282 - DNA, 26 bp, Homo sapiens
agtcggtcctgagagatgggcgagcg

SEQ ID NO: 47283 - DNA, 27 bp, Homo sapiens
agtcggtcctgagagatgggcgagcgc

SEQ ID NO: 47284 - DNA, 17 bp, Homo sapiens
gtcggtcctgagagatg

SEQ ID NO: 47285 - DNA, 19 bp, Homo sapiens
gtcggtcctgagagatggg

SEQ ID NO: 47286 - DNA, 20 bp, Homo sapiens
gtcggtcctgagagatgggc

SEQ ID NO: 47287 - DNA, 22 bp, Homo sapiens
gtcggtcctgagagatgggcga

SEQ ID NO: 47288 - DNA, 24 bp, Homo sapiens
gtcggtcctgagagatgggcgagc

SEQ ID NO: 47289 - DNA, 25 bp, Homo sapiens
gtcggtcctgagagatgggcgagcg

SEQ ID NO: 47290 - DNA, 26 bp, Homo sapiens
gtcggtcctgagagatgggcgagcgc

SEQ ID NO: 47291 - DNA, 16 bp, Homo sapiens
tcggtcctgagagatg

SEQ ID NO: 47292 - DNA, 19 bp, Homo sapiens
tcggtcctgagagatgggc

SEQ ID NO: 47293 - DNA, 18 bp, Homo sapiens
cggtcctgagagatgggc

SEQ ID NO: 47294 - DNA, 22 bp, Homo sapiens
cggtcctgagagatgggcgagc

SEQ ID NO: 47295 - DNA, 23 bp, Homo sapiens
cggtcctgagagatgggcgagcg

SEQ ID NO: 47296 - DNA, 16 bp, Homo sapiens
ggtcctgagagatggg

SEQ ID NO: 47297 - DNA, 17 bp, Homo sapiens
ggtcctgagagatgggc

SEQ ID NO: 47298 - DNA, 18 bp, Homo sapiens
ggtcctgagagatgggcg

SEQ ID NO: 47299 - DNA, 19 bp, Homo sapiens
ggtcctgagagatgggcga

SEQ ID NO: 47300 - DNA, 20 bp, Homo sapiens
ggtcctgagagatgggcgag

SEQ ID NO: 47301 - DNA, 21 bp, Homo sapiens
ggtcctgagagatgggcgagc

SEQ ID NO: 47302 - DNA, 22 bp, Homo sapiens
ggtcctgagagatgggcgagcg

SEQ ID NO: 47303 - DNA, 23 bp, Homo sapiens
ggtcctgagagatgggcgagcgc

SEQ ID NO: 47304 - DNA, 24 bp, Homo sapiens
ggtcctgagagatgggcgagcgcc

SEQ ID NO: 47305 - DNA, 25 bp, Homo sapiens
ggtcctgagagatgggcgagcgccg

SEQ ID NO: 47306 - DNA, 26 bp, Homo sapiens
ggtcctgagagatgggcgagcgccgt

SEQ ID NO: 47307 - DNA, 27 bp, Homo sapiens
ggtcctgagagatgggcgagcgccgtt

SEQ ID NO: 47308 - DNA, 28 bp, Homo sapiens
ggtcctgagagatgggcgagcgccgttc

SEQ ID NO: 47309 - DNA, 29 bp, Homo sapiens
ggtcctgagagatgggcgagcgccgttcc

SEQ ID NO: 47310 - DNA, 30 bp, Homo sapiens; identical to SEQ ID NO: 22713

SEQ ID NO: 47311 - DNA, 16 bp, Homo sapiens
gtcctgagagatgggc

SEQ ID NO: 47312 - DNA, 20 bp, Homo sapiens
gtcctgagagatgggcgagc

SEQ ID NO: 47313 - DNA, 21 bp, Homo sapiens
gtcctgagagatgggcgagcg

SEQ ID NO: 47314 - DNA, 23 bp, Homo sapiens
gtcctgagagatgggcgagcgcc

SEQ ID NO: 47315 - DNA, 24 bp, Homo sapiens
gtcctgagagatgggcgagcgccg

SEQ ID NO: 47316 - DNA, 20 bp, Homo sapiens
cctgagagatgggcgagcgc

SEQ ID NO: 47317 - DNA, 21 bp, Homo sapiens
cctgagagatgggcgagcgcc

SEQ ID NO: 47318 - DNA, 17 bp, Homo sapiens
ctgagagatgggcgagc

SEQ ID NO: 47319 - DNA, 18 bp, Homo sapiens
ctgagagatgggcgagcg

SEQ ID NO: 47320 - DNA, 19 bp, Homo sapiens
ctgagagatgggcgagcgc

SEQ ID NO: 47321 - DNA, 20 bp, Homo sapiens
ctgagagatgggcgagcgcc

SEQ ID NO: 47322 - DNA, 21 bp, Homo sapiens
ctgagagatgggcgagcgccg

SEQ ID NO: 47323 - DNA, 30 bp, Homo sapiens
ctgagagatgggcgagcgccgttccgaagg

SEQ ID NO: 47324 - DNA, 30 bp, Homo sapiens
gatgggcgagcgccgttccgaagggacggg

SEQ ID NO: 47325 - DNA, 29 bp, Homo sapiens
tgggcgagcgccgttccgaagggacgggc

SEQ ID NO: 47326 - DNA, 22 bp, Homo sapiens
gggcgagcgccgttccgaaggg

SEQ ID NO: 47327 - DNA, 19 bp, Homo sapiens
ggcgagcgccgttccgaag

SEQ ID NO: 47328 - DNA, 20 bp, Homo sapiens
ggcgagcgccgttccgaagg

SEQ ID NO: 47329 - DNA, 21 bp, Homo sapiens
ggcgagcgccgttccgaaggg

SEQ ID NO: 47330 - DNA, 17 bp, Homo sapiens
gcgagcgccgttccgaa

SEQ ID NO: 47331 - DNA, 18 bp, Homo sapiens
gcgagcgccgttccgaag

SEQ ID NO: 47332 - DNA, 19 bp, Homo sapiens
gcgagcgccgttccgaagg

SEQ ID NO: 47333 - DNA, 20 bp, Homo sapiens
gcgagcgccgttccgaaggg

SEQ ID NO: 47334 - DNA, 17 bp, Homo sapiens
cgagcgccgttccgaag

SEQ ID NO: 47335 - DNA, 18 bp, Homo sapiens
cgagcgccgttccgaagg

SEQ ID NO: 47336 - DNA, 19 bp, Homo sapiens
cgagcgccgttccgaaggg

SEQ ID NO: 47337 - DNA, 20 bp, Homo sapiens
cgagcgccgttccgaaggga

SEQ ID NO: 47338 - DNA, 17 bp, Homo sapiens
gagcgccgttccgaagg

SEQ ID NO: 47339 - DNA, 24 bp, Homo sapiens
gagcgccgttccgaagggacgggc

SEQ ID NO: 47340 - DNA, 16 bp, Homo sapiens
agcgccgttccgaagg

SEQ ID NO: 47341 - DNA, 20 bp, Homo sapiens
agcgccgttccgaagggacg

SEQ ID NO: 47342 - DNA, 23 bp, Homo sapiens
agcgccgttccgaagggacgggc

SEQ ID NO: 47343 - DNA, 19 bp, Homo sapiens
gcgccgttccgaagggacg

SEQ ID NO: 47344 - DNA, 21 bp, Homo sapiens
gcgccgttccgaagggacggg

SEQ ID NO: 47345 - DNA, 22 bp, Homo sapiens
gcgccgttccgaagggacgggc

SEQ ID NO: 47346 - DNA, 20 bp, Homo sapiens
gccgttccgaagggacgggc

SEQ ID NO: 47347 - DNA, 16 bp, Homo sapiens
ccgttccgaagggacg

SEQ ID NO: 47348 - DNA, 17 bp, Homo sapiens
ccgttccgaagggacgg

SEQ ID NO: 47349 - DNA, 17 bp, Homo sapiens
cgttccgaagggacggg

SEQ ID NO: 47350 - DNA, 16 bp, Homo sapiens
gttccgaagggacggg

SEQ ID NO: 47351 - DNA, 17 bp, Homo sapiens
gttccgaagggacgggc

SEQ ID NO: 47352 - DNA, 18 bp, Homo sapiens
gttccgaagggacgggcg

SEQ ID NO: 47353 - DNA, 19 bp, Homo sapiens
gttccgaagggacgggcga

SEQ ID NO: 47354 - DNA, 21 bp, Homo sapiens
gttccgaagggacgggcgatg

SEQ ID NO: 47355 - DNA, 22 bp, Homo sapiens
gttccgaagggacgggcgatgg

SEQ ID NO: 47356 - DNA, 23 bp, Homo sapiens
gttccgaagggacgggcgatggc

SEQ ID NO: 47357 - DNA, 17 bp, Homo sapiens
cgaagggacgggcgatg

SEQ ID NO: 47358 - DNA, 18 bp, Homo sapiens
cgaagggacgggcgatgg

SEQ ID NO: 47359 - DNA, 18 bp, Homo sapiens
gaagggacgggcgatggc

SEQ ID NO: 47360 - DNA, 17 bp, Homo sapiens
aagggacgggcgatggc

SEQ ID NO: 47361 - DNA, 18 bp, Homo sapiens
aagggacgggcgatggcc

SEQ ID NO: 47362 - DNA, 16 bp, Homo sapiens
agggacgggcgatggc

SEQ ID NO: 47363 - DNA, 30 bp, Homo sapiens
gggacgggcgatggcctccgttgccctcgg

SEQ ID NO: 47364 - DNA, 30 bp, Homo sapiens
acgggcgatggcctccgttgccctcggccg

SEQ ID NO: 47365 - DNA, 19 bp, Homo sapiens
cgggcgatggcctccgttg

SEQ ID NO: 47366 - DNA, 29 bp, Homo sapiens
cgggcgatggcctccgttgccctcggccg

SEQ ID NO: 47367 - DNA, 27 bp, Homo sapiens
gggcgatggcctccgttgccctcggcc

SEQ ID NO: 47368 - DNA, 28 bp, Homo sapiens
gggcgatggcctccgttgccctcggccg

SEQ ID NO: 47369 - DNA, 27 bp, Homo sapiens
ggcgatggcctccgttgccctcggccg

SEQ ID NO: 47370 - DNA, 30 bp, Homo sapiens
gcgatggcctccgttgccctcggccgatcg

SEQ ID NO: 47371 - DNA, 28 bp, Homo sapiens
gatggcctccgttgccctcggccgatcg

SEQ ID NO: 47372 - DNA, 29 bp, Homo sapiens
gatggcctccgttgccctcggccgatcga

SEQ ID NO: 47373 - DNA, 29 bp, Homo sapiens
atggcctccgttgccctcggccgatcgaa

SEQ ID NO: 47374 - DNA, 25 bp, Homo sapiens
tggcctccgttgccctcggccgatc

SEQ ID NO: 47375 - DNA, 26 bp, Homo sapiens
tggcctccgttgccctcggccgatcg

SEQ ID NO: 47376 - DNA, 30 bp, Homo sapiens
tggcctccgttgccctcggccgatcgaaag

SEQ ID NO: 47377 - DNA, 21 bp, Homo sapiens
ggcctccgttgccctcggccg

SEQ ID NO: 47378 - DNA, 24 bp, Homo sapiens
ggcctccgttgccctcggccgatc

SEQ ID NO: 47379 - DNA, 25 bp, Homo sapiens
ggcctccgttgccctcggccgatcg

SEQ ID NO: 47380 - DNA, 26 bp, Homo sapiens
ggcctccgttgccctcggccgatcga

SEQ ID NO: 47381 - DNA, 27 bp, Homo sapiens
ggcctccgttgccctcggccgatcgaa

SEQ ID NO: 47382 - DNA, 28 bp, Homo sapiens
ggcctccgttgccctcggccgatcgaaa

SEQ ID NO: 47383 - DNA, 30 bp, Homo sapiens
ggcctccgttgccctcggccgatcgaaagg

SEQ ID NO: 47384 - DNA, 17 bp, Homo sapiens
gcctccgttgccctcgg

SEQ ID NO: 47385 - DNA, 18 bp, Homo sapiens
gcctccgttgccctcggc

SEQ ID NO: 47386 - DNA, 19 bp, Homo sapiens
gcctccgttgccctcggcc

SEQ ID NO: 47387 - DNA, 20 bp, Homo sapiens
gcctccgttgccctcggccg

SEQ ID NO: 47388 - DNA, 21 bp, Homo sapiens
gcctccgttgccctcggccga

SEQ ID NO: 47389 - DNA, 22 bp, Homo sapiens
gcctccgttgccctcggccgat

SEQ ID NO: 47390 - DNA, 23 bp, Homo sapiens
gcctccgttgccctcggccgatc

SEQ ID NO: 47391 - DNA, 24 bp, Homo sapiens
gcctccgttgccctcggccgatcg

SEQ ID NO: 47392 - DNA, 25 bp, Homo sapiens
gcctccgttgccctcggccgatcga

SEQ ID NO: 47393 - DNA, 26 bp, Homo sapiens
gcctccgttgccctcggccgatcgaa

SEQ ID NO: 47394 - DNA, 27 bp, Homo sapiens
gcctccgttgccctcggccgatcgaaa

SEQ ID NO: 47395 - DNA, 28 bp, Homo sapiens
gcctccgttgccctcggccgatcgaaag

SEQ ID NO: 47396 - DNA, 29 bp, Homo sapiens
gcctccgttgccctcggccgatcgaaagg

SEQ ID NO: 47397 - DNA, 30 bp, Homo sapiens
gcctccgttgccctcggccgatcgaaaggg

SEQ ID NO: 47398 - DNA, 19 bp, Homo sapiens
cctccgttgccctcggccg

SEQ ID NO: 47399 - DNA, 20 bp, Homo sapiens
cctccgttgccctcggccga

SEQ ID NO: 47400 - DNA, 22 bp, Homo sapiens
cctccgttgccctcggccgatc

SEQ ID NO: 47401 - DNA, 23 bp, Homo sapiens
cctccgttgccctcggccgatcg

SEQ ID NO: 47402 - DNA, 28 bp, Homo sapiens
cctccgttgccctcggccgatcgaaagg

SEQ ID NO: 47403 - DNA, 20 bp, Homo sapiens
ctccgttgccctcggccgat

SEQ ID NO: 47404 - DNA, 21 bp, Homo sapiens
ctccgttgccctcggccgatc

SEQ ID NO: 47405 - DNA, 22 bp, Homo sapiens
ctccgttgccctcggccgatcg

SEQ ID NO: 47406 - DNA, 24 bp, Homo sapiens
ctccgttgccctcggccgatcgaa

SEQ ID NO: 47407 - DNA, 25 bp, Homo sapiens
ctccgttgccctcggccgatcgaaa

SEQ ID NO: 47408 - DNA, 19 bp, Homo sapiens
tccgttgccctcggccgat

SEQ ID NO: 47409 - DNA, 20 bp, Homo sapiens
tccgttgccctcggccgatc

SEQ ID NO: 47410 - DNA, 21 bp, Homo sapiens
tccgttgccctcggccgatcg

SEQ ID NO: 47411 - DNA, 18 bp, Homo sapiens
ccgttgccctcggccgat

SEQ ID NO: 47412 - DNA, 19 bp, Homo sapiens
ccgttgccctcggccgatc

SEQ ID NO: 47413 - DNA, 20 bp, Homo sapiens
ccgttgccctcggccgatcg

SEQ ID NO: 47414 - DNA, 17 bp, Homo sapiens
cgttgccctcggccgat

SEQ ID NO: 47415 - DNA, 18 bp, Homo sapiens
cgttgccctcggccgatc

SEQ ID NO: 47416 - DNA, 19 bp, Homo sapiens
cgttgccctcggccgatcg

SEQ ID NO: 47417 - DNA, 24 bp, Homo sapiens
cgttgccctcggccgatcgaaagg

SEQ ID NO: 47418 - DNA, 25 bp, Homo sapiens
cgttgccctcggccgatcgaaaggg

SEQ ID NO: 47419 - DNA, 27 bp, Homo sapiens
cgttgccctcggccgatcgaaagggag

SEQ ID NO: 47420 - DNA, 30 bp, Homo sapiens
cgttgccctcggccgatcgaaagggagtcg

SEQ ID NO: 47421 - DNA, 17 bp, Homo sapiens
gttgccctcggccgatc

SEQ ID NO: 47422 - DNA, 18 bp, Homo sapiens
gttgccctcggccgatcg

SEQ ID NO: 47423 - DNA, 19 bp, Homo sapiens
gttgccctcggccgatcga

SEQ ID NO: 47424 - DNA, 20 bp, Homo sapiens
gttgccctcggccgatcgaa

SEQ ID NO: 47425 - DNA, 21 bp, Homo sapiens
gttgccctcggccgatcgaaa

SEQ ID NO: 47426 - DNA, 22 bp, Homo sapiens
gttgccctcggccgatcgaaag

SEQ ID NO: 47427 - DNA, 23 bp, Homo sapiens
gttgccctcggccgatcgaaagg

SEQ ID NO: 47428 - DNA, 24 bp, Homo sapiens
gttgccctcggccgatcgaaaggg

SEQ ID NO: 47429 - DNA, 25 bp, Homo sapiens
gttgccctcggccgatcgaaaggga

SEQ ID NO: 47430 - DNA, 26 bp, Homo sapiens
gttgccctcggccgatcgaaagggag

SEQ ID NO: 47431 - DNA, 27 bp, Homo sapiens
gttgccctcggccgatcgaaagggagt

SEQ ID NO: 47432 - DNA, 28 bp, Homo sapiens
gttgccctcggccgatcgaaagggagtc

SEQ ID NO: 47433 - DNA, 29 bp, Homo sapiens
gttgccctcggccgatcgaaagggagtcg

SEQ ID NO: 47434 - DNA, 30 bp, Homo sapiens; identical to SEQ ID NO: 4924

SEQ ID NO: 47435 - DNA, 16 bp, Homo sapiens
ttgccctcggccgatc

SEQ ID NO: 47436 - DNA, 17 bp, Homo sapiens
ttgccctcggccgatcg

SEQ ID NO: 47437 - DNA, 18 bp, Homo sapiens
ttgccctcggccgatcga

SEQ ID NO: 47438 - DNA, 19 bp, Homo sapiens
ttgccctcggccgatcgaa

SEQ ID NO: 47439 - DNA, 20 bp, Homo sapiens
ttgccctcggccgatcgaaa

SEQ ID NO: 47440 - DNA, 21 bp, Homo sapiens
ttgccctcggccgatcgaaag

SEQ ID NO: 47441 - DNA, 22 bp, Homo sapiens
ttgccctcggccgatcgaaagg

SEQ ID NO: 47442 - DNA, 23 bp, Homo sapiens
ttgccctcggccgatcgaaaggg

SEQ ID NO: 47443 - DNA, 24 bp, Homo sapiens
ttgccctcggccgatcgaaaggga

SEQ ID NO: 47444 - DNA, 25 bp, Homo sapiens
ttgccctcggccgatcgaaagggag

SEQ ID NO: 47445 - DNA, 26 bp, Homo sapiens
ttgccctcggccgatcgaaagggagt

SEQ ID NO: 47446 - DNA, 27 bp, Homo sapiens
ttgccctcggccgatcgaaagggagtc

SEQ ID NO: 47447 - DNA, 28 bp, Homo sapiens
ttgccctcggccgatcgaaagggagtcg

SEQ ID NO: 47448 - DNA, 29 bp, Homo sapiens
ttgccctcggccgatcgaaagggagtcgg

SEQ ID NO: 47449 - DNA, 30 bp, Homo sapiens; identical to SEQ ID NO: 4929

SEQ ID NO: 47450 - DNA, 16 bp, Homo sapiens
tgccctcggccgatcg

SEQ ID NO: 47451 - DNA, 19 bp, Homo sapiens
tgccctcggccgatcgaaa

SEQ ID NO: 47452 - DNA, 20 bp, Homo sapiens
tgccctcggccgatcgaaag

SEQ ID NO: 47453 - DNA, 21 bp, Homo sapiens
tgccctcggccgatcgaaagg

SEQ ID NO: 47454 - DNA, 22 bp, Homo sapiens
tgccctcggccgatcgaaaggg

SEQ ID NO: 47455 - DNA, 23 bp, Homo sapiens
tgccctcggccgatcgaaaggga

SEQ ID NO: 47456 - DNA, 24 bp, Homo sapiens
tgccctcggccgatcgaaagggag

SEQ ID NO: 47457 - DNA, 25 bp, Homo sapiens
tgccctcggccgatcgaaagggagt

SEQ ID NO: 47458 - DNA, 27 bp, Homo sapiens
tgccctcggccgatcgaaagggagtcg

SEQ ID NO: 47459 - DNA, 28 bp, Homo sapiens
tgccctcggccgatcgaaagggagtcgg

SEQ ID NO: 47460 - DNA, 30 bp, Homo sapiens
tgccctcggccgatcgaaagggagtcgggt

SEQ ID NO: 47461 - DNA, 19 bp, Homo sapiens
gccctcggccgatcgaaag

SEQ ID NO: 47462 - DNA, 20 bp, Homo sapiens
gccctcggccgatcgaaagg

SEQ ID NO: 47463 - DNA, 21 bp, Homo sapiens
gccctcggccgatcgaaaggg

SEQ ID NO: 47464 - DNA, 22 bp, Homo sapiens
gccctcggccgatcgaaaggga

SEQ ID NO: 47465 - DNA, 23 bp, Homo sapiens
gccctcggccgatcgaaagggag

SEQ ID NO: 47466 - DNA, 24 bp, Homo sapiens
gccctcggccgatcgaaagggagt

SEQ ID NO: 47467 - DNA, 25 bp, Homo sapiens
gccctcggccgatcgaaagggagtc

SEQ ID NO: 47468 - DNA, 27 bp, Homo sapiens
gccctcggccgatcgaaagggagtcgg

SEQ ID NO: 47469 - DNA, 28 bp, Homo sapiens
gccctcggccgatcgaaagggagtcggg

SEQ ID NO: 47470 - DNA, 17 bp, Homo sapiens
ccctcggccgatcgaaa

SEQ ID NO: 47471 - DNA, 18 bp, Homo sapiens
ccctcggccgatcgaaag

SEQ ID NO: 47472 - DNA, 19 bp, Homo sapiens
ccctcggccgatcgaaagg

SEQ ID NO: 47473 - DNA, 20 bp, Homo sapiens
ccctcggccgatcgaaaggg

SEQ ID NO: 47474 - DNA, 21 bp, Homo sapiens
ccctcggccgatcgaaaggga

SEQ ID NO: 47475 - DNA, 22 bp, Homo sapiens
ccctcggccgatcgaaagggag

SEQ ID NO: 47476 - DNA, 23 bp, Homo sapiens
ccctcggccgatcgaaagggagt

SEQ ID NO: 47477 - DNA, 25 bp, Homo sapiens
ccctcggccgatcgaaagggagtcg

SEQ ID NO: 47478 - DNA, 27 bp, Homo sapiens
ccctcggccgatcgaaagggagtcggg

SEQ ID NO: 47479 - DNA, 18 bp, Homo sapiens
cctcggccgatcgaaagg

SEQ ID NO: 47480 - DNA, 19 bp, Homo sapiens
cctcggccgatcgaaaggg

SEQ ID NO: 47481 - DNA, 20 bp, Homo sapiens
cctcggccgatcgaaaggga

SEQ ID NO: 47482 - DNA, 21 bp, Homo sapiens
cctcggccgatcgaaagggag

SEQ ID NO: 47483 - DNA, 22 bp, Homo sapiens
cctcggccgatcgaaagggagt

SEQ ID NO: 47484 - DNA, 23 bp, Homo sapiens
cctcggccgatcgaaagggagtc

SEQ ID NO: 47485 - DNA, 24 bp, Homo sapiens
cctcggccgatcgaaagggagtcg

SEQ ID NO: 47486 - DNA, 25 bp, Homo sapiens
cctcggccgatcgaaagggagtcgg

SEQ ID NO: 47487 - DNA, 26 bp, Homo sapiens
cctcggccgatcgaaagggagtcggg

SEQ ID NO: 47488 - DNA, 16 bp, Homo sapiens
ctcggccgatcgaaag

SEQ ID NO: 47489 - DNA, 17 bp, Homo sapiens
ctcggccgatcgaaagg

SEQ ID NO: 47490 - DNA, 18 bp, Homo sapiens
ctcggccgatcgaaaggg

SEQ ID NO: 47491 - DNA, 19 bp, Homo sapiens
ctcggccgatcgaaaggga

SEQ ID NO: 47492 - DNA, 20 bp, Homo sapiens
ctcggccgatcgaaagggag

SEQ ID NO: 47493 - DNA, 21 bp, Homo sapiens
ctcggccgatcgaaagggagt

SEQ ID NO: 47494 - DNA, 22 bp, Homo sapiens
ctcggccgatcgaaagggagtc

SEQ ID NO: 47495 - DNA, 23 bp, Homo sapiens
ctcggccgatcgaaagggagtcg

SEQ ID NO: 47496 - DNA, 24 bp, Homo sapiens
ctcggccgatcgaaagggagtcgg

SEQ ID NO: 47497 - DNA, 25 bp, Homo sapiens
ctcggccgatcgaaagggagtcggg

SEQ ID NO: 47498 - DNA, 26 bp, Homo sapiens
ctcggccgatcgaaagggagtcgggt

SEQ ID NO: 47499 - DNA, 30 bp, Homo sapiens
ctcggccgatcgaaagggagtcgggttcag

SEQ ID NO: 47500 - DNA, 19 bp, Homo sapiens
tcggccgatcgaaagggag

SEQ ID NO: 47501 - DNA, 20 bp, Homo sapiens
tcggccgatcgaaagggagt

SEQ ID NO: 47502 - DNA, 21 bp, Homo sapiens
tcggccgatcgaaagggagtc

SEQ ID NO: 47503 - DNA, 22 bp, Homo sapiens
tcggccgatcgaaagggagtcg

SEQ ID NO: 47504 - DNA, 23 bp, Homo sapiens
tcggccgatcgaaagggagtcgg

SEQ ID NO: 47505 - DNA, 24 bp, Homo sapiens
tcggccgatcgaaagggagtcggg

SEQ ID NO: 47506 - DNA, 16 bp, Homo sapiens
cggccgatcgaaaggg

SEQ ID NO: 47507 - DNA, 17 bp, Homo sapiens
cggccgatcgaaaggga

SEQ ID NO: 47508 - DNA, 18 bp, Homo sapiens
cggccgatcgaaagggag

SEQ ID NO: 47509 - DNA, 19 bp, Homo sapiens
cggccgatcgaaagggagt

SEQ ID NO: 47510 - DNA, 20 bp, Homo sapiens
cggccgatcgaaagggagtc

SEQ ID NO: 47511 - DNA, 21 bp, Homo sapiens
cggccgatcgaaagggagtcg

SEQ ID NO: 47512 - DNA, 22 bp, Homo sapiens
cggccgatcgaaagggagtcgg

SEQ ID NO: 47513 - DNA, 23 bp, Homo sapiens
cggccgatcgaaagggagtcggg

SEQ ID NO: 47514 - DNA, 21 bp, Homo sapiens
ggccgatcgaaagggagtcgg

SEQ ID NO: 47515 - DNA, 22 bp, Homo sapiens
ggccgatcgaaagggagtcggg

SEQ ID NO: 47516 - DNA, 23 bp, Homo sapiens
ggccgatcgaaagggagtcgggt

SEQ ID NO: 47517 - DNA, 16 bp, Homo sapiens
gccgatcgaaagggag

SEQ ID NO: 47518 - DNA, 17 bp, Homo sapiens
gccgatcgaaagggagt

SEQ ID NO: 47519 - DNA, 18 bp, Homo sapiens
gccgatcgaaagggagtc

SEQ ID NO: 47520 - DNA, 19 bp, Homo sapiens
gccgatcgaaagggagtcg

SEQ ID NO: 47521 - DNA, 20 bp, Homo sapiens
gccgatcgaaagggagtcgg

SEQ ID NO: 47522 - DNA, 21 bp, Homo sapiens
gccgatcgaaagggagtcggg

SEQ ID NO: 47523 - DNA, 22 bp, Homo sapiens
gccgatcgaaagggagtcgggt

SEQ ID NO: 47524 - DNA, 16 bp, Homo sapiens
ccgatcgaaagggagt

SEQ ID NO: 47525 - DNA, 18 bp, Homo sapiens
ccgatcgaaagggagtcg

SEQ ID NO: 47526 - DNA, 19 bp, Homo sapiens
ccgatcgaaagggagtcgg

SEQ ID NO: 47527 - DNA, 20 bp, Homo sapiens
ccgatcgaaagggagtcggg

SEQ ID NO: 47528 - DNA, 21 bp, Homo sapiens
ccgatcgaaagggagtcgggt

SEQ ID NO: 47529 - DNA, 26 bp, Homo sapiens
ccgatcgaaagggagtcgggttcaga

SEQ ID NO: 47530 - DNA, 18 bp, Homo sapiens
cgatcgaaagggagtcgg

SEQ ID NO: 47531 - DNA, 21 bp, Homo sapiens
cgatcgaaagggagtcgggtt

SEQ ID NO: 47532 - DNA, 22 bp, Homo sapiens
cgatcgaaagggagtcgggttc

SEQ ID NO: 47533 - DNA, 24 bp, Homo sapiens
cgatcgaaagggagtcgggttcag

SEQ ID NO: 47534 - DNA, 25 bp, Homo sapiens
cgatcgaaagggagtcgggttcaga

SEQ ID NO: 47535 - DNA, 16 bp, Homo sapiens
gatcgaaagggagtcg

SEQ ID NO: 47536 - DNA, 17 bp, Homo sapiens
gatcgaaagggagtcgg

SEQ ID NO: 47537 - DNA, 18 bp, Homo sapiens
gatcgaaagggagtcggg

SEQ ID NO: 47538 - DNA, 19 bp, Homo sapiens
gatcgaaagggagtcgggt

SEQ ID NO: 47539 - DNA, 20 bp, Homo sapiens
gatcgaaagggagtcgggtt

SEQ ID NO: 47540 - DNA, 21 bp, Homo sapiens
gatcgaaagggagtcgggttc

SEQ ID NO: 47541 - DNA, 22 bp, Homo sapiens
gatcgaaagggagtcgggttca

SEQ ID NO: 47542 - DNA, 23 bp, Homo sapiens
gatcgaaagggagtcgggttcag

SEQ ID NO: 47543 - DNA, 24 bp, Homo sapiens
gatcgaaagggagtcgggttcaga

SEQ ID NO: 47544 - DNA, 26 bp, Homo sapiens
gatcgaaagggagtcgggttcagatc

SEQ ID NO: 47545 - DNA, 16 bp, Homo sapiens
atcgaaagggagtcgg

SEQ ID NO: 47546 - DNA, 18 bp, Homo sapiens
atcgaaagggagtcgggt

SEQ ID NO: 47547 - DNA, 19 bp, Homo sapiens
atcgaaagggagtcgggtt

SEQ ID NO: 47548 - DNA, 20 bp, Homo sapiens
atcgaaagggagtcgggttc

SEQ ID NO: 47549 - DNA, 22 bp, Homo sapiens
atcgaaagggagtcgggttcag

SEQ ID NO: 47550 - DNA, 23 bp, Homo sapiens
atcgaaagggagtcgggttcaga

SEQ ID NO: 47551 - DNA, 25 bp, Homo sapiens
atcgaaagggagtcgggttcagatc

SEQ ID NO: 47552 - DNA, 17 bp, Homo sapiens
tcgaaagggagtcgggt

SEQ ID NO: 47553 - DNA, 18 bp, Homo sapiens
tcgaaagggagtcgggtt

SEQ ID NO: 47554 - DNA, 19 bp, Homo sapiens
tcgaaagggagtcgggttc

SEQ ID NO: 47555 - DNA, 20 bp, Homo sapiens
tcgaaagggagtcgggttca

SEQ ID NO: 47556 - DNA, 21 bp, Homo sapiens
tcgaaagggagtcgggttcag

SEQ ID NO: 47557 - DNA, 22 bp, Homo sapiens
tcgaaagggagtcgggttcaga

SEQ ID NO: 47558 - DNA, 23 bp, Homo sapiens
tcgaaagggagtcgggttcagat

SEQ ID NO: 47559 - DNA, 16 bp, Homo sapiens
cgaaagggagtcgggt

SEQ ID NO: 47560 - DNA, 17 bp, Homo sapiens
cgaaagggagtcgggtt

SEQ ID NO: 47561 - DNA, 18 bp, Homo sapiens
cgaaagggagtcgggttc

SEQ ID NO: 47562 - DNA, 19 bp, Homo sapiens
cgaaagggagtcgggttca

SEQ ID NO: 47563 - DNA, 20 bp, Homo sapiens
cgaaagggagtcgggttcag

SEQ ID NO: 47564 - DNA, 21 bp, Homo sapiens
cgaaagggagtcgggttcaga

SEQ ID NO: 47565 - DNA, 22 bp, Homo sapiens
cgaaagggagtcgggttcagat

SEQ ID NO: 47566 - DNA, 23 bp, Homo sapiens
cgaaagggagtcgggttcagatc

SEQ ID NO: 47567 - DNA, 16 bp, Homo sapiens
gaaagggagtcgggtt

SEQ ID NO: 47568 - DNA, 17 bp, Homo sapiens
gaaagggagtcgggttc

SEQ ID NO: 47569 - DNA, 18 bp, Homo sapiens
gaaagggagtcgggttca

SEQ ID NO: 47570 - DNA, 19 bp, Homo sapiens
gaaagggagtcgggttcag

SEQ ID NO: 47571 - DNA, 20 bp, Homo sapiens
gaaagggagtcgggttcaga

SEQ ID NO: 47572 - DNA, 21 bp, Homo sapiens
gaaagggagtcgggttcagat

SEQ ID NO: 47573 - DNA, 22 bp, Homo sapiens
gaaagggagtcgggttcagatc

SEQ ID NO: 47574 - DNA, 23 bp, Homo sapiens
gaaagggagtcgggttcagatcc

SEQ ID NO: 47575 - DNA, 16 bp, Homo sapiens
aaagggagtcgggttc

SEQ ID NO: 47576 - DNA, 17 bp, Homo sapiens
aaagggagtcgggttca

SEQ ID NO: 47577 - DNA, 18 bp, Homo sapiens
aaagggagtcgggttcag

SEQ ID NO: 47578 - DNA, 19 bp, Homo sapiens
aaagggagtcgggttcaga

SEQ ID NO: 47579 - DNA, 20 bp, Homo sapiens
aaagggagtcgggttcagat

SEQ ID NO: 47580 - DNA, 21 bp, Homo sapiens
aaagggagtcgggttcagatc

SEQ ID NO: 47581 - DNA, 22 bp, Homo sapiens
aaagggagtcgggttcagatcc

SEQ ID NO: 47582 - DNA, 16 bp, Homo sapiens
aagggagtcgggttca

SEQ ID NO: 47583 - DNA, 17 bp, Homo sapiens
aagggagtcgggttcag

SEQ ID NO: 47584 - DNA, 18 bp, Homo sapiens
aagggagtcgggttcaga

SEQ ID NO: 47585 - DNA, 19 bp, Homo sapiens
aagggagtcgggttcagat

SEQ ID NO: 47586 - DNA, 20 bp, Homo sapiens
aagggagtcgggttcagatc

SEQ ID NO: 47587 - DNA, 16 bp, Homo sapiens
agggagtcgggttcag

SEQ ID NO: 47588 - DNA, 17 bp, Homo sapiens
agggagtcgggttcaga

SEQ ID NO: 47589 - DNA, 18 bp, Homo sapiens
agggagtcgggttcagat

SEQ ID NO: 47590 - DNA, 16 bp, Homo sapiens
gggagtcgggttcaga

SEQ ID NO: 47591 - DNA, 24 bp, Homo sapiens
tcgggttcagatccccgaatccgg

SEQ ID NO: 47592 - DNA, 19 bp, Homo sapiens
gttcagatccccgaatccg

SEQ ID NO: 47593 - DNA, 20 bp, Homo sapiens
gttcagatccccgaatccgg

SEQ ID NO: 47594 - DNA, 21 bp, Homo sapiens
gttcagatccccgaatccgga

SEQ ID NO: 47595 - DNA, 22 bp, Homo sapiens
gttcagatccccgaatccggag

SEQ ID NO: 47596 - DNA, 27 bp, Homo sapiens
gttcagatccccgaatccggagtggcg

SEQ ID NO: 47597 - DNA, 29 bp, Homo sapiens
gttcagatccccgaatccggagtggcgga

SEQ ID NO: 47598 - DNA, 18 bp, Homo sapiens
ttcagatccccgaatccg

SEQ ID NO: 47599 - DNA, 19 bp, Homo sapiens
ttcagatccccgaatccgg

SEQ ID NO: 47600 - DNA, 20 bp, Homo sapiens
ttcagatccccgaatccgga

SEQ ID NO: 47601 - DNA, 22 bp, Homo sapiens
ttcagatccccgaatccggagt

SEQ ID NO: 47602 - DNA, 24 bp, Homo sapiens
ttcagatccccgaatccggagtgg

SEQ ID NO: 47603 - DNA, 26 bp, Homo sapiens
ttcagatccccgaatccggagtggcg

SEQ ID NO: 47604 - DNA, 18 bp, Homo sapiens
tcagatccccgaatccgg

SEQ ID NO: 47605 - DNA, 19 bp, Homo sapiens
tcagatccccgaatccgga

SEQ ID NO: 47606 - DNA, 18 bp, Homo sapiens
cagatccccgaatccgga

SEQ ID NO: 47607 - DNA, 20 bp, Homo sapiens
cagatccccgaatccggagt

SEQ ID NO: 47608 - DNA, 24 bp, Homo sapiens
gatccccgaatccggagtggcgga

SEQ ID NO: 47609 - DNA, 19 bp, Homo sapiens
atccccgaatccggagtgg

SEQ ID NO: 47610 - DNA, 21 bp, Homo sapiens
atccccgaatccggagtggcg

SEQ ID NO: 47611 - DNA, 17 bp, Homo sapiens
tccccgaatccggagtg

SEQ ID NO: 47612 - DNA, 18 bp, Homo sapiens
tccccgaatccggagtgg

SEQ ID NO: 47613 - DNA, 20 bp, Homo sapiens
tccccgaatccggagtggcg

SEQ ID NO: 47614 - DNA, 22 bp, Homo sapiens
tccccgaatccggagtggcgga

SEQ ID NO: 47615 - DNA, 17 bp, Homo sapiens
ccccgaatccggagtgg

SEQ ID NO: 47616 - DNA, 19 bp, Homo sapiens
ccccgaatccggagtggcg

SEQ ID NO: 47617 - DNA, 20 bp, Homo sapiens
ccccgaatccggagtggcgg

SEQ ID NO: 47618 - DNA, 21 bp, Homo sapiens
ccccgaatccggagtggcgga

SEQ ID NO: 47619 - DNA, 23 bp, Homo sapiens
ccccgaatccggagtggcggaga

SEQ ID NO: 47620 - DNA, 21 bp, Homo sapiens
gaatccggagtggcggagatg

SEQ ID NO: 47621 - DNA, 22 bp, Homo sapiens
gaatccggagtggcggagatgg

SEQ ID NO: 47622 - DNA, 23 bp, Homo sapiens
gaatccggagtggcggagatggg

SEQ ID NO: 47623 - DNA, 21 bp, Homo sapiens
aatccggagtggcggagatgg

SEQ ID NO: 47624 - DNA, 22 bp, Homo sapiens
aatccggagtggcggagatggg

SEQ ID NO: 47625 - DNA, 19 bp, Homo sapiens
ccggagtggcggagatggg

SEQ ID NO: 47626 - DNA, 20 bp, Homo sapiens
ccggagtggcggagatgggc

SEQ ID NO: 47627 - DNA, 21 bp, Homo sapiens
ccggagtggcggagatgggcg

SEQ ID NO: 47628 - DNA, 20 bp, Homo sapiens
cggagtggcggagatgggcg

SEQ ID NO: 47629 - DNA, 19 bp, Homo sapiens
ggagtggcggagatgggcg

SEQ ID NO: 47630 - DNA, 22 bp, Homo sapiens
ggagtggcggagatgggcgccg

SEQ ID NO: 47631 - DNA, 23 bp, Homo sapiens
ggagtggcggagatgggcgccgc

SEQ ID NO: 47632 - DNA, 19 bp, Homo sapiens
gtggcggagatgggcgccg

SEQ ID NO: 47633 - DNA, 20 bp, Homo sapiens
gtggcggagatgggcgccgc

SEQ ID NO: 47634 - DNA, 30 bp, Homo sapiens
gcgccgcgaggcgtccagtgcggtaacgcg

SEQ ID NO: 47635 - DNA, 17 bp, Homo sapiens
cgccgcgaggcgtccag

SEQ ID NO: 47636 - DNA, 21 bp, Homo sapiens
cgccgcgaggcgtccagtgcg

SEQ ID NO: 47637 - DNA, 22 bp, Homo sapiens
cgccgcgaggcgtccagtgcgg

SEQ ID NO: 47638 - DNA, 29 bp, Homo sapiens
cgccgcgaggcgtccagtgcggtaacgcg

SEQ ID NO: 47639 - DNA, 16 bp, Homo sapiens
gccgcgaggcgtccag

SEQ ID NO: 47640 - DNA, 17 bp, Homo sapiens
gccgcgaggcgtccagt

SEQ ID NO: 47641 - DNA, 18 bp, Homo sapiens
gccgcgaggcgtccagtg

SEQ ID NO: 47642 - DNA, 20 bp, Homo sapiens
gccgcgaggcgtccagtgcg

SEQ ID NO: 47643 - DNA, 21 bp, Homo sapiens
gccgcgaggcgtccagtgcgg

SEQ ID NO: 47644 - DNA, 22 bp, Homo sapiens
gccgcgaggcgtccagtgcggt

SEQ ID NO: 47645 - DNA, 23 bp, Homo sapiens
gccgcgaggcgtccagtgcggta

SEQ ID NO: 47646 - DNA, 28 bp, Homo sapiens
gccgcgaggcgtccagtgcggtaacgcg

SEQ ID NO: 47647 - DNA, 29 bp, Homo sapiens
gccgcgaggcgtccagtgcggtaacgcga

SEQ ID NO: 47648 - DNA, 30 bp, Homo sapiens
gccgcgaggcgtccagtgcggtaacgcgac

SEQ ID NO: 47649 - DNA, 27 bp, Homo sapiens
ccgcgaggcgtccagtgcggtaacgcg

SEQ ID NO: 47650 - DNA, 30 bp, Homo sapiens
ccgcgaggcgtccagtgcggtaacgcgacc

SEQ ID NO: 47651 - DNA, 26 bp, Homo sapiens
cgcgaggcgtccagtgcggtaacgcg

SEQ ID NO: 47652 - DNA, 28 bp, Homo sapiens
cgcgaggcgtccagtgcggtaacgcgac

SEQ ID NO: 47653 - DNA, 30 bp, Homo sapiens
cgcgaggcgtccagtgcggtaacgcgaccg

SEQ ID NO: 47654 - DNA, 18 bp, Homo sapiens
gcgaggcgtccagtgcgg

SEQ ID NO: 47655 - DNA, 19 bp, Homo sapiens
gcgaggcgtccagtgcggt

SEQ ID NO: 47656 - DNA, 25 bp, Homo sapiens
gcgaggcgtccagtgcggtaacgcg

SEQ ID NO: 47657 - DNA, 26 bp, Homo sapiens
gcgaggcgtccagtgcggtaacgcga

SEQ ID NO: 47658 - DNA, 27 bp, Homo sapiens
gcgaggcgtccagtgcggtaacgcgac

SEQ ID NO: 47659 - DNA, 28 bp, Homo sapiens
gcgaggcgtccagtgcggtaacgcgacc

SEQ ID NO: 47660 - DNA, 29 bp, Homo sapiens
gcgaggcgtccagtgcggtaacgcgaccg

SEQ ID NO: 47661 - DNA, 24 bp, Homo sapiens
cgaggcgtccagtgcggtaacgcg

SEQ ID NO: 47662 - DNA, 25 bp, Homo sapiens
cgaggcgtccagtgcggtaacgcga

SEQ ID NO: 47663 - DNA, 26 bp, Homo sapiens
cgaggcgtccagtgcggtaacgcgac

SEQ ID NO: 47664 - DNA, 27 bp, Homo sapiens
cgaggcgtccagtgcggtaacgcgacc

SEQ ID NO: 47665 - DNA, 28 bp, Homo sapiens
cgaggcgtccagtgcggtaacgcgaccg

SEQ ID NO: 47666 - DNA, 23 bp, Homo sapiens
gaggcgtccagtgcggtaacgcg

SEQ ID NO: 47667 - DNA, 24 bp, Homo sapiens
gaggcgtccagtgcggtaacgcga

SEQ ID NO: 47668 - DNA, 25 bp, Homo sapiens
gaggcgtccagtgcggtaacgcgac

SEQ ID NO: 47669 - DNA, 26 bp, Homo sapiens
gaggcgtccagtgcggtaacgcgacc

SEQ ID NO: 47670 - DNA, 27 bp, Homo sapiens
gaggcgtccagtgcggtaacgcgaccg

SEQ ID NO: 47671 - DNA, 22 bp, Homo sapiens
aggcgtccagtgcggtaacgcg

SEQ ID NO: 47672 - DNA, 23 bp, Homo sapiens
aggcgtccagtgcggtaacgcga

SEQ ID NO: 47673 - DNA, 24 bp, Homo sapiens
aggcgtccagtgcggtaacgcgac

SEQ ID NO: 47674 - DNA, 25 bp, Homo sapiens
aggcgtccagtgcggtaacgcgacc

SEQ ID NO: 47675 - DNA, 26 bp, Homo sapiens
aggcgtccagtgcggtaacgcgaccg

SEQ ID NO: 47676 - DNA, 30 bp, Homo sapiens
aggcgtccagtgcggtaacgcgaccgatcc

SEQ ID NO: 47677 - DNA, 21 bp, Homo sapiens
ggcgtccagtgcggtaacgcg

SEQ ID NO: 47678 - DNA, 30 bp, Homo sapiens
ggcgtccagtgcggtaacgcgaccgatccc

SEQ ID NO: 47679 - DNA, 20 bp, Homo sapiens
gcgtccagtgcggtaacgcg

SEQ ID NO: 47680 - DNA, 24 bp, Homo sapiens
gcgtccagtgcggtaacgcgaccg

SEQ ID NO: 47681 - DNA, 30 bp, Homo sapiens
gcgtccagtgcggtaacgcgaccgatcccg

SEQ ID NO: 47682 - DNA, 17 bp, Homo sapiens
cgtccagtgcggtaacg

SEQ ID NO: 47683 - DNA, 18 bp, Homo sapiens
cgtccagtgcggtaacgc

SEQ ID NO: 47684 - DNA, 19 bp, Homo sapiens
cgtccagtgcggtaacgcg

SEQ ID NO: 47685 - DNA, 20 bp, Homo sapiens
cgtccagtgcggtaacgcga

SEQ ID NO: 47686 - DNA, 21 bp, Homo sapiens
cgtccagtgcggtaacgcgac

SEQ ID NO: 47687 - DNA, 22 bp, Homo sapiens
cgtccagtgcggtaacgcgacc

SEQ ID NO: 47688 - DNA, 23 bp, Homo sapiens
cgtccagtgcggtaacgcgaccg

SEQ ID NO: 47689 - DNA, 24 bp, Homo sapiens
cgtccagtgcggtaacgcgaccga

SEQ ID NO: 47690 - DNA, 25 bp, Homo sapiens
cgtccagtgcggtaacgcgaccgat

SEQ ID NO: 47691 - DNA, 26 bp, Homo sapiens
cgtccagtgcggtaacgcgaccgatc

SEQ ID NO: 47692 - DNA, 27 bp, Homo sapiens
cgtccagtgcggtaacgcgaccgatcc

SEQ ID NO: 47693 - DNA, 28 bp, Homo sapiens
cgtccagtgcggtaacgcgaccgatccc

SEQ ID NO: 47694 - DNA, 29 bp, Homo sapiens
cgtccagtgcggtaacgcgaccgatcccg

SEQ ID NO: 47695 - DNA, 30 bp, Homo sapiens
cgtccagtgcggtaacgcgaccgatcccgg

SEQ ID NO: 47696 - DNA, 18 bp, Homo sapiens
gtccagtgcggtaacgcg

SEQ ID NO: 47697 - DNA, 19 bp, Homo sapiens
gtccagtgcggtaacgcga

SEQ ID NO: 47698 - DNA, 20 bp, Homo sapiens
gtccagtgcggtaacgcgac

SEQ ID NO: 47699 - DNA, 21 bp, Homo sapiens
gtccagtgcggtaacgcgacc

SEQ ID NO: 47700 - DNA, 22 bp, Homo sapiens
gtccagtgcggtaacgcgaccg

SEQ ID NO: 47701 - DNA, 25 bp, Homo sapiens
gtccagtgcggtaacgcgaccgatc

SEQ ID NO: 47702 - DNA, 26 bp, Homo sapiens
gtccagtgcggtaacgcgaccgatcc

SEQ ID NO: 47703 - DNA, 29 bp, Homo sapiens
gtccagtgcggtaacgcgaccgatcccgg

SEQ ID NO: 47704 - DNA, 30 bp, Homo sapiens
tccagtgcggtaacgcgaccgatcccggag

SEQ ID NO: 47705 - DNA, 20 bp, Homo sapiens
ccagtgcggtaacgcgaccg

SEQ ID NO: 47706 - DNA, 27 bp, Homo sapiens
ccagtgcggtaacgcgaccgatcccgg

SEQ ID NO: 47707 - DNA, 28 bp, Homo sapiens
ccagtgcggtaacgcgaccgatcccgga

SEQ ID NO: 47708 - DNA, 29 bp, Homo sapiens
ccagtgcggtaacgcgaccgatcccggag

SEQ ID NO: 47709 - DNA, 19 bp, Homo sapiens
cagtgcggtaacgcgaccg

SEQ ID NO: 47710 - DNA, 26 bp, Homo sapiens
cagtgcggtaacgcgaccgatcccgg

SEQ ID NO: 47711 - DNA, 27 bp, Homo sapiens
cagtgcggtaacgcgaccgatcccgga

SEQ ID NO: 47712 - DNA, 28 bp, Homo sapiens
cagtgcggtaacgcgaccgatcccggag

SEQ ID NO: 47713 - DNA, 29 bp, Homo sapiens
cagtgcggtaacgcgaccgatcccggaga

SEQ ID NO: 47714 - DNA, 25 bp, Homo sapiens
agtgcggtaacgcgaccgatcccgg

SEQ ID NO: 47715 - DNA, 26 bp, Homo sapiens
agtgcggtaacgcgaccgatcccgga

SEQ ID NO: 47716 - DNA, 27 bp, Homo sapiens
agtgcggtaacgcgaccgatcccggag

SEQ ID NO: 47717 - DNA, 28 bp, Homo sapiens
agtgcggtaacgcgaccgatcccggaga

SEQ ID NO: 47718 - DNA, 29 bp, Homo sapiens
agtgcggtaacgcgaccgatcccggagaa

SEQ ID NO: 47719 - DNA, 30 bp, Homo sapiens; identical to SEQ ID NO: 4950

SEQ ID NO: 47720 - DNA, 20 bp, Homo sapiens
gtgcggtaacgcgaccgatc

SEQ ID NO: 47721 - DNA, 21 bp, Homo sapiens
gtgcggtaacgcgaccgatcc

SEQ ID NO: 47722 - DNA, 22 bp, Homo sapiens
gtgcggtaacgcgaccgatccc

SEQ ID NO: 47723 - DNA, 24 bp, Homo sapiens
gtgcggtaacgcgaccgatcccgg

SEQ ID NO: 47724 - DNA, 25 bp, Homo sapiens
gtgcggtaacgcgaccgatcccgga

SEQ ID NO: 47725 - DNA, 26 bp, Homo sapiens
gtgcggtaacgcgaccgatcccggag

SEQ ID NO: 47726 - DNA, 27 bp, Homo sapiens
gtgcggtaacgcgaccgatcccggaga

SEQ ID NO: 47727 - DNA, 28 bp, Homo sapiens
gtgcggtaacgcgaccgatcccggagaa

SEQ ID NO: 47728 - DNA, 29 bp, Homo sapiens
gtgcggtaacgcgaccgatcccggagaag

SEQ ID NO: 47729 - DNA, 30 bp, Homo sapiens; identical to SEQ ID NO: 4956

SEQ ID NO: 47730 - DNA, 23 bp, Homo sapiens
tgcggtaacgcgaccgatcccgg

SEQ ID NO: 47731 - DNA, 24 bp, Homo sapiens
tgcggtaacgcgaccgatcccgga

SEQ ID NO: 47732 - DNA, 25 bp, Homo sapiens
tgcggtaacgcgaccgatcccggag

SEQ ID NO: 47733 - DNA, 26 bp, Homo sapiens
tgcggtaacgcgaccgatcccggaga

SEQ ID NO: 47734 - DNA, 27 bp, Homo sapiens
tgcggtaacgcgaccgatcccggagaa

SEQ ID NO: 47735 - DNA, 28 bp, Homo sapiens
tgcggtaacgcgaccgatcccggagaag

SEQ ID NO: 47736 - DNA, 29 bp, Homo sapiens
tgcggtaacgcgaccgatcccggagaagc

SEQ ID NO: 47737 - DNA, 30 bp, Homo sapiens; identical to SEQ ID NO: 22963

SEQ ID NO: 47738 - DNA, 22 bp, Homo sapiens
gcggtaacgcgaccgatcccgg

SEQ ID NO: 47739 - DNA, 23 bp, Homo sapiens
gcggtaacgcgaccgatcccgga

SEQ ID NO: 47740 - DNA, 24 bp, Homo sapiens
gcggtaacgcgaccgatcccggag

SEQ ID NO: 47741 - DNA, 25 bp, Homo sapiens
gcggtaacgcgaccgatcccggaga

SEQ ID NO: 47742 - DNA, 27 bp, Homo sapiens
gcggtaacgcgaccgatcccggagaag

SEQ ID NO: 47743 - DNA, 28 bp, Homo sapiens
gcggtaacgcgaccgatcccggagaagc

SEQ ID NO: 47744 - DNA, 21 bp, Homo sapiens
cggtaacgcgaccgatcccgg

SEQ ID NO: 47745 - DNA, 22 bp, Homo sapiens
cggtaacgcgaccgatcccgga

SEQ ID NO: 47746 - DNA, 23 bp, Homo sapiens
cggtaacgcgaccgatcccggag

SEQ ID NO: 47747 - DNA, 24 bp, Homo sapiens
cggtaacgcgaccgatcccggaga

SEQ ID NO: 47748 - DNA, 25 bp, Homo sapiens
cggtaacgcgaccgatcccggagaa

SEQ ID NO: 47749 - DNA, 26 bp, Homo sapiens
cggtaacgcgaccgatcccggagaag

SEQ ID NO: 47750 - DNA, 29 bp, Homo sapiens
cggtaacgcgaccgatcccggagaagccg

SEQ ID NO: 47751 - DNA, 20 bp, Homo sapiens
ggtaacgcgaccgatcccgg

SEQ ID NO: 47752 - DNA, 21 bp, Homo sapiens
ggtaacgcgaccgatcccgga

SEQ ID NO: 47753 - DNA, 22 bp, Homo sapiens
ggtaacgcgaccgatcccggag

SEQ ID NO: 47754 - DNA, 23 bp, Homo sapiens
ggtaacgcgaccgatcccggaga

SEQ ID NO: 47755 - DNA, 24 bp, Homo sapiens
ggtaacgcgaccgatcccggagaa

SEQ ID NO: 47756 - DNA, 25 bp, Homo sapiens
ggtaacgcgaccgatcccggagaag

SEQ ID NO: 47757 - DNA, 26 bp, Homo sapiens
ggtaacgcgaccgatcccggagaagc

SEQ ID NO: 47758 - DNA, 18 bp, Homo sapiens
gtaacgcgaccgatcccg

SEQ ID NO: 47759 - DNA, 19 bp, Homo sapiens
gtaacgcgaccgatcccgg

SEQ ID NO: 47760 - DNA, 20 bp, Homo sapiens
gtaacgcgaccgatcccgga

SEQ ID NO: 47761 - DNA, 21 bp, Homo sapiens
gtaacgcgaccgatcccggag

SEQ ID NO: 47762 - DNA, 22 bp, Homo sapiens
gtaacgcgaccgatcccggaga

SEQ ID NO: 47763 - DNA, 23 bp, Homo sapiens
gtaacgcgaccgatcccggagaa

SEQ ID NO: 47764 - DNA, 24 bp, Homo sapiens
gtaacgcgaccgatcccggagaag

SEQ ID NO: 47765 - DNA, 25 bp, Homo sapiens
gtaacgcgaccgatcccggagaagc

SEQ ID NO: 47766 - DNA, 26 bp, Homo sapiens
gtaacgcgaccgatcccggagaagcc

SEQ ID NO: 47767 - DNA, 27 bp, Homo sapiens
gtaacgcgaccgatcccggagaagccg

SEQ ID NO: 47768 - DNA, 30 bp, Homo sapiens
gtaacgcgaccgatcccggagaagccggcg

SEQ ID NO: 47769 - DNA, 17 bp, Homo sapiens
taacgcgaccgatcccg

SEQ ID NO: 47770 - DNA, 18 bp, Homo sapiens
taacgcgaccgatcccgg

SEQ ID NO: 47771 - DNA, 19 bp, Homo sapiens
taacgcgaccgatcccgga

SEQ ID NO: 47772 - DNA, 20 bp, Homo sapiens
taacgcgaccgatcccggag

SEQ ID NO: 47773 - DNA, 21 bp, Homo sapiens
taacgcgaccgatcccggaga

SEQ ID NO: 47774 - DNA, 22 bp, Homo sapiens
taacgcgaccgatcccggagaa

SEQ ID NO: 47775 - DNA, 23 bp, Homo sapiens
taacgcgaccgatcccggagaag

SEQ ID NO: 47776 - DNA, 24 bp, Homo sapiens
taacgcgaccgatcccggagaagc

SEQ ID NO: 47777 - DNA, 25 bp, Homo sapiens
taacgcgaccgatcccggagaagcc

SEQ ID NO: 47778 - DNA, 26 bp, Homo sapiens
taacgcgaccgatcccggagaagccg

SEQ ID NO: 47779 - DNA, 27 bp, Homo sapiens
taacgcgaccgatcccggagaagccgg

SEQ ID NO: 47780 - DNA, 29 bp, Homo sapiens
taacgcgaccgatcccggagaagccggcg

SEQ ID NO: 47781 - DNA, 30 bp, Homo sapiens
taacgcgaccgatcccggagaagccggcgg

SEQ ID NO: 47782 - DNA, 16 bp, Homo sapiens
aacgcgaccgatcccg

SEQ ID NO: 47783 - DNA, 17 bp, Homo sapiens
aacgcgaccgatcccgg

SEQ ID NO: 47784 - DNA, 18 bp, Homo sapiens
aacgcgaccgatcccgga

SEQ ID NO: 47785 - DNA, 19 bp, Homo sapiens
aacgcgaccgatcccggag

SEQ ID NO: 47786 - DNA, 20 bp, Homo sapiens
aacgcgaccgatcccggaga

SEQ ID NO: 47787 - DNA, 21 bp, Homo sapiens
aacgcgaccgatcccggagaa

SEQ ID NO: 47788 - DNA, 22 bp, Homo sapiens
aacgcgaccgatcccggagaag

SEQ ID NO: 47789 - DNA, 23 bp, Homo sapiens
aacgcgaccgatcccggagaagc

SEQ ID NO: 47790 - DNA, 24 bp, Homo sapiens
aacgcgaccgatcccggagaagcc

SEQ ID NO: 47791 - DNA, 25 bp, Homo sapiens
aacgcgaccgatcccggagaagccg

SEQ ID NO: 47792 - DNA, 26 bp, Homo sapiens
aacgcgaccgatcccggagaagccgg

SEQ ID NO: 47793 - DNA, 28 bp, Homo sapiens
aacgcgaccgatcccggagaagccggcg

SEQ ID NO: 47794 - DNA, 29 bp, Homo sapiens
aacgcgaccgatcccggagaagccggcgg

SEQ ID NO: 47795 - DNA, 30 bp, Homo sapiens
aacgcgaccgatcccggagaagccggcggg

SEQ ID NO: 47796 - DNA, 16 bp, Homo sapiens
acgcgaccgatcccgg

SEQ ID NO: 47797 - DNA, 17 bp, Homo sapiens
acgcgaccgatcccgga

SEQ ID NO: 47798 - DNA, 18 bp, Homo sapiens
acgcgaccgatcccggag

SEQ ID NO: 47799 - DNA, 19 bp, Homo sapiens
acgcgaccgatcccggaga

SEQ ID NO: 47800 - DNA, 20 bp, Homo sapiens
acgcgaccgatcccggagaa

SEQ ID NO: 47801 - DNA, 21 bp, Homo sapiens
acgcgaccgatcccggagaag

SEQ ID NO: 47802 - DNA, 22 bp, Homo sapiens
acgcgaccgatcccggagaagc

SEQ ID NO: 47803 - DNA, 24 bp, Homo sapiens
acgcgaccgatcccggagaagccg

SEQ ID NO: 47804 - DNA, 16 bp, Homo sapiens
cgcgaccgatcccgga

SEQ ID NO: 47805 - DNA, 17 bp, Homo sapiens
cgcgaccgatcccggag

SEQ ID NO: 47806 - DNA, 18 bp, Homo sapiens
cgcgaccgatcccggaga

SEQ ID NO: 47807 - DNA, 20 bp, Homo sapiens
cgcgaccgatcccggagaag

SEQ ID NO: 47808 - DNA, 23 bp, Homo sapiens
cgcgaccgatcccggagaagccg

SEQ ID NO: 47809 - DNA, 20 bp, Homo sapiens
gcgaccgatcccggagaagc

SEQ ID NO: 47810 - DNA, 18 bp, Homo sapiens
cgaccgatcccggagaag

SEQ ID NO: 47811 - DNA, 21 bp, Homo sapiens
cgaccgatcccggagaagccg

SEQ ID NO: 47812 - DNA, 22 bp, Homo sapiens
cgaccgatcccggagaagccgg

SEQ ID NO: 47813 - DNA, 16 bp, Homo sapiens
accgatcccggagaag

SEQ ID NO: 47814 - DNA, 19 bp, Homo sapiens
accgatcccggagaagccg

SEQ ID NO: 47815 - DNA, 20 bp, Homo sapiens
atcccggagaagccggcggg

SEQ ID NO: 47816 - DNA, 22 bp, Homo sapiens
atcccggagaagccggcgggag

SEQ ID NO: 47817 - DNA, 23 bp, Homo sapiens
ggagaagccggcgggagccccgg

SEQ ID NO: 47818 - DNA, 17 bp, Homo sapiens
gagaagccggcgggagc

SEQ ID NO: 47819 - DNA, 21 bp, Homo sapiens
gagaagccggcgggagccccg

SEQ ID NO: 47820 - DNA, 22 bp, Homo sapiens
gagaagccggcgggagccccgg

SEQ ID NO: 47821 - DNA, 16 bp, Homo sapiens
agaagccggcgggagc

SEQ ID NO: 47822 - DNA, 21 bp, Homo sapiens
agaagccggcgggagccccgg

SEQ ID NO: 47823 - DNA, 19 bp, Homo sapiens
gaagccggcgggagccccg

SEQ ID NO: 47824 - DNA, 20 bp, Homo sapiens
gaagccggcgggagccccgg

SEQ ID NO: 47825 - DNA, 21 bp, Homo sapiens
gaagccggcgggagccccggg

SEQ ID NO: 47826 - DNA, 18 bp, Homo sapiens
aagccggcgggagccccg

SEQ ID NO: 47827 - DNA, 19 bp, Homo sapiens
aagccggcgggagccccgg

SEQ ID NO: 47828 - DNA, 20 bp, Homo sapiens
aagccggcgggagccccggg

SEQ ID NO: 47829 - DNA, 21 bp, Homo sapiens
aagccggcgggagccccgggg

SEQ ID NO: 47830 - DNA, 23 bp, Homo sapiens
aagccggcgggagccccggggag

SEQ ID NO: 47831 - DNA, 24 bp, Homo sapiens
aagccggcgggagccccggggaga

SEQ ID NO: 47832 - DNA, 25 bp, Homo sapiens
aagccggcgggagccccggggagag

SEQ ID NO: 47833 - DNA, 26 bp, Homo sapiens
aagccggcgggagccccggggagagt

SEQ ID NO: 47834 - DNA, 23 bp, Homo sapiens
agccggcgggagccccggggaga

SEQ ID NO: 47835 - DNA, 24 bp, Homo sapiens
agccggcgggagccccggggagag

SEQ ID NO: 47836 - DNA, 25 bp, Homo sapiens
agccggcgggagccccggggagagt

SEQ ID NO: 47837 - DNA, 16 bp, Homo sapiens
gccggcgggagccccg

SEQ ID NO: 47838 - DNA, 17 bp, Homo sapiens
gccggcgggagccccgg

SEQ ID NO: 47839 - DNA, 18 bp, Homo sapiens
gccggcgggagccccggg

SEQ ID NO: 47840 - DNA, 19 bp, Homo sapiens
gccggcgggagccccgggg

SEQ ID NO: 47841 - DNA, 20 bp, Homo sapiens
gccggcgggagccccgggga

SEQ ID NO: 47842 - DNA, 21 bp, Homo sapiens
gccggcgggagccccggggag

SEQ ID NO: 47843 - DNA, 22 bp, Homo sapiens
gccggcgggagccccggggaga

SEQ ID NO: 47844 - DNA, 23 bp, Homo sapiens
gccggcgggagccccggggagag

SEQ ID NO: 47845 - DNA, 24 bp, Homo sapiens
gccggcgggagccccggggagagt

SEQ ID NO: 47846 - DNA, 25 bp, Homo sapiens
gccggcgggagccccggggagagtt

SEQ ID NO: 47847 - DNA, 18 bp, Homo sapiens
ccggcgggagccccgggg

SEQ ID NO: 47848 - DNA, 19 bp, Homo sapiens
ccggcgggagccccgggga

SEQ ID NO: 47849 - DNA, 17 bp, Homo sapiens
cggcgggagccccgggg

SEQ ID NO: 47850 - DNA, 18 bp, Homo sapiens
cggcgggagccccgggga

SEQ ID NO: 47851 - DNA, 16 bp, Homo sapiens
ggcgggagccccgggg

SEQ ID NO: 47852 - DNA, 17 bp, Homo sapiens
ggcgggagccccgggga

SEQ ID NO: 47853 - DNA, 18 bp, Homo sapiens
ggcgggagccccggggag

SEQ ID NO: 47854 - DNA, 19 bp, Homo sapiens
ggcgggagccccggggaga

SEQ ID NO: 47855 - DNA, 20 bp, Homo sapiens
ggcgggagccccggggagag

SEQ ID NO: 47856 - DNA, 21 bp, Homo sapiens
ggcgggagccccggggagagt

SEQ ID NO: 47857 - DNA, 17 bp, Homo sapiens
gcgggagccccggggag

SEQ ID NO: 47858 - DNA, 18 bp, Homo sapiens
gcgggagccccggggaga

SEQ ID NO: 47859 - DNA, 19 bp, Homo sapiens
gcgggagccccggggagag

SEQ ID NO: 47860 - DNA, 20 bp, Homo sapiens
gcgggagccccggggagagt

SEQ ID NO: 47861 - DNA, 18 bp, Homo sapiens
cgggagccccggggagag

SEQ ID NO: 47862 - DNA, 19 bp, Homo sapiens
cgggagccccggggagagt

SEQ ID NO: 47863 - DNA, 18 bp, Homo sapiens
gggagccccggggagagt

SEQ ID NO: 47864 - DNA, 16 bp, Homo sapiens
gagccccggggagagt

SEQ ID NO: 47865 - DNA, 21 bp, Homo sapiens
gggagagttctcttttctttg

SEQ ID NO: 47866 - DNA, 20 bp, Homo sapiens
ggagagttctcttttctttg

SEQ ID NO: 47867 - DNA, 22 bp, Homo sapiens
ggagagttctcttttctttgtg

SEQ ID NO: 47868 - DNA, 19 bp, Homo sapiens
gagagttctcttttctttg

SEQ ID NO: 47869 - DNA, 21 bp, Homo sapiens
gagagttctcttttctttgtg

SEQ ID NO: 47870 - DNA, 18 bp, Homo sapiens
agagttctcttttctttg

SEQ ID NO: 47871 - DNA, 20 bp, Homo sapiens
agagttctcttttctttgtg

SEQ ID NO: 47872 - DNA, 16 bp, Homo sapiens
agttctcttttctttg

SEQ ID NO: 47873 - DNA, 18 bp, Homo sapiens
agttctcttttctttgtg

SEQ ID NO: 47874 - DNA, 19 bp, Homo sapiens
agttctcttttctttgtga

SEQ ID NO: 47875 - DNA, 21 bp, Homo sapiens
agttctcttttctttgtgaag

SEQ ID NO: 47876 - DNA, 18 bp, Homo sapiens
gttctcttttctttgtga

SEQ ID NO: 47877 - DNA, 23 bp, Homo sapiens
gttctcttttctttgtgaagggc

SEQ ID NO: 47878 - DNA, 16 bp, Homo sapiens
ctcttttctttgtgaa

SEQ ID NO: 47879 - DNA, 17 bp, Homo sapiens
ctcttttctttgtgaag

SEQ ID NO: 47880 - DNA, 20 bp, Homo sapiens
ctcttttctttgtgaagggc

SEQ ID NO: 47881 - DNA, 21 bp, Homo sapiens
ctcttttctttgtgaagggca

SEQ ID NO: 47882 - DNA, 22 bp, Homo sapiens
ctcttttctttgtgaagggcag

SEQ ID NO: 47883 - DNA, 21 bp, Homo sapiens
gggcagggcgccctggaatgg

SEQ ID NO: 47884 - DNA, 23 bp, Homo sapiens
gggcagggcgccctggaatgggt

SEQ ID NO: 47885 - DNA, 30 bp, Homo sapiens
ggcagggcgccctggaatgggttcgccccg

SEQ ID NO: 47886 - DNA, 22 bp, Homo sapiens
gcagggcgccctggaatgggtt

SEQ ID NO: 47887 - DNA, 23 bp, Homo sapiens
gcagggcgccctggaatgggttc

SEQ ID NO: 47888 - DNA, 18 bp, Homo sapiens
cagggcgccctggaatgg

SEQ ID NO: 47889 - DNA, 17 bp, Homo sapiens
agggcgccctggaatgg

SEQ ID NO: 47890 - DNA, 16 bp, Homo sapiens
gggcgccctggaatgg

SEQ ID NO: 47891 - DNA, 21 bp, Homo sapiens
ccctggaatgggttcgccccg

SEQ ID NO: 47892 - DNA, 20 bp, Homo sapiens
cctggaatgggttcgccccg

SEQ ID NO: 47893 - DNA, 21 bp, Homo sapiens
ctggaatgggttcgccccgag

SEQ ID NO: 47894 - DNA, 22 bp, Homo sapiens
ctggaatgggttcgccccgaga

SEQ ID NO: 47895 - DNA, 17 bp, Homo sapiens
ggttcgccccgagagag

SEQ ID NO: 47896 - DNA, 18 bp, Homo sapiens
ggttcgccccgagagagg

SEQ ID NO: 47897 - DNA, 19 bp, Homo sapiens
ggttcgccccgagagaggg

SEQ ID NO: 47898 - DNA, 20 bp, Homo sapiens
ggttcgccccgagagagggg

SEQ ID NO: 47899 - DNA, 23 bp, Homo sapiens
ggttcgccccgagagaggggccc

SEQ ID NO: 47900 - DNA, 26 bp, Homo sapiens
ggttcgccccgagagaggggcccgtg

SEQ ID NO: 47901 - DNA, 27 bp, Homo sapiens
ggttcgccccgagagaggggcccgtgc

SEQ ID NO: 47902 - DNA, 30 bp, Homo sapiens
ggttcgccccgagagaggggcccgtgcctt

SEQ ID NO: 47903 - DNA, 22 bp, Homo sapiens
gttcgccccgagagaggggccc

SEQ ID NO: 47904 - DNA, 23 bp, Homo sapiens
gttcgccccgagagaggggcccg

SEQ ID NO: 47905 - DNA, 18 bp, Homo sapiens
ccccgagagaggggcccg

SEQ ID NO: 47906 - DNA, 20 bp, Homo sapiens
ccccgagagaggggcccgtg

SEQ ID NO: 47907 - DNA, 20 bp, Homo sapiens
cgagagaggggcccgtgcct

SEQ ID NO: 47908 - DNA, 21 bp, Homo sapiens
cgagagaggggcccgtgcctt

SEQ ID NO: 47909 - DNA, 22 bp, Homo sapiens
ggggcccgtgccttggaaagcg

SEQ ID NO: 47910 - DNA, 25 bp, Homo sapiens
ggggcccgtgccttggaaagcgtcg

SEQ ID NO: 47911 - DNA, 27 bp, Homo sapiens
ggggcccgtgccttggaaagcgtcgcg

SEQ ID NO: 47912 - DNA, 19 bp, Homo sapiens
gggcccgtgccttggaaag

SEQ ID NO: 47913 - DNA, 24 bp, Homo sapiens
gggcccgtgccttggaaagcgtcg

SEQ ID NO: 47914 - DNA, 26 bp, Homo sapiens
gggcccgtgccttggaaagcgtcgcg

SEQ ID NO: 47915 - DNA, 27 bp, Homo sapiens
gggcccgtgccttggaaagcgtcgcgg

SEQ ID NO: 47916 - DNA, 18 bp, Homo sapiens
ggcccgtgccttggaaag

SEQ ID NO: 47917 - DNA, 20 bp, Homo sapiens
ggcccgtgccttggaaagcg

SEQ ID NO: 47918 - DNA, 21 bp, Homo sapiens
ggcccgtgccttggaaagcgt

SEQ ID NO: 47919 - DNA, 22 bp, Homo sapiens
ggcccgtgccttggaaagcgtc

SEQ ID NO: 47920 - DNA, 23 bp, Homo sapiens
ggcccgtgccttggaaagcgtcg

SEQ ID NO: 47921 - DNA, 24 bp, Homo sapiens
ggcccgtgccttggaaagcgtcgc

SEQ ID NO: 47922 - DNA, 25 bp, Homo sapiens
ggcccgtgccttggaaagcgtcgcg

SEQ ID NO: 47923 - DNA, 26 bp, Homo sapiens
ggcccgtgccttggaaagcgtcgcgg

SEQ ID NO: 47924 - DNA, 27 bp, Homo sapiens
ggcccgtgccttggaaagcgtcgcggt

SEQ ID NO: 47925 - DNA, 28 bp, Homo sapiens
ggcccgtgccttggaaagcgtcgcggtt

SEQ ID NO: 47926 - DNA, 18 bp, Homo sapiens
gcccgtgccttggaaagc

SEQ ID NO: 47927 - DNA, 19 bp, Homo sapiens
gcccgtgccttggaaagcg

SEQ ID NO: 47928 - DNA, 20 bp, Homo sapiens
gcccgtgccttggaaagcgt

SEQ ID NO: 47929 - DNA, 21 bp, Homo sapiens
gcccgtgccttggaaagcgtc

SEQ ID NO: 47930 - DNA, 22 bp, Homo sapiens
gcccgtgccttggaaagcgtcg

SEQ ID NO: 47931 - DNA, 23 bp, Homo sapiens
gcccgtgccttggaaagcgtcgc

SEQ ID NO: 47932 - DNA, 24 bp, Homo sapiens
gcccgtgccttggaaagcgtcgcg

SEQ ID NO: 47933 - DNA, 25 bp, Homo sapiens
gcccgtgccttggaaagcgtcgcgg

SEQ ID NO: 47934 - DNA, 26 bp, Homo sapiens
gcccgtgccttggaaagcgtcgcggt

SEQ ID NO: 47935 - DNA, 22 bp, Homo sapiens
ccgtgccttggaaagcgtcgcg

SEQ ID NO: 47936 - DNA, 24 bp, Homo sapiens
ccgtgccttggaaagcgtcgcggt

SEQ ID NO: 47937 - DNA, 29 bp, Homo sapiens
ccgtgccttggaaagcgtcgcggttccgg

SEQ ID NO: 47938 - DNA, 21 bp, Homo sapiens
cgtgccttggaaagcgtcgcg

SEQ ID NO: 47939 - DNA, 23 bp, Homo sapiens
cgtgccttggaaagcgtcgcggt

SEQ ID NO: 47940 - DNA, 20 bp, Homo sapiens
gtgccttggaaagcgtcgcg

SEQ ID NO: 47941 - DNA, 21 bp, Homo sapiens
gtgccttggaaagcgtcgcgg

SEQ ID NO: 47942 - DNA, 22 bp, Homo sapiens
gtgccttggaaagcgtcgcggt

SEQ ID NO: 47943 - DNA, 19 bp, Homo sapiens
tgccttggaaagcgtcgcg

SEQ ID NO: 47944 - DNA, 20 bp, Homo sapiens
tgccttggaaagcgtcgcgg

SEQ ID NO: 47945 - DNA, 18 bp, Homo sapiens
gccttggaaagcgtcgcg

SEQ ID NO: 47946 - DNA, 19 bp, Homo sapiens
gccttggaaagcgtcgcgg

SEQ ID NO: 47947 - DNA, 21 bp, Homo sapiens
gccttggaaagcgtcgcggtt

SEQ ID NO: 47948 - DNA, 17 bp, Homo sapiens
ccttggaaagcgtcgcg

SEQ ID NO: 47949 - DNA, 18 bp, Homo sapiens
ccttggaaagcgtcgcgg

SEQ ID NO: 47950 - DNA, 19 bp, Homo sapiens
ccttggaaagcgtcgcggt

SEQ ID NO: 47951 - DNA, 20 bp, Homo sapiens
ccttggaaagcgtcgcggtt

SEQ ID NO: 47952 - DNA, 24 bp, Homo sapiens
ccttggaaagcgtcgcggttccgg

SEQ ID NO: 47953 - DNA, 16 bp, Homo sapiens
cttggaaagcgtcgcg

SEQ ID NO: 47954 - DNA, 17 bp, Homo sapiens
cttggaaagcgtcgcgg

SEQ ID NO: 47955 - DNA, 18 bp, Homo sapiens
cttggaaagcgtcgcggt

SEQ ID NO: 47956 - DNA, 19 bp, Homo sapiens
cttggaaagcgtcgcggtt

SEQ ID NO: 47957 - DNA, 16 bp, Homo sapiens
ttggaaagcgtcgcgg

SEQ ID NO: 47958 - DNA, 17 bp, Homo sapiens
ttggaaagcgtcgcggt

SEQ ID NO: 47959 - DNA, 23 bp, Homo sapiens
ttggaaagcgtcgcggttccggc

SEQ ID NO: 47960 - DNA, 22 bp, Homo sapiens
tggaaagcgtcgcggttccggc

SEQ ID NO: 47961 - DNA, 19 bp, Homo sapiens
gaaagcgtcgcggttccgg

SEQ ID NO: 47962 - DNA, 21 bp, Homo sapiens
gaaagcgtcgcggttccggcg

SEQ ID NO: 47963 - DNA, 22 bp, Homo sapiens
gaaagcgtcgcggttccggcgg

SEQ ID NO: 47964 - DNA, 18 bp, Homo sapiens
aaagcgtcgcggttccgg

SEQ ID NO: 47965 - DNA, 19 bp, Homo sapiens
aaagcgtcgcggttccggc

SEQ ID NO: 47966 - DNA, 20 bp, Homo sapiens
aaagcgtcgcggttccggcg

SEQ ID NO: 47967 - DNA, 21 bp, Homo sapiens
aaagcgtcgcggttccggcgg

SEQ ID NO: 47968 - DNA, 17 bp, Homo sapiens
aagcgtcgcggttccgg

SEQ ID NO: 47969 - DNA, 19 bp, Homo sapiens
aagcgtcgcggttccggcg

SEQ ID NO: 47970 - DNA, 20 bp, Homo sapiens
aagcgtcgcggttccggcgg

SEQ ID NO: 47971 - DNA, 21 bp, Homo sapiens
aagcgtcgcggttccggcggc

SEQ ID NO: 47972 - DNA, 16 bp, Homo sapiens
agcgtcgcggttccgg

SEQ ID NO: 47973 - DNA, 17 bp, Homo sapiens
agcgtcgcggttccggc

SEQ ID NO: 47974 - DNA, 18 bp, Homo sapiens
agcgtcgcggttccggcg

SEQ ID NO: 47975 - DNA, 19 bp, Homo sapiens
agcgtcgcggttccggcgg

SEQ ID NO: 47976 - DNA, 20 bp, Homo sapiens
agcgtcgcggttccggcggc

SEQ ID NO: 47977 - DNA, 21 bp, Homo sapiens
agcgtcgcggttccggcggcg

SEQ ID NO: 47978 - DNA, 19 bp, Homo sapiens
gcgtcgcggttccggcggc

SEQ ID NO: 47979 - DNA, 17 bp, Homo sapiens
gtcgcggttccggcggc

SEQ ID NO: 47980 - DNA, 18 bp, Homo sapiens
gtcgcggttccggcggcg

SEQ ID NO: 47981 - DNA, 21 bp, Homo sapiens
gtcgcggttccggcggcgtcc

SEQ ID NO: 47982 - DNA, 23 bp, Homo sapiens
gtcgcggttccggcggcgtccgg

SEQ ID NO: 47983 - DNA, 24 bp, Homo sapiens
gtcgcggttccggcggcgtccggt

SEQ ID NO: 47984 - DNA, 25 bp, Homo sapiens
gtcgcggttccggcggcgtccggtg

SEQ ID NO: 47985 - DNA, 26 bp, Homo sapiens
gtcgcggttccggcggcgtccggtga

SEQ ID NO: 47986 - DNA, 16 bp, Homo sapiens
gcggttccggcggcgt

SEQ ID NO: 47987 - DNA, 17 bp, Homo sapiens
gcggttccggcggcgtc

SEQ ID NO: 47988 - DNA, 18 bp, Homo sapiens
gcggttccggcggcgtcc

SEQ ID NO: 47989 - DNA, 19 bp, Homo sapiens
gcggttccggcggcgtccg

SEQ ID NO: 47990 - DNA, 21 bp, Homo sapiens
gcggttccggcggcgtccggt

SEQ ID NO: 47991 - DNA, 22 bp, Homo sapiens
gcggttccggcggcgtccggtg

SEQ ID NO: 47992 - DNA, 23 bp, Homo sapiens
gcggttccggcggcgtccggtga

SEQ ID NO: 47993 - DNA, 24 bp, Homo sapiens
gcggttccggcggcgtccggtgag

SEQ ID NO: 47994 - DNA, 25 bp, Homo sapiens
gcggttccggcggcgtccggtgagc

SEQ ID NO: 47995 - DNA, 30 bp, Homo sapiens
gcggttccggcggcgtccggtgagctctcg

SEQ ID NO: 47996 - DNA, 29 bp, Homo sapiens
cggttccggcggcgtccggtgagctctcg

SEQ ID NO: 47997 - DNA, 30 bp, Homo sapiens; identical to SEQ ID NO: 5023

SEQ ID NO: 47998 - DNA, 29 bp, Homo sapiens
ggttccggcggcgtccggtgagctctcgc

SEQ ID NO: 47999 - DNA, 30 bp, Homo sapiens; identical to SEQ ID NO: 5025

SEQ ID NO: 48000 - DNA, 27 bp, Homo sapiens
gttccggcggcgtccggtgagctctcg

SEQ ID NO: 48001 - DNA, 28 bp, Homo sapiens
gttccggcggcgtccggtgagctctcgc

SEQ ID NO: 48002 - DNA, 30 bp, Homo sapiens; identical to SEQ ID NO: 23215

SEQ ID NO: 48003 - DNA, 25 bp, Homo sapiens
ccggcggcgtccggtgagctctcgc

SEQ ID NO: 48004 - DNA, 23 bp, Homo sapiens
cggcggcgtccggtgagctctcg

SEQ ID NO: 48005 - DNA, 28 bp, Homo sapiens
cggcggcgtccggtgagctctcgctggc

SEQ ID NO: 48006 - DNA, 20 bp, Homo sapiens
ggcggcgtccggtgagctct

SEQ ID NO: 48007 - DNA, 22 bp, Homo sapiens
ggcggcgtccggtgagctctcg

SEQ ID NO: 48008 - DNA, 23 bp, Homo sapiens
ggcggcgtccggtgagctctcgc

SEQ ID NO: 48009 - DNA, 26 bp, Homo sapiens
ggcggcgtccggtgagctctcgctgg

SEQ ID NO: 48010 - DNA, 27 bp, Homo sapiens
ggcggcgtccggtgagctctcgctggc

SEQ ID NO: 48011 - DNA, 19 bp, Homo sapiens
gcggcgtccggtgagctct

SEQ ID NO: 48012 - DNA, 20 bp, Homo sapiens
gcggcgtccggtgagctctc

SEQ ID NO: 48013 - DNA, 21 bp, Homo sapiens
gcggcgtccggtgagctctcg

SEQ ID NO: 48014 - DNA, 22 bp, Homo sapiens
gcggcgtccggtgagctctcgc

SEQ ID NO: 48015 - DNA, 23 bp, Homo sapiens
gcggcgtccggtgagctctcgct

SEQ ID NO: 48016 - DNA, 24 bp, Homo sapiens
gcggcgtccggtgagctctcgctg

SEQ ID NO: 48017 - DNA, 25 bp, Homo sapiens
gcggcgtccggtgagctctcgctgg

SEQ ID NO: 48018 - DNA, 26 bp, Homo sapiens
gcggcgtccggtgagctctcgctggc

SEQ ID NO: 48019 - DNA, 18 bp, Homo sapiens
cggcgtccggtgagctct

SEQ ID NO: 48020 - DNA, 20 bp, Homo sapiens
cggcgtccggtgagctctcg

SEQ ID NO: 48021 - DNA, 21 bp, Homo sapiens
cggcgtccggtgagctctcgc

SEQ ID NO: 48022 - DNA, 22 bp, Homo sapiens
cggcgtccggtgagctctcgct

SEQ ID NO: 48023 - DNA, 25 bp, Homo sapiens
cggcgtccggtgagctctcgctggc

SEQ ID NO: 48024 - DNA, 19 bp, Homo sapiens
ggcgtccggtgagctctcg

SEQ ID NO: 48025 - DNA, 20 bp, Homo sapiens
ggcgtccggtgagctctcgc

SEQ ID NO: 48026 - DNA, 21 bp, Homo sapiens
ggcgtccggtgagctctcgct

SEQ ID NO: 48027 - DNA, 23 bp, Homo sapiens
ggcgtccggtgagctctcgctgg

SEQ ID NO: 48028 - DNA, 24 bp, Homo sapiens
ggcgtccggtgagctctcgctggc

SEQ ID NO: 48029 - DNA, 25 bp, Homo sapiens
ggcgtccggtgagctctcgctggcc

SEQ ID NO: 48030 - DNA, 17 bp, Homo sapiens
gcgtccggtgagctctc

SEQ ID NO: 48031 - DNA, 18 bp, Homo sapiens
gcgtccggtgagctctcg

SEQ ID NO: 48032 - DNA, 19 bp, Homo sapiens
gcgtccggtgagctctcgc

SEQ ID NO: 48033 - DNA, 20 bp, Homo sapiens
gcgtccggtgagctctcgct

SEQ ID NO: 48034 - DNA, 21 bp, Homo sapiens
gcgtccggtgagctctcgctg

SEQ ID NO: 48035 - DNA, 22 bp, Homo sapiens
gcgtccggtgagctctcgctgg

SEQ ID NO: 48036 - DNA, 23 bp, Homo sapiens
gcgtccggtgagctctcgctggc

SEQ ID NO: 48037 - DNA, 24 bp, Homo sapiens
gcgtccggtgagctctcgctggcc

SEQ ID NO: 48038 - DNA, 25 bp, Homo sapiens
gcgtccggtgagctctcgctggccc

SEQ ID NO: 48039 - DNA, 17 bp, Homo sapiens
cgtccggtgagctctcg

SEQ ID NO: 48040 - DNA, 18 bp, Homo sapiens
cgtccggtgagctctcgc

SEQ ID NO: 48041 - DNA, 19 bp, Homo sapiens
cgtccggtgagctctcgct

SEQ ID NO: 48042 - DNA, 20 bp, Homo sapiens
cgtccggtgagctctcgctg

SEQ ID NO: 48043 - DNA, 21 bp, Homo sapiens
cgtccggtgagctctcgctgg

SEQ ID NO: 48044 - DNA, 22 bp, Homo sapiens
cgtccggtgagctctcgctggc

SEQ ID NO: 48045 - DNA, 23 bp, Homo sapiens
cgtccggtgagctctcgctggcc

SEQ ID NO: 48046 - DNA, 24 bp, Homo sapiens
cgtccggtgagctctcgctggccc

SEQ ID NO: 48047 - DNA, 25 bp, Homo sapiens
cgtccggtgagctctcgctggccct

SEQ ID NO: 48048 - DNA, 17 bp, Homo sapiens
gtccggtgagctctcgc

SEQ ID NO: 48049 - DNA, 21 bp, Homo sapiens
gtccggtgagctctcgctggc

SEQ ID NO: 48050 - DNA, 16 bp, Homo sapiens
tccggtgagctctcgc

SEQ ID NO: 48051 - DNA, 20 bp, Homo sapiens
tccggtgagctctcgctggc

SEQ ID NO: 48052 - DNA, 16 bp, Homo sapiens
ccggtgagctctcgct

SEQ ID NO: 48053 - DNA, 18 bp, Homo sapiens
ccggtgagctctcgctgg

SEQ ID NO: 48054 - DNA, 19 bp, Homo sapiens
ccggtgagctctcgctggc

SEQ ID NO: 48055 - DNA, 20 bp, Homo sapiens
ccggtgagctctcgctggcc

SEQ ID NO: 48056 - DNA, 17 bp, Homo sapiens
cggtgagctctcgctgg

SEQ ID NO: 48057 - DNA, 18 bp, Homo sapiens
cggtgagctctcgctggc

SEQ ID NO: 48058 - DNA, 19 bp, Homo sapiens
cggtgagctctcgctggcc

SEQ ID NO: 48059 - DNA, 17 bp, Homo sapiens
ggtgagctctcgctggc

SEQ ID NO: 48060 - DNA, 18 bp, Homo sapiens
ggtgagctctcgctggcc

SEQ ID NO: 48061 - DNA, 19 bp, Homo sapiens
ggtgagctctcgctggccc

SEQ ID NO: 48062 - DNA, 17 bp, Homo sapiens
gtgagctctcgctggcc

SEQ ID NO: 48063 - DNA, 18 bp, Homo sapiens
gtgagctctcgctggccc

SEQ ID NO: 48064 - DNA, 21 bp, Homo sapiens
gtgagctctcgctggcccttg

SEQ ID NO: 48065 - DNA, 16 bp, Homo sapiens
gagctctcgctggccc

SEQ ID NO: 48066 - DNA, 19 bp, Homo sapiens
gagctctcgctggcccttg

SEQ ID NO: 48067 - DNA, 28 bp, Homo sapiens
gagctctcgctggcccttgaaaatccgg

SEQ ID NO: 48068 - DNA, 21 bp, Homo sapiens
cgctggcccttgaaaatccgg

SEQ ID NO: 48069 - DNA, 19 bp, Homo sapiens
ctggcccttgaaaatccgg

SEQ ID NO: 48070 - DNA, 29 bp, Homo sapiens
cccttgaaaatccgggggagagggtgtaa

SEQ ID NO: 48071 - DNA, 28 bp, Homo sapiens
ccttgaaaatccgggggagagggtgtaa

SEQ ID NO: 48072 - DNA, 27 bp, Homo sapiens
cttgaaaatccgggggagagggtgtaa

SEQ ID NO: 48073 - DNA, 25 bp, Homo sapiens
tgaaaatccgggggagagggtgtaa

SEQ ID NO: 48074 - DNA, 21 bp, Homo sapiens
gaaaatccgggggagagggtg

SEQ ID NO: 48075 - DNA, 22 bp, Homo sapiens
gaaaatccgggggagagggtgt

SEQ ID NO: 48076 - DNA, 24 bp, Homo sapiens
gaaaatccgggggagagggtgtaa

SEQ ID NO: 48077 - DNA, 20 bp, Homo sapiens
aaaatccgggggagagggtg

SEQ ID NO: 48078 - DNA, 22 bp, Homo sapiens
aaaatccgggggagagggtgta

SEQ ID NO: 48079 - DNA, 23 bp, Homo sapiens
aaaatccgggggagagggtgtaa

SEQ ID NO: 48080 - DNA, 22 bp, Homo sapiens
aaatccgggggagagggtgtaa

SEQ ID NO: 48081 - DNA, 18 bp, Homo sapiens
aatccgggggagagggtg

SEQ ID NO: 48082 - DNA, 20 bp, Homo sapiens
aatccgggggagagggtgta

SEQ ID NO: 48083 - DNA, 21 bp, Homo sapiens
aatccgggggagagggtgtaa

SEQ ID NO: 48084 - DNA, 19 bp, Homo sapiens
atccgggggagagggtgta

SEQ ID NO: 48085 - DNA, 20 bp, Homo sapiens
atccgggggagagggtgtaa

SEQ ID NO: 48086 - DNA, 19 bp, Homo sapiens
tccgggggagagggtgtaa

SEQ ID NO: 48087 - DNA, 18 bp, Homo sapiens
ccgggggagagggtgtaa

SEQ ID NO: 48088 - DNA, 19 bp, Homo sapiens
ccgggggagagggtgtaaa

SEQ ID NO: 48089 - DNA, 16 bp, Homo sapiens
cgggggagagggtgta

SEQ ID NO: 48090 - DNA, 17 bp, Homo sapiens
cgggggagagggtgtaa

SEQ ID NO: 48091 - DNA, 16 bp, Homo sapiens
gggggagagggtgtaa

SEQ ID NO: 48092 - DNA, 21 bp, Homo sapiens
agggtgtaaatctcgcgccgg

SEQ ID NO: 48093 - DNA, 20 bp, Homo sapiens
gggtgtaaatctcgcgccgg

SEQ ID NO: 48094 - DNA, 19 bp, Homo sapiens
ggtgtaaatctcgcgccgg

SEQ ID NO: 48095 - DNA, 20 bp, Homo sapiens
ggtgtaaatctcgcgccggg

SEQ ID NO: 48096 - DNA, 18 bp, Homo sapiens
gtgtaaatctcgcgccgg

SEQ ID NO: 48097 - DNA, 19 bp, Homo sapiens
gtgtaaatctcgcgccggg

SEQ ID NO: 48098 - DNA, 23 bp, Homo sapiens
gtgtaaatctcgcgccgggccgt

SEQ ID NO: 48099 - DNA, 24 bp, Homo sapiens
gtgtaaatctcgcgccgggccgta

SEQ ID NO: 48100 - DNA, 17 bp, Homo sapiens
tgtaaatctcgcgccgg

SEQ ID NO: 48101 - DNA, 18 bp, Homo sapiens
tgtaaatctcgcgccggg

SEQ ID NO: 48102 - DNA, 21 bp, Homo sapiens
tgtaaatctcgcgccgggccg

SEQ ID NO: 48103 - DNA, 22 bp, Homo sapiens
tgtaaatctcgcgccgggccgt

SEQ ID NO: 48104 - DNA, 23 bp, Homo sapiens
tgtaaatctcgcgccgggccgta

SEQ ID NO: 48105 - DNA, 24 bp, Homo sapiens
tgtaaatctcgcgccgggccgtac

SEQ ID NO: 48106 - DNA, 16 bp, Homo sapiens
gtaaatctcgcgccgg

SEQ ID NO: 48107 - DNA, 21 bp, Homo sapiens
gtaaatctcgcgccgggccgt

SEQ ID NO: 48108 - DNA, 22 bp, Homo sapiens
gtaaatctcgcgccgggccgta

SEQ ID NO: 48109 - DNA, 24 bp, Homo sapiens
gtaaatctcgcgccgggccgtacc

SEQ ID NO: 48110 - DNA, 20 bp, Homo sapiens
taaatctcgcgccgggccgt

SEQ ID NO: 48111 - DNA, 21 bp, Homo sapiens
taaatctcgcgccgggccgta

SEQ ID NO: 48112 - DNA, 22 bp, Homo sapiens
taaatctcgcgccgggccgtac

SEQ ID NO: 48113 - DNA, 23 bp, Homo sapiens
taaatctcgcgccgggccgtacc

SEQ ID NO: 48114 - DNA, 18 bp, Homo sapiens
aaatctcgcgccgggccg

SEQ ID NO: 48115 - DNA, 19 bp, Homo sapiens
aaatctcgcgccgggccgt

SEQ ID NO: 48116 - DNA, 20 bp, Homo sapiens
aaatctcgcgccgggccgta

SEQ ID NO: 48117 - DNA, 21 bp, Homo sapiens
aaatctcgcgccgggccgtac

SEQ ID NO: 48118 - DNA, 22 bp, Homo sapiens
aaatctcgcgccgggccgtacc

SEQ ID NO: 48119 - DNA, 25 bp, Homo sapiens
aaatctcgcgccgggccgtacccat

SEQ ID NO: 48120 - DNA, 16 bp, Homo sapiens
aatctcgcgccgggcc

SEQ ID NO: 48121 - DNA, 17 bp, Homo sapiens
aatctcgcgccgggccg

SEQ ID NO: 48122 - DNA, 18 bp, Homo sapiens
aatctcgcgccgggccgt

SEQ ID NO: 48123 - DNA, 19 bp, Homo sapiens
aatctcgcgccgggccgta

SEQ ID NO: 48124 - DNA, 20 bp, Homo sapiens
aatctcgcgccgggccgtac

SEQ ID NO: 48125 - DNA, 21 bp, Homo sapiens
aatctcgcgccgggccgtacc

SEQ ID NO: 48126 - DNA, 17 bp, Homo sapiens
atctcgcgccgggccgt

SEQ ID NO: 48127 - DNA, 18 bp, Homo sapiens
atctcgcgccgggccgta

SEQ ID NO: 48128 - DNA, 19 bp, Homo sapiens
atctcgcgccgggccgtac

SEQ ID NO: 48129 - DNA, 20 bp, Homo sapiens
atctcgcgccgggccgtacc

SEQ ID NO: 48130 - DNA, 21 bp, Homo sapiens
atctcgcgccgggccgtaccc

SEQ ID NO: 48131 - DNA, 23 bp, Homo sapiens
atctcgcgccgggccgtacccat

SEQ ID NO: 48132 - DNA, 16 bp, Homo sapiens
tctcgcgccgggccgt

SEQ ID NO: 48133 - DNA, 17 bp, Homo sapiens
tctcgcgccgggccgta

SEQ ID NO: 48134 - DNA, 18 bp, Homo sapiens
tctcgcgccgggccgtac

SEQ ID NO: 48135 - DNA, 19 bp, Homo sapiens
tctcgcgccgggccgtacc

SEQ ID NO: 48136 - DNA, 23 bp, Homo sapiens
tctcgcgccgggccgtacccata

SEQ ID NO: 48137 - DNA, 16 bp, Homo sapiens
ctcgcgccgggccgta

SEQ ID NO: 48138 - DNA, 17 bp, Homo sapiens
ctcgcgccgggccgtac

SEQ ID NO: 48139 - DNA, 18 bp, Homo sapiens
ctcgcgccgggccgtacc

SEQ ID NO: 48140 - DNA, 21 bp, Homo sapiens
ctcgcgccgggccgtacccat

SEQ ID NO: 48141 - DNA, 22 bp, Homo sapiens
ctcgcgccgggccgtacccata

SEQ ID NO: 48142 - DNA, 23 bp, Homo sapiens
ctcgcgccgggccgtacccatat

SEQ ID NO: 48143 - DNA, 16 bp, Homo sapiens
tcgcgccgggccgtac

SEQ ID NO: 48144 - DNA, 17 bp, Homo sapiens
tcgcgccgggccgtacc

SEQ ID NO: 48145 - DNA, 16 bp, Homo sapiens
cgcgccgggccgtacc

SEQ ID NO: 48146 - DNA, 20 bp, Homo sapiens
cgcgccgggccgtacccata

SEQ ID NO: 48147 - DNA, 20 bp, Homo sapiens
ggccgtacccatatccgcag

SEQ ID NO: 48148 - DNA, 21 bp, Homo sapiens
ggccgtacccatatccgcagc

SEQ ID NO: 48149 - DNA, 23 bp, Homo sapiens
ggccgtacccatatccgcagcag

SEQ ID NO: 48150 - DNA, 18 bp, Homo sapiens
ccgtacccatatccgcag

SEQ ID NO: 48151 - DNA, 20 bp, Homo sapiens
ccgtacccatatccgcagca

SEQ ID NO: 48152 - DNA, 21 bp, Homo sapiens
ccgtacccatatccgcagcag

SEQ ID NO: 48153 - DNA, 22 bp, Homo sapiens
ccgtacccatatccgcagcagg

SEQ ID NO: 48154 - DNA, 30 bp, Homo sapiens
ccgtacccatatccgcagcaggtctccaag

SEQ ID NO: 48155 - DNA, 18 bp, Homo sapiens
tacccatatccgcagcag

SEQ ID NO: 48156 - DNA, 23 bp, Homo sapiens
cccatatccgcagcaggtctcca

SEQ ID NO: 48157 - DNA, 24 bp, Homo sapiens
cccatatccgcagcaggtctccaa

SEQ ID NO: 48158 - DNA, 22 bp, Homo sapiens
ccatatccgcagcaggtctcca

SEQ ID NO: 48159 - DNA, 20 bp, Homo sapiens
catatccgcagcaggtctcc

SEQ ID NO: 48160 - DNA, 21 bp, Homo sapiens
catatccgcagcaggtctcca

SEQ ID NO: 48161 - DNA, 20 bp, Homo sapiens
tccgcagcaggtctccaagg

SEQ ID NO: 48162 - DNA, 18 bp, Homo sapiens
ccgcagcaggtctccaag

SEQ ID NO: 48163 - DNA, 19 bp, Homo sapiens
ccgcagcaggtctccaagg

SEQ ID NO: 48164 - DNA, 20 bp, Homo sapiens
ccgcagcaggtctccaaggt

SEQ ID NO: 48165 - DNA, 21 bp, Homo sapiens
ccgcagcaggtctccaaggtg

SEQ ID NO: 48166 - DNA, 30 bp, Homo sapiens; identical to SEQ ID NO: 23491

SEQ ID NO: 48167 - DNA, 17 bp, Homo sapiens
gcagcaggtctccaagg

SEQ ID NO: 48168 - DNA, 24 bp, Homo sapiens
gcagcaggtctccaaggtgaacag

SEQ ID NO: 48169 - DNA, 30 bp, Homo sapiens; identical to SEQ ID NO: 5128

SEQ ID NO: 48170 - DNA, 16 bp, Homo sapiens
cagcaggtctccaagg

SEQ ID NO: 48171 - DNA, 18 bp, Homo sapiens
cagcaggtctccaaggtg

SEQ ID NO: 48172 - DNA, 19 bp, Homo sapiens
cagcaggtctccaaggtga

SEQ ID NO: 48173 - DNA, 21 bp, Homo sapiens
cagcaggtctccaaggtgaac

SEQ ID NO: 48174 - DNA, 23 bp, Homo sapiens
cagcaggtctccaaggtgaacag

SEQ ID NO: 48175 - DNA, 29 bp, Homo sapiens
cagcaggtctccaaggtgaacagcctctg

SEQ ID NO: 48176 - DNA, 30 bp, Homo sapiens
cagcaggtctccaaggtgaacagcctctgg

SEQ ID NO: 48177 - DNA, 18 bp, Homo sapiens
agcaggtctccaaggtga

SEQ ID NO: 48178 - DNA, 19 bp, Homo sapiens
agcaggtctccaaggtgaa

SEQ ID NO: 48179 - DNA, 20 bp, Homo sapiens
agcaggtctccaaggtgaac

SEQ ID NO: 48180 - DNA, 22 bp, Homo sapiens
agcaggtctccaaggtgaacag

SEQ ID NO: 48181 - DNA, 28 bp, Homo sapiens
agcaggtctccaaggtgaacagcctctg

SEQ ID NO: 48182 - DNA, 30 bp, Homo sapiens
agcaggtctccaaggtgaacagcctctggc

SEQ ID NO: 48183 - DNA, 16 bp, Homo sapiens
gcaggtctccaaggtg

SEQ ID NO: 48184 - DNA, 17 bp, Homo sapiens
gcaggtctccaaggtga

SEQ ID NO: 48185 - DNA, 18 bp, Homo sapiens
gcaggtctccaaggtgaa

SEQ ID NO: 48186 - DNA, 19 bp, Homo sapiens
gcaggtctccaaggtgaac

SEQ ID NO: 48187 - DNA, 21 bp, Homo sapiens
gcaggtctccaaggtgaacag

SEQ ID NO: 48188 - DNA, 22 bp, Homo sapiens
gcaggtctccaaggtgaacagc

SEQ ID NO: 48189 - DNA, 23 bp, Homo sapiens
gcaggtctccaaggtgaacagcc

SEQ ID NO: 48190 - DNA, 24 bp, Homo sapiens
gcaggtctccaaggtgaacagcct

SEQ ID NO: 48191 - DNA, 25 bp, Homo sapiens
gcaggtctccaaggtgaacagcctc

SEQ ID NO: 48192 - DNA, 27 bp, Homo sapiens
gcaggtctccaaggtgaacagcctctg

SEQ ID NO: 48193 - DNA, 29 bp, Homo sapiens
gcaggtctccaaggtgaacagcctctggc

SEQ ID NO: 48194 - DNA, 17 bp, Homo sapiens
caggtctccaaggtgaa

SEQ ID NO: 48195 - DNA, 18 bp, Homo sapiens
caggtctccaaggtgaac

SEQ ID NO: 48196 - DNA, 20 bp, Homo sapiens
caggtctccaaggtgaacag

SEQ ID NO: 48197 - DNA, 21 bp, Homo sapiens
caggtctccaaggtgaacagc

SEQ ID NO: 48198 - DNA, 26 bp, Homo sapiens
caggtctccaaggtgaacagcctctg

SEQ ID NO: 48199 - DNA, 27 bp, Homo sapiens
caggtctccaaggtgaacagcctctgg

SEQ ID NO: 48200 - DNA, 28 bp, Homo sapiens
caggtctccaaggtgaacagcctctggc

SEQ ID NO: 48201 - DNA, 16 bp, Homo sapiens
aggtctccaaggtgaa

SEQ ID NO: 48202 - DNA, 17 bp, Homo sapiens
aggtctccaaggtgaac

SEQ ID NO: 48203 - DNA, 30 bp, Homo sapiens
aggtctccaaggtgaacagcctctggcatg

SEQ ID NO: 48204 - DNA, 16 bp, Homo sapiens
ggtctccaaggtgaac

SEQ ID NO: 48205 - DNA, 18 bp, Homo sapiens
ggtctccaaggtgaacag

SEQ ID NO: 48206 - DNA, 19 bp, Homo sapiens
ggtctccaaggtgaacagc

SEQ ID NO: 48207 - DNA, 20 bp, Homo sapiens
ggtctccaaggtgaacagcc

SEQ ID NO: 48208 - DNA, 24 bp, Homo sapiens
ggtctccaaggtgaacagcctctg

SEQ ID NO: 48209 - DNA, 30 bp, Homo sapiens
ggtctccaaggtgaacagcctctggcatgt

SEQ ID NO: 48210 - DNA, 16 bp, Homo sapiens
tctccaaggtgaacag

SEQ ID NO: 48211 - DNA, 30 bp, Homo sapiens
ctccaaggtgaacagcctctggcatgttgg

SEQ ID NO: 48212 - DNA, 30 bp, Homo sapiens
caaggtgaacagcctctggcatgttggaac

SEQ ID NO: 48213 - DNA, 29 bp, Homo sapiens
aaggtgaacagcctctggcatgttggaac

SEQ ID NO: 48214 - DNA, 16 bp, Homo sapiens
aggtgaacagcctctg

SEQ ID NO: 48215 - DNA, 25 bp, Homo sapiens
aggtgaacagcctctggcatgttgg

SEQ ID NO: 48216 - DNA, 26 bp, Homo sapiens
aggtgaacagcctctggcatgttgga

SEQ ID NO: 48217 - DNA, 28 bp, Homo sapiens
aggtgaacagcctctggcatgttggaac

SEQ ID NO: 48218 - DNA, 29 bp, Homo sapiens
aggtgaacagcctctggcatgttggaaca

SEQ ID NO: 48219 - DNA, 20 bp, Homo sapiens
ggtgaacagcctctggcatg

SEQ ID NO: 48220 - DNA, 24 bp, Homo sapiens
ggtgaacagcctctggcatgttgg

SEQ ID NO: 48221 - DNA, 28 bp, Homo sapiens
ggtgaacagcctctggcatgttggaaca

SEQ ID NO: 48222 - DNA, 30 bp, Homo sapiens
ggtgaacagcctctggcatgttggaacaat

SEQ ID NO: 48223 - DNA, 17 bp, Homo sapiens
gtgaacagcctctggca

SEQ ID NO: 48224 - DNA, 19 bp, Homo sapiens
gtgaacagcctctggcatg

SEQ ID NO: 48225 - DNA, 20 bp, Homo sapiens
gtgaacagcctctggcatgt

SEQ ID NO: 48226 - DNA, 30 bp, Homo sapiens
gtgaacagcctctggcatgttggaacaatg

SEQ ID NO: 48227 - DNA, 29 bp, Homo sapiens
tgaacagcctctggcatgttggaacaatg

SEQ ID NO: 48228 - DNA, 30 bp, Homo sapiens
tgaacagcctctggcatgttggaacaatgt

SEQ ID NO: 48229 - DNA, 28 bp, Homo sapiens
gaacagcctctggcatgttggaacaatg

SEQ ID NO: 48230 - DNA, 29 bp, Homo sapiens
gaacagcctctggcatgttggaacaatgt

SEQ ID NO: 48231 - DNA, 27 bp, Homo sapiens
aacagcctctggcatgttggaacaatg

SEQ ID NO: 48232 - DNA, 28 bp, Homo sapiens
aacagcctctggcatgttggaacaatgt

SEQ ID NO: 48233 - DNA, 30 bp, Homo sapiens
aacagcctctggcatgttggaacaatgtag

SEQ ID NO: 48234 - DNA, 22 bp, Homo sapiens
acagcctctggcatgttggaac

SEQ ID NO: 48235 - DNA, 26 bp, Homo sapiens
acagcctctggcatgttggaacaatg

SEQ ID NO: 48236 - DNA, 28 bp, Homo sapiens
acagcctctggcatgttggaacaatgta

SEQ ID NO: 48237 - DNA, 29 bp, Homo sapiens
acagcctctggcatgttggaacaatgtag

SEQ ID NO: 48238 - DNA, 30 bp, Homo sapiens; identical to SEQ ID NO: 23533

SEQ ID NO: 48239 - DNA, 17 bp, Homo sapiens
cagcctctggcatgttg

SEQ ID NO: 48240 - DNA, 18 bp, Homo sapiens
cagcctctggcatgttgg

SEQ ID NO: 48241 - DNA, 19 bp, Homo sapiens
cagcctctggcatgttgga

SEQ ID NO: 48242 - DNA, 21 bp, Homo sapiens
cagcctctggcatgttggaac

SEQ ID NO: 48243 - DNA, 22 bp, Homo sapiens
cagcctctggcatgttggaaca

SEQ ID NO: 48244 - DNA, 25 bp, Homo sapiens
cagcctctggcatgttggaacaatg

SEQ ID NO: 48245 - DNA, 26 bp, Homo sapiens
cagcctctggcatgttggaacaatgt

SEQ ID NO: 48246 - DNA, 27 bp, Homo sapiens
cagcctctggcatgttggaacaatgta

SEQ ID NO: 48247 - DNA, 28 bp, Homo sapiens
cagcctctggcatgttggaacaatgtag

SEQ ID NO: 48248 - DNA, 29 bp, Homo sapiens
cagcctctggcatgttggaacaatgtagg

SEQ ID NO: 48249 - DNA, 30 bp, Homo sapiens; identical to SEQ ID NO: 23547

SEQ ID NO: 48250 - DNA, 24 bp, Homo sapiens
agcctctggcatgttggaacaatg

SEQ ID NO: 48251 - DNA, 26 bp, Homo sapiens
agcctctggcatgttggaacaatgta

SEQ ID NO: 48252 - DNA, 27 bp, Homo sapiens
agcctctggcatgttggaacaatgtag

SEQ ID NO: 48253 - DNA, 28 bp, Homo sapiens
agcctctggcatgttggaacaatgtagg

SEQ ID NO: 48254 - DNA, 29 bp, Homo sapiens
agcctctggcatgttggaacaatgtaggt

SEQ ID NO: 48255 - DNA, 26 bp, Homo sapiens
gcctctggcatgttggaacaatgtag

SEQ ID NO: 48256 - DNA, 27 bp, Homo sapiens
gcctctggcatgttggaacaatgtagg

SEQ ID NO: 48257 - DNA, 22 bp, Homo sapiens
cctctggcatgttggaacaatg

SEQ ID NO: 48258 - DNA, 23 bp, Homo sapiens
cctctggcatgttggaacaatgt

SEQ ID NO: 48259 - DNA, 24 bp, Homo sapiens
cctctggcatgttggaacaatgta

SEQ ID NO: 48260 - DNA, 25 bp, Homo sapiens
cctctggcatgttggaacaatgtag

SEQ ID NO: 48261 - DNA, 26 bp, Homo sapiens
cctctggcatgttggaacaatgtagg

SEQ ID NO: 48262 - DNA, 27 bp, Homo sapiens
cctctggcatgttggaacaatgtaggt

SEQ ID NO: 48263 - DNA, 28 bp, Homo sapiens
cctctggcatgttggaacaatgtaggta

SEQ ID NO: 48264 - DNA, 30 bp, Homo sapiens
cctctggcatgttggaacaatgtaggtaag

SEQ ID NO: 48265 - DNA, 16 bp, Homo sapiens
ctctggcatgttggaa

SEQ ID NO: 48266 - DNA, 17 bp, Homo sapiens
ctctggcatgttggaac

SEQ ID NO: 48267 - DNA, 18 bp, Homo sapiens
ctctggcatgttggaaca

SEQ ID NO: 48268 - DNA, 19 bp, Homo sapiens
ctctggcatgttggaacaa

SEQ ID NO: 48269 - DNA, 20 bp, Homo sapiens
ctctggcatgttggaacaat

SEQ ID NO: 48270 - DNA, 21 bp, Homo sapiens
ctctggcatgttggaacaatg

SEQ ID NO: 48271 - DNA, 22 bp, Homo sapiens
ctctggcatgttggaacaatgt

SEQ ID NO: 48272 - DNA, 23 bp, Homo sapiens
ctctggcatgttggaacaatgta

SEQ ID NO: 48273 - DNA, 24 bp, Homo sapiens
ctctggcatgttggaacaatgtag

SEQ ID NO: 48274 - DNA, 25 bp, Homo sapiens
ctctggcatgttggaacaatgtagg

SEQ ID NO: 48275 - DNA, 26 bp, Homo sapiens
ctctggcatgttggaacaatgtaggt

SEQ ID NO: 48276 - DNA, 27 bp, Homo sapiens
ctctggcatgttggaacaatgtaggta

SEQ ID NO: 48277 - DNA, 29 bp, Homo sapiens
ctctggcatgttggaacaatgtaggtaag

SEQ ID NO: 48278 - DNA, 30 bp, Homo sapiens; identical to SEQ ID NO: 23566

SEQ ID NO: 48279 - DNA, 20 bp, Homo sapiens
tctggcatgttggaacaatg

SEQ ID NO: 48280 - DNA, 21 bp, Homo sapiens
tctggcatgttggaacaatgt

SEQ ID NO: 48281 - DNA, 22 bp, Homo sapiens
tctggcatgttggaacaatgta

SEQ ID NO: 48282 - DNA, 23 bp, Homo sapiens
tctggcatgttggaacaatgtag

SEQ ID NO: 48283 - DNA, 24 bp, Homo sapiens
tctggcatgttggaacaatgtagg

SEQ ID NO: 48284 - DNA, 26 bp, Homo sapiens
tctggcatgttggaacaatgtaggta

SEQ ID NO: 48285 - DNA, 29 bp, Homo sapiens
tctggcatgttggaacaatgtaggtaagg

SEQ ID NO: 48286 - DNA, 30 bp, Homo sapiens
tctggcatgttggaacaatgtaggtaaggg

SEQ ID NO: 48287 - DNA, 18 bp, Homo sapiens
ctggcatgttggaacaat

SEQ ID NO: 48288 - DNA, 19 bp, Homo sapiens
ctggcatgttggaacaatg

SEQ ID NO: 48289 - DNA, 20 bp, Homo sapiens
ctggcatgttggaacaatgt

SEQ ID NO: 48290 - DNA, 21 bp, Homo sapiens
ctggcatgttggaacaatgta

SEQ ID NO: 48291 - DNA, 22 bp, Homo sapiens
ctggcatgttggaacaatgtag

SEQ ID NO: 48292 - DNA, 23 bp, Homo sapiens
ctggcatgttggaacaatgtagg

SEQ ID NO: 48293 - DNA, 24 bp, Homo sapiens
ctggcatgttggaacaatgtaggt

SEQ ID NO: 48294 - DNA, 25 bp, Homo sapiens
ctggcatgttggaacaatgtaggta

SEQ ID NO: 48295 - DNA, 27 bp, Homo sapiens
ctggcatgttggaacaatgtaggtaag

SEQ ID NO: 48296 - DNA, 28 bp, Homo sapiens
ctggcatgttggaacaatgtaggtaagg

SEQ ID NO: 48297 - DNA, 29 bp, Homo sapiens
ctggcatgttggaacaatgtaggtaaggg

SEQ ID NO: 48298 - DNA, 18 bp, Homo sapiens
tggcatgttggaacaatg

SEQ ID NO: 48299 - DNA, 20 bp, Homo sapiens
tggcatgttggaacaatgta

SEQ ID NO: 48300 - DNA, 21 bp, Homo sapiens
tggcatgttggaacaatgtag

SEQ ID NO: 48301 - DNA, 22 bp, Homo sapiens
tggcatgttggaacaatgtagg

SEQ ID NO: 48302 - DNA, 23 bp, Homo sapiens
tggcatgttggaacaatgtaggt

SEQ ID NO: 48303 - DNA, 24 bp, Homo sapiens
tggcatgttggaacaatgtaggta

SEQ ID NO: 48304 - DNA, 27 bp, Homo sapiens
tggcatgttggaacaatgtaggtaagg

SEQ ID NO: 48305 - DNA, 29 bp, Homo sapiens
tggcatgttggaacaatgtaggtaaggga

SEQ ID NO: 48306 - DNA, 17 bp, Homo sapiens
ggcatgttggaacaatg

SEQ ID NO: 48307 - DNA, 19 bp, Homo sapiens
ggcatgttggaacaatgta

SEQ ID NO: 48308 - DNA, 20 bp, Homo sapiens
ggcatgttggaacaatgtag

SEQ ID NO: 48309 - DNA, 21 bp, Homo sapiens
ggcatgttggaacaatgtagg

SEQ ID NO: 48310 - DNA, 22 bp, Homo sapiens
ggcatgttggaacaatgtaggt

SEQ ID NO: 48311 - DNA, 23 bp, Homo sapiens
ggcatgttggaacaatgtaggta

SEQ ID NO: 48312 - DNA, 24 bp, Homo sapiens
ggcatgttggaacaatgtaggtaa

SEQ ID NO: 48313 - DNA, 25 bp, Homo sapiens
ggcatgttggaacaatgtaggtaag

SEQ ID NO: 48314 - DNA, 26 bp, Homo sapiens
ggcatgttggaacaatgtaggtaagg

SEQ ID NO: 48315 - DNA, 27 bp, Homo sapiens
ggcatgttggaacaatgtaggtaaggg

SEQ ID NO: 48316 - DNA, 30 bp, Homo sapiens
ggcatgttggaacaatgtaggtaagggaag

SEQ ID NO: 48317 - DNA, 16 bp, Homo sapiens
gcatgttggaacaatg

SEQ ID NO: 48318 - DNA, 18 bp, Homo sapiens
gcatgttggaacaatgta

SEQ ID NO: 48319 - DNA, 19 bp, Homo sapiens
gcatgttggaacaatgtag

SEQ ID NO: 48320 - DNA, 20 bp, Homo sapiens
gcatgttggaacaatgtagg

SEQ ID NO: 48321 - DNA, 21 bp, Homo sapiens
gcatgttggaacaatgtaggt

SEQ ID NO: 48322 - DNA, 22 bp, Homo sapiens
gcatgttggaacaatgtaggta

SEQ ID NO: 48323 - DNA, 23 bp, Homo sapiens
gcatgttggaacaatgtaggtaa

SEQ ID NO: 48324 - DNA, 24 bp, Homo sapiens
gcatgttggaacaatgtaggtaag

SEQ ID NO: 48325 - DNA, 25 bp, Homo sapiens
gcatgttggaacaatgtaggtaagg

SEQ ID NO: 48326 - DNA, 26 bp, Homo sapiens
gcatgttggaacaatgtaggtaaggg

SEQ ID NO: 48327 - DNA, 29 bp, Homo sapiens
gcatgttggaacaatgtaggtaagggaag

SEQ ID NO: 48328 - DNA, 30 bp, Homo sapiens; identical to SEQ ID NO: 23587

SEQ ID NO: 48329 - DNA, 16 bp, Homo sapiens
catgttggaacaatgt

SEQ ID NO: 48330 - DNA, 17 bp, Homo sapiens
catgttggaacaatgta

SEQ ID NO: 48331 - DNA, 18 bp, Homo sapiens
catgttggaacaatgtag

SEQ ID NO: 48332 - DNA, 19 bp, Homo sapiens
catgttggaacaatgtagg

SEQ ID NO: 48333 - DNA, 20 bp, Homo sapiens
catgttggaacaatgtaggt

SEQ ID NO: 48334 - DNA, 21 bp, Homo sapiens
catgttggaacaatgtaggta

SEQ ID NO: 48335 - DNA, 22 bp, Homo sapiens
catgttggaacaatgtaggtaa

SEQ ID NO: 48336 - DNA, 23 bp, Homo sapiens
catgttggaacaatgtaggtaag

SEQ ID NO: 48337 - DNA, 24 bp, Homo sapiens
catgttggaacaatgtaggtaagg

SEQ ID NO: 48338 - DNA, 25 bp, Homo sapiens
catgttggaacaatgtaggtaaggg

SEQ ID NO: 48339 - DNA, 26 bp, Homo sapiens
catgttggaacaatgtaggtaaggga

SEQ ID NO: 48340 - DNA, 27 bp, Homo sapiens
catgttggaacaatgtaggtaagggaa

SEQ ID NO: 48341 - DNA, 28 bp, Homo sapiens
catgttggaacaatgtaggtaagggaag

SEQ ID NO: 48342 - DNA, 29 bp, Homo sapiens
catgttggaacaatgtaggtaagggaagt

SEQ ID NO: 48343 - DNA, 30 bp, Homo sapiens; identical to SEQ ID NO: 23595

SEQ ID NO: 48344 - DNA, 17 bp, Homo sapiens
atgttggaacaatgtag

SEQ ID NO: 48345 - DNA, 18 bp, Homo sapiens
atgttggaacaatgtagg

SEQ ID NO: 48346 - DNA, 19 bp, Homo sapiens
atgttggaacaatgtaggt

SEQ ID NO: 48347 - DNA, 20 bp, Homo sapiens
atgttggaacaatgtaggta

SEQ ID NO: 48348 - DNA, 21 bp, Homo sapiens
atgttggaacaatgtaggtaa

SEQ ID NO: 48349 - DNA, 22 bp, Homo sapiens
atgttggaacaatgtaggtaag

SEQ ID NO: 48350 - DNA, 23 bp, Homo sapiens
atgttggaacaatgtaggtaagg

SEQ ID NO: 48351 - DNA, 24 bp, Homo sapiens
atgttggaacaatgtaggtaaggg

SEQ ID NO: 48352 - DNA, 25 bp, Homo sapiens
atgttggaacaatgtaggtaaggga

SEQ ID NO: 48353 - DNA, 30 bp, Homo sapiens
atgttggaacaatgtaggtaagggaagtcg

SEQ ID NO: 48354 - DNA, 16 bp, Homo sapiens
tgttggaacaatgtag

SEQ ID NO: 48355 - DNA, 17 bp, Homo sapiens
tgttggaacaatgtagg

SEQ ID NO: 48356 - DNA, 18 bp, Homo sapiens
tgttggaacaatgtaggt

SEQ ID NO: 48357 - DNA, 19 bp, Homo sapiens
tgttggaacaatgtaggta

SEQ ID NO: 48358 - DNA, 20 bp, Homo sapiens
tgttggaacaatgtaggtaa

SEQ ID NO: 48359 - DNA, 21 bp, Homo sapiens
tgttggaacaatgtaggtaag

SEQ ID NO: 48360 - DNA, 22 bp, Homo sapiens
tgttggaacaatgtaggtaagg

SEQ ID NO: 48361 - DNA, 23 bp, Homo sapiens
tgttggaacaatgtaggtaaggg

SEQ ID NO: 48362 - DNA, 24 bp, Homo sapiens
tgttggaacaatgtaggtaaggga

SEQ ID NO: 48363 - DNA, 25 bp, Homo sapiens
tgttggaacaatgtaggtaagggaa

SEQ ID NO: 48364 - DNA, 30 bp, Homo sapiens
tgttggaacaatgtaggtaagggaagtcgg

SEQ ID NO: 48365 - DNA, 16 bp, Homo sapiens
gttggaacaatgtagg

SEQ ID NO: 48366 - DNA, 17 bp, Homo sapiens
gttggaacaatgtaggt

SEQ ID NO: 48367 - DNA, 18 bp, Homo sapiens
gttggaacaatgtaggta

SEQ ID NO: 48368 - DNA, 19 bp, Homo sapiens
gttggaacaatgtaggtaa

SEQ ID NO: 48369 - DNA, 20 bp, Homo sapiens
gttggaacaatgtaggtaag

SEQ ID NO: 48370 - DNA, 21 bp, Homo sapiens
gttggaacaatgtaggtaagg

SEQ ID NO: 48371 - DNA, 22 bp, Homo sapiens
gttggaacaatgtaggtaaggg

SEQ ID NO: 48372 - DNA, 23 bp, Homo sapiens
gttggaacaatgtaggtaaggga

SEQ ID NO: 48373 - DNA, 25 bp, Homo sapiens
gttggaacaatgtaggtaagggaag

SEQ ID NO: 48374 - DNA, 30 bp, Homo sapiens
gttggaacaatgtaggtaagggaagtcggc

SEQ ID NO: 48375 - DNA, 16 bp, Homo sapiens
ttggaacaatgtaggt

SEQ ID NO: 48376 - DNA, 17 bp, Homo sapiens
ttggaacaatgtaggta

SEQ ID NO: 48377 - DNA, 18 bp, Homo sapiens
ttggaacaatgtaggtaa

SEQ ID NO: 48378 - DNA, 19 bp, Homo sapiens
ttggaacaatgtaggtaag

SEQ ID NO: 48379 - DNA, 20 bp, Homo sapiens
ttggaacaatgtaggtaagg

SEQ ID NO: 48380 - DNA, 21 bp, Homo sapiens
ttggaacaatgtaggtaaggg

SEQ ID NO: 48381 - DNA, 22 bp, Homo sapiens
ttggaacaatgtaggtaaggga

SEQ ID NO: 48382 - DNA, 24 bp, Homo sapiens
ttggaacaatgtaggtaagggaag

SEQ ID NO: 48383 - DNA, 26 bp, Homo sapiens
ttggaacaatgtaggtaagggaagtc

SEQ ID NO: 48384 - DNA, 27 bp, Homo sapiens
ttggaacaatgtaggtaagggaagtcg

SEQ ID NO: 48385 - DNA, 28 bp, Homo sapiens
ttggaacaatgtaggtaagggaagtcgg

SEQ ID NO: 48386 - DNA, 29 bp, Homo sapiens
ttggaacaatgtaggtaagggaagtcggc

SEQ ID NO: 48387 - DNA, 16 bp, Homo sapiens
tggaacaatgtaggta

SEQ ID NO: 48388 - DNA, 18 bp, Homo sapiens
tggaacaatgtaggtaag

SEQ ID NO: 48389 - DNA, 19 bp, Homo sapiens
tggaacaatgtaggtaagg

SEQ ID NO: 48390 - DNA, 20 bp, Homo sapiens
tggaacaatgtaggtaaggg

SEQ ID NO: 48391 - DNA, 21 bp, Homo sapiens
tggaacaatgtaggtaaggga

SEQ ID NO: 48392 - DNA, 22 bp, Homo sapiens
tggaacaatgtaggtaagggaa

SEQ ID NO: 48393 - DNA, 23 bp, Homo sapiens
tggaacaatgtaggtaagggaag

SEQ ID NO: 48394 - DNA, 24 bp, Homo sapiens
tggaacaatgtaggtaagggaagt

SEQ ID NO: 48395 - DNA, 25 bp, Homo sapiens
tggaacaatgtaggtaagggaagtc

SEQ ID NO: 48396 - DNA, 26 bp, Homo sapiens
tggaacaatgtaggtaagggaagtcg

SEQ ID NO: 48397 - DNA, 27 bp, Homo sapiens
tggaacaatgtaggtaagggaagtcgg

SEQ ID NO: 48398 - DNA, 29 bp, Homo sapiens
tggaacaatgtaggtaagggaagtcggca

SEQ ID NO: 48399 - DNA, 18 bp, Homo sapiens
ggaacaatgtaggtaagg

SEQ ID NO: 48400 - DNA, 19 bp, Homo sapiens
ggaacaatgtaggtaaggg

SEQ ID NO: 48401 - DNA, 22 bp, Homo sapiens
ggaacaatgtaggtaagggaag

SEQ ID NO: 48402 - DNA, 23 bp, Homo sapiens
ggaacaatgtaggtaagggaagt

SEQ ID NO: 48403 - DNA, 24 bp, Homo sapiens
ggaacaatgtaggtaagggaagtc

SEQ ID NO: 48404 - DNA, 25 bp, Homo sapiens
ggaacaatgtaggtaagggaagtcg

SEQ ID NO: 48405 - DNA, 27 bp, Homo sapiens
ggaacaatgtaggtaagggaagtcggc

SEQ ID NO: 48406 - DNA, 21 bp, Homo sapiens
gaacaatgtaggtaagggaag

SEQ ID NO: 48407 - DNA, 22 bp, Homo sapiens
gaacaatgtaggtaagggaagt

SEQ ID NO: 48408 - DNA, 23 bp, Homo sapiens
gaacaatgtaggtaagggaagtc

SEQ ID NO: 48409 - DNA, 24 bp, Homo sapiens
gaacaatgtaggtaagggaagtcg

SEQ ID NO: 48410 - DNA, 25 bp, Homo sapiens
gaacaatgtaggtaagggaagtcgg

SEQ ID NO: 48411 - DNA, 26 bp, Homo sapiens
gaacaatgtaggtaagggaagtcggc

SEQ ID NO: 48412 - DNA, 27 bp, Homo sapiens
gaacaatgtaggtaagggaagtcggca

SEQ ID NO: 48413 - DNA, 30 bp, Homo sapiens
gaacaatgtaggtaagggaagtcggcaagc

SEQ ID NO: 48414 - DNA, 20 bp, Homo sapiens
aacaatgtaggtaagggaag

SEQ ID NO: 48415 - DNA, 21 bp, Homo sapiens
aacaatgtaggtaagggaagt

SEQ ID NO: 48416 - DNA, 23 bp, Homo sapiens
aacaatgtaggtaagggaagtcg

SEQ ID NO: 48417 - DNA, 19 bp, Homo sapiens
acaatgtaggtaagggaag

SEQ ID NO: 48418 - DNA, 21 bp, Homo sapiens
acaatgtaggtaagggaagtc

SEQ ID NO: 48419 - DNA, 22 bp, Homo sapiens
acaatgtaggtaagggaagtcg

SEQ ID NO: 48420 - DNA, 23 bp, Homo sapiens
acaatgtaggtaagggaagtcgg

SEQ ID NO: 48421 - DNA, 24 bp, Homo sapiens
acaatgtaggtaagggaagtcggc

SEQ ID NO: 48422 - DNA, 18 bp, Homo sapiens
caatgtaggtaagggaag

SEQ ID NO: 48423 - DNA, 19 bp, Homo sapiens
caatgtaggtaagggaagt

SEQ ID NO: 48424 - DNA, 20 bp, Homo sapiens
caatgtaggtaagggaagtc

SEQ ID NO: 48425 - DNA, 21 bp, Homo sapiens
caatgtaggtaagggaagtcg

SEQ ID NO: 48426 - DNA, 22 bp, Homo sapiens
caatgtaggtaagggaagtcgg

SEQ ID NO: 48427 - DNA, 23 bp, Homo sapiens
caatgtaggtaagggaagtcggc

SEQ ID NO: 48428 - DNA, 24 bp, Homo sapiens
caatgtaggtaagggaagtcggca

SEQ ID NO: 48429 - DNA, 17 bp, Homo sapiens
aatgtaggtaagggaag

SEQ ID NO: 48430 - DNA, 18 bp, Homo sapiens
aatgtaggtaagggaagt

SEQ ID NO: 48431 - DNA, 19 bp, Homo sapiens
aatgtaggtaagggaagtc

SEQ ID NO: 48432 - DNA, 20 bp, Homo sapiens
aatgtaggtaagggaagtcg

SEQ ID NO: 48433 - DNA, 21 bp, Homo sapiens
aatgtaggtaagggaagtcgg

SEQ ID NO: 48434 - DNA, 22 bp, Homo sapiens
aatgtaggtaagggaagtcggc

SEQ ID NO: 48435 - DNA, 23 bp, Homo sapiens
aatgtaggtaagggaagtcggca

SEQ ID NO: 48436 - DNA, 28 bp, Homo sapiens
aatgtaggtaagggaagtcggcaagccg

SEQ ID NO: 48437 - DNA, 16 bp, Homo sapiens
atgtaggtaagggaag

SEQ ID NO: 48438 - DNA, 17 bp, Homo sapiens
atgtaggtaagggaagt

SEQ ID NO: 48439 - DNA, 18 bp, Homo sapiens
atgtaggtaagggaagtc

SEQ ID NO: 48440 - DNA, 19 bp, Homo sapiens
atgtaggtaagggaagtcg

SEQ ID NO: 48441 - DNA, 20 bp, Homo sapiens
atgtaggtaagggaagtcgg

SEQ ID NO: 48442 - DNA, 21 bp, Homo sapiens
atgtaggtaagggaagtcggc

SEQ ID NO: 48443 - DNA, 22 bp, Homo sapiens
atgtaggtaagggaagtcggca

SEQ ID NO: 48444 - DNA, 23 bp, Homo sapiens
atgtaggtaagggaagtcggcaa

SEQ ID NO: 48445 - DNA, 24 bp, Homo sapiens
atgtaggtaagggaagtcggcaag

SEQ ID NO: 48446 - DNA, 28 bp, Homo sapiens
atgtaggtaagggaagtcggcaagccgg

SEQ ID NO: 48447 - DNA, 17 bp, Homo sapiens
tgtaggtaagggaagtc

SEQ ID NO: 48448 - DNA, 18 bp, Homo sapiens
tgtaggtaagggaagtcg

SEQ ID NO: 48449 - DNA, 19 bp, Homo sapiens
tgtaggtaagggaagtcgg

SEQ ID NO: 48450 - DNA, 20 bp, Homo sapiens
tgtaggtaagggaagtcggc

SEQ ID NO: 48451 - DNA, 21 bp, Homo sapiens
tgtaggtaagggaagtcggca

SEQ ID NO: 48452 - DNA, 19 bp, Homo sapiens
gtaggtaagggaagtcggc

SEQ ID NO: 48453 - DNA, 26 bp, Homo sapiens
gtaggtaagggaagtcggcaagccgg

SEQ ID NO: 48454 - DNA, 17 bp, Homo sapiens
taggtaagggaagtcgg

SEQ ID NO: 48455 - DNA, 18 bp, Homo sapiens
taggtaagggaagtcggc

SEQ ID NO: 48456 - DNA, 21 bp, Homo sapiens
taggtaagggaagtcggcaag

SEQ ID NO: 48457 - DNA, 17 bp, Homo sapiens
aggtaagggaagtcggc

SEQ ID NO: 48458 - DNA, 16 bp, Homo sapiens
ggtaagggaagtcggc

SEQ ID NO: 48459 - DNA, 17 bp, Homo sapiens
taagggaagtcggcaag

SEQ ID NO: 48460 - DNA, 29 bp, Homo sapiens
agtcggcaagccggatccgtaacttcggg

SEQ ID NO: 48461 - DNA, 28 bp, Homo sapiens
gtcggcaagccggatccgtaacttcggg

SEQ ID NO: 48462 - DNA, 29 bp, Homo sapiens
tcggcaagccggatccgtaacttcgggat

SEQ ID NO: 48463 - DNA, 22 bp, Homo sapiens
cggcaagccggatccgtaactt

SEQ ID NO: 48464 - DNA, 30 bp, Homo sapiens; identical to SEQ ID NO: 5162

SEQ ID NO: 48465 - DNA, 18 bp, Homo sapiens
gcaagccggatccgtaac

SEQ ID NO: 48466 - DNA, 19 bp, Homo sapiens
gcaagccggatccgtaact

SEQ ID NO: 48467 - DNA, 22 bp, Homo sapiens
gcaagccggatccgtaacttcg

SEQ ID NO: 48468 - DNA, 25 bp, Homo sapiens
gcaagccggatccgtaacttcggga

SEQ ID NO: 48469 - DNA, 30 bp, Homo sapiens; identical to SEQ ID NO: 5169

SEQ ID NO: 48470 - DNA, 16 bp, Homo sapiens
caagccggatccgtaa

SEQ ID NO: 48471 - DNA, 17 bp, Homo sapiens
caagccggatccgtaac

SEQ ID NO: 48472 - DNA, 18 bp, Homo sapiens
caagccggatccgtaact

SEQ ID NO: 48473 - DNA, 19 bp, Homo sapiens
caagccggatccgtaactt

SEQ ID NO: 48474 - DNA, 21 bp, Homo sapiens
caagccggatccgtaacttcg

SEQ ID NO: 48475 - DNA, 22 bp, Homo sapiens
caagccggatccgtaacttcgg

SEQ ID NO: 48476 - DNA, 23 bp, Homo sapiens
caagccggatccgtaacttcggg

SEQ ID NO: 48477 - DNA, 24 bp, Homo sapiens
caagccggatccgtaacttcggga

SEQ ID NO: 48478 - DNA, 25 bp, Homo sapiens
caagccggatccgtaacttcgggat

SEQ ID NO: 48479 - DNA, 26 bp, Homo sapiens
caagccggatccgtaacttcgggata

SEQ ID NO: 48480 - DNA, 28 bp, Homo sapiens
caagccggatccgtaacttcgggataag

SEQ ID NO: 48481 - DNA, 29 bp, Homo sapiens
caagccggatccgtaacttcgggataagg

SEQ ID NO: 48482 - DNA, 20 bp, Homo sapiens
aagccggatccgtaacttcg

SEQ ID NO: 48483 - DNA, 22 bp, Homo sapiens
aagccggatccgtaacttcggg

SEQ ID NO: 48484 - DNA, 23 bp, Homo sapiens
aagccggatccgtaacttcggga

SEQ ID NO: 48485 - DNA, 28 bp, Homo sapiens
aagccggatccgtaacttcgggataagg

SEQ ID NO: 48486 - DNA, 19 bp, Homo sapiens
agccggatccgtaacttcg

SEQ ID NO: 48487 - DNA, 21 bp, Homo sapiens
agccggatccgtaacttcggg

SEQ ID NO: 48488 - DNA, 22 bp, Homo sapiens
agccggatccgtaacttcggga

SEQ ID NO: 48489 - DNA, 21 bp, Homo sapiens
gccggatccgtaacttcggga

SEQ ID NO: 48490 - DNA, 23 bp, Homo sapiens
gccggatccgtaacttcgggata

SEQ ID NO: 48491 - DNA, 24 bp, Homo sapiens
gccggatccgtaacttcgggataa

SEQ ID NO: 48492 - DNA, 25 bp, Homo sapiens
gccggatccgtaacttcgggataag

SEQ ID NO: 48493 - DNA, 30 bp, Homo sapiens; identical to SEQ ID NO: 5180

SEQ ID NO: 48494 - DNA, 19 bp, Homo sapiens
ccggatccgtaacttcggg

SEQ ID NO: 48495 - DNA, 20 bp, Homo sapiens
ccggatccgtaacttcggga

SEQ ID NO: 48496 - DNA, 24 bp, Homo sapiens
ccggatccgtaacttcgggataag

SEQ ID NO: 48497 - DNA, 30 bp, Homo sapiens; identical to SEQ ID NO: 23742

SEQ ID NO: 48498 - DNA, 19 bp, Homo sapiens
cggatccgtaacttcggga

SEQ ID NO: 48499 - DNA, 30 bp, Homo sapiens
gatccgtaacttcgggataaggattggctc

SEQ ID NO: 48500 - DNA, 20 bp, Homo sapiens
tccgtaacttcgggataagg

SEQ ID NO: 48501 - DNA, 23 bp, Homo sapiens
tccgtaacttcgggataaggatt

SEQ ID NO: 48502 - DNA, 24 bp, Homo sapiens
tccgtaacttcgggataaggattg

SEQ ID NO: 48503 - DNA, 25 bp, Homo sapiens
tccgtaacttcgggataaggattgg

SEQ ID NO: 48504 - DNA, 27 bp, Homo sapiens
tccgtaacttcgggataaggattggct

SEQ ID NO: 48505 - DNA, 29 bp, Homo sapiens
tccgtaacttcgggataaggattggctct

SEQ ID NO: 48506 - DNA, 19 bp, Homo sapiens
ccgtaacttcgggataagg

SEQ ID NO: 48507 - DNA, 20 bp, Homo sapiens
tccttatcccgaagttacgg

SEQ ID NO: 48508 - DNA, 24 bp, Homo sapiens
ccgtaacttcgggataaggattgg

SEQ ID NO: 48509 - DNA, 29 bp, Homo sapiens
ccgtaacttcgggataaggattggctcta

SEQ ID NO: 48510 - DNA, 18 bp, Homo sapiens
cgtaacttcgggataagg

SEQ ID NO: 48511 - DNA, 19 bp, Homo sapiens
cgtaacttcgggataagga

SEQ ID NO: 48512 - DNA, 22 bp, Homo sapiens
cgtaacttcgggataaggattg

SEQ ID NO: 48513 - DNA, 23 bp, Homo sapiens
cgtaacttcgggataaggattgg

SEQ ID NO: 48514 - DNA, 25 bp, Homo sapiens
cgtaacttcgggataaggattggct

SEQ ID NO: 48515 - DNA, 27 bp, Homo sapiens
cgtaacttcgggataaggattggctct

SEQ ID NO: 48516 - DNA, 28 bp, Homo sapiens
cgtaacttcgggataaggattggctcta

SEQ ID NO: 48517 - DNA, 30 bp, Homo sapiens; identical to SEQ ID NO: 23780

SEQ ID NO: 48518 - DNA, 21 bp, Homo sapiens
gtaacttcgggataaggattg

SEQ ID NO: 48519 - DNA, 22 bp, Homo sapiens
gtaacttcgggataaggattgg

SEQ ID NO: 48520 - DNA, 30 bp, Homo sapiens
gtaacttcgggataaggattggctctaagg

SEQ ID NO: 48521 - DNA, 21 bp, Homo sapiens
taacttcgggataaggattgg

SEQ ID NO: 48522 - DNA, 26 bp, Homo sapiens
taacttcgggataaggattggctcta

SEQ ID NO: 48523 - DNA, 30 bp, Homo sapiens
taacttcgggataaggattggctctaaggg

SEQ ID NO: 48524 - DNA, 19 bp, Homo sapiens
aacttcgggataaggattg

SEQ ID NO: 48525 - DNA, 20 bp, Homo sapiens
aacttcgggataaggattgg

SEQ ID NO: 48526 - DNA, 24 bp, Homo sapiens
aacttcgggataaggattggctct

SEQ ID NO: 48527 - DNA, 25 bp, Homo sapiens
aacttcgggataaggattggctcta

SEQ ID NO: 48528 - DNA, 26 bp, Homo sapiens
aacttcgggataaggattggctctaa

SEQ ID NO: 48529 - DNA, 27 bp, Homo sapiens
aacttcgggataaggattggctctaag

SEQ ID NO: 48530 - DNA, 28 bp, Homo sapiens
aacttcgggataaggattggctctaagg

SEQ ID NO: 48531 - DNA, 29 bp, Homo sapiens
aacttcgggataaggattggctctaaggg

SEQ ID NO: 48532 - DNA, 30 bp, Homo sapiens
aacttcgggataaggattggctctaagggc

SEQ ID NO: 48533 - DNA, 18 bp, Homo sapiens
acttcgggataaggattg

SEQ ID NO: 48534 - DNA, 19 bp, Homo sapiens
acttcgggataaggattgg

SEQ ID NO: 48535 - DNA, 21 bp, Homo sapiens
acttcgggataaggattggct

SEQ ID NO: 48536 - DNA, 23 bp, Homo sapiens
acttcgggataaggattggctct

SEQ ID NO: 48537 - DNA, 24 bp, Homo sapiens
acttcgggataaggattggctcta

SEQ ID NO: 48538 - DNA, 25 bp, Homo sapiens
acttcgggataaggattggctctaa

SEQ ID NO: 48539 - DNA, 26 bp, Homo sapiens
acttcgggataaggattggctctaag

SEQ ID NO: 48540 - DNA, 27 bp, Homo sapiens
acttcgggataaggattggctctaagg

SEQ ID NO: 48541 - DNA, 28 bp, Homo sapiens
acttcgggataaggattggctctaaggg

SEQ ID NO: 48542 - DNA, 29 bp, Homo sapiens
acttcgggataaggattggctctaagggc

SEQ ID NO: 48543 - DNA, 30 bp, Homo sapiens; identical to SEQ ID NO: 23795

SEQ ID NO: 48544 - DNA, 18 bp, Homo sapiens
cttcgggataaggattgg

SEQ ID NO: 48545 - DNA, 22 bp, Homo sapiens
cttcgggataaggattggctct

SEQ ID NO: 48546 - DNA, 23 bp, Homo sapiens
cttcgggataaggattggctcta

SEQ ID NO: 48547 - DNA, 24 bp, Homo sapiens
cttcgggataaggattggctctaa

SEQ ID NO: 48548 - DNA, 25 bp, Homo sapiens
cttcgggataaggattggctctaag

SEQ ID NO: 48549 - DNA, 26 bp, Homo sapiens
cttcgggataaggattggctctaagg

SEQ ID NO: 48550 - DNA, 27 bp, Homo sapiens
cttcgggataaggattggctctaaggg

SEQ ID NO: 48551 - DNA, 30 bp, Homo sapiens; identical to SEQ ID NO: 23803

SEQ ID NO: 48552 - DNA, 17 bp, Homo sapiens
ttcgggataaggattgg

SEQ ID NO: 48553 - DNA, 19 bp, Homo sapiens
ttcgggataaggattggct

SEQ ID NO: 48554 - DNA, 20 bp, Homo sapiens
ttcgggataaggattggctc

SEQ ID NO: 48555 - DNA, 21 bp, Homo sapiens
ttcgggataaggattggctct

SEQ ID NO: 48556 - DNA, 22 bp, Homo sapiens
ttcgggataaggattggctcta

SEQ ID NO: 48557 - DNA, 23 bp, Homo sapiens
ttcgggataaggattggctctaa

SEQ ID NO: 48558 - DNA, 24 bp, Homo sapiens
ttcgggataaggattggctctaag

SEQ ID NO: 48559 - DNA, 25 bp, Homo sapiens
ttcgggataaggattggctctaagg

SEQ ID NO: 48560 - DNA, 26 bp, Homo sapiens
ttcgggataaggattggctctaaggg

SEQ ID NO: 48561 - DNA, 27 bp, Homo sapiens
ttcgggataaggattggctctaagggc

SEQ ID NO: 48562 - DNA, 30 bp, Homo sapiens; identical to SEQ ID NO: 23812

SEQ ID NO: 48563 - DNA, 16 bp, Homo sapiens
tcgggataaggattgg

SEQ ID NO: 48564 - DNA, 20 bp, Homo sapiens
tcgggataaggattggctct

SEQ ID NO: 48565 - DNA, 21 bp, Homo sapiens
tcgggataaggattggctcta

SEQ ID NO: 48566 - DNA, 22 bp, Homo sapiens
tcgggataaggattggctctaa

SEQ ID NO: 48567 - DNA, 23 bp, Homo sapiens
tcgggataaggattggctctaag

SEQ ID NO: 48568 - DNA, 24 bp, Homo sapiens
tcgggataaggattggctctaagg

SEQ ID NO: 48569 - DNA, 25 bp, Homo sapiens
tcgggataaggattggctctaaggg

SEQ ID NO: 48570 - DNA, 26 bp, Homo sapiens
tcgggataaggattggctctaagggc

SEQ ID NO: 48571 - DNA, 30 bp, Homo sapiens; identical to SEQ ID NO: 23824

SEQ ID NO: 48572 - DNA, 19 bp, Homo sapiens
cgggataaggattggctct

SEQ ID NO: 48573 - DNA, 20 bp, Homo sapiens
cgggataaggattggctcta

SEQ ID NO: 48574 - DNA, 21 bp, Homo sapiens
cgggataaggattggctctaa

SEQ ID NO: 48575 - DNA, 22 bp, Homo sapiens
cgggataaggattggctctaag

SEQ ID NO: 48576 - DNA, 23 bp, Homo sapiens
cgggataaggattggctctaagg

SEQ ID NO: 48577 - DNA, 24 bp, Homo sapiens
cgggataaggattggctctaaggg

SEQ ID NO: 48578 - DNA, 25 bp, Homo sapiens
cgggataaggattggctctaagggc

SEQ ID NO: 48579 - DNA, 29 bp, Homo sapiens
cgggataaggattggctctaagggctggg

SEQ ID NO: 48580 - DNA, 30 bp, Homo sapiens
cgggataaggattggctctaagggctgggt

SEQ ID NO: 48581 - DNA, 22 bp, Homo sapiens
gggataaggattggctctaagg

SEQ ID NO: 48582 - DNA, 23 bp, Homo sapiens
gggataaggattggctctaaggg

SEQ ID NO: 48583 - DNA, 24 bp, Homo sapiens
gggataaggattggctctaagggc

SEQ ID NO: 48584 - DNA, 28 bp, Homo sapiens
gggataaggattggctctaagggctggg

SEQ ID NO: 48585 - DNA, 30 bp, Homo sapiens
gggataaggattggctctaagggctgggtc

SEQ ID NO: 48586 - DNA, 23 bp, Homo sapiens
ggataaggattggctctaagggc

SEQ ID NO: 48587 - DNA, 27 bp, Homo sapiens
ggataaggattggctctaagggctggg

SEQ ID NO: 48588 - DNA, 28 bp, Homo sapiens
ggataaggattggctctaagggctgggt

SEQ ID NO: 48589 - DNA, 30 bp, Homo sapiens
ggataaggattggctctaagggctgggtcg

SEQ ID NO: 48590 - DNA, 17 bp, Homo sapiens
gataaggattggctcta

SEQ ID NO: 48591 - DNA, 18 bp, Homo sapiens
gataaggattggctctaa

SEQ ID NO: 48592 - DNA, 19 bp, Homo sapiens
gataaggattggctctaag

SEQ ID NO: 48593 - DNA, 20 bp, Homo sapiens
gataaggattggctctaagg

SEQ ID NO: 48594 - DNA, 21 bp, Homo sapiens
gataaggattggctctaaggg

SEQ ID NO: 48595 - DNA, 22 bp, Homo sapiens
gataaggattggctctaagggc

SEQ ID NO: 48596 - DNA, 23 bp, Homo sapiens
gataaggattggctctaagggct

SEQ ID NO: 48597 - DNA, 25 bp, Homo sapiens
gataaggattggctctaagggctgg

SEQ ID NO: 48598 - DNA, 26 bp, Homo sapiens
gataaggattggctctaagggctggg

SEQ ID NO: 48599 - DNA, 27 bp, Homo sapiens
gataaggattggctctaagggctgggt

SEQ ID NO: 48600 - DNA, 28 bp, Homo sapiens
gataaggattggctctaagggctgggtc

SEQ ID NO: 48601 - DNA, 30 bp, Homo sapiens
gataaggattggctctaagggctgggtcgg

SEQ ID NO: 48602 - DNA, 16 bp, Homo sapiens
ataaggattggctcta

SEQ ID NO: 48603 - DNA, 17 bp, Homo sapiens
ataaggattggctctaa

SEQ ID NO: 48604 - DNA, 18 bp, Homo sapiens
ataaggattggctctaag

SEQ ID NO: 48605 - DNA, 19 bp, Homo sapiens
ataaggattggctctaagg

SEQ ID NO: 48606 - DNA, 20 bp, Homo sapiens
ataaggattggctctaaggg

SEQ ID NO: 48607 - DNA, 21 bp, Homo sapiens
ataaggattggctctaagggc

SEQ ID NO: 48608 - DNA, 22 bp, Homo sapiens
ataaggattggctctaagggct

SEQ ID NO: 48609 - DNA, 24 bp, Homo sapiens
ataaggattggctctaagggctgg

SEQ ID NO: 48610 - DNA, 25 bp, Homo sapiens
ataaggattggctctaagggctggg

SEQ ID NO: 48611 - DNA, 26 bp, Homo sapiens
ataaggattggctctaagggctgggt

SEQ ID NO: 48612 - DNA, 29 bp, Homo sapiens
ataaggattggctctaagggctgggtcgg

SEQ ID NO: 48613 - DNA, 30 bp, Homo sapiens
ataaggattggctctaagggctgggtcggt

SEQ ID NO: 48614 - DNA, 17 bp, Homo sapiens
taaggattggctctaag

SEQ ID NO: 48615 - DNA, 18 bp, Homo sapiens
taaggattggctctaagg

SEQ ID NO: 48616 - DNA, 19 bp, Homo sapiens
taaggattggctctaaggg

SEQ ID NO: 48617 - DNA, 20 bp, Homo sapiens
taaggattggctctaagggc

SEQ ID NO: 48618 - DNA, 21 bp, Homo sapiens
taaggattggctctaagggct

SEQ ID NO: 48619 - DNA, 23 bp, Homo sapiens
taaggattggctctaagggctgg

SEQ ID NO: 48620 - DNA, 24 bp, Homo sapiens
taaggattggctctaagggctggg

SEQ ID NO: 48621 - DNA, 25 bp, Homo sapiens
taaggattggctctaagggctgggt

SEQ ID NO: 48622 - DNA, 28 bp, Homo sapiens
taaggattggctctaagggctgggtcgg

SEQ ID NO: 48623 - DNA, 30 bp, Homo sapiens; identical to SEQ ID NO: 23853

SEQ ID NO: 48624 - DNA, 16 bp, Homo sapiens
aaggattggctctaag

SEQ ID NO: 48625 - DNA, 17 bp, Homo sapiens
aaggattggctctaagg

SEQ ID NO: 48626 - DNA, 18 bp, Homo sapiens
aaggattggctctaaggg

SEQ ID NO: 48627 - DNA, 19 bp, Homo sapiens
aaggattggctctaagggc

SEQ ID NO: 48628 - DNA, 20 bp, Homo sapiens
aaggattggctctaagggct

SEQ ID NO: 48629 - DNA, 22 bp, Homo sapiens
aaggattggctctaagggctgg

SEQ ID NO: 48630 - DNA, 23 bp, Homo sapiens
aaggattggctctaagggctggg

SEQ ID NO: 48631 - DNA, 24 bp, Homo sapiens
aaggattggctctaagggctgggt

SEQ ID NO: 48632 - DNA, 25 bp, Homo sapiens
aaggattggctctaagggctgggtc

SEQ ID NO: 48633 - DNA, 27 bp, Homo sapiens
aaggattggctctaagggctgggtcgg

SEQ ID NO: 48634 - DNA, 28 bp, Homo sapiens
aaggattggctctaagggctgggtcggt

SEQ ID NO: 48635 - DNA, 30 bp, Homo sapiens
aaggattggctctaagggctgggtcggtcg

SEQ ID NO: 48636 - DNA, 21 bp, Homo sapiens
aggattggctctaagggctgg

SEQ ID NO: 48637 - DNA, 22 bp, Homo sapiens
aggattggctctaagggctggg

SEQ ID NO: 48638 - DNA, 23 bp, Homo sapiens
aggattggctctaagggctgggt

SEQ ID NO: 48639 - DNA, 26 bp, Homo sapiens
aggattggctctaagggctgggtcgg

SEQ ID NO: 48640 - DNA, 27 bp, Homo sapiens
aggattggctctaagggctgggtcggt

SEQ ID NO: 48641 - DNA, 30 bp, Homo sapiens
aggattggctctaagggctgggtcggtcgg

SEQ ID NO: 48642 - DNA, 20 bp, Homo sapiens
ggattggctctaagggctgg

SEQ ID NO: 48643 - DNA, 21 bp, Homo sapiens
ggattggctctaagggctggg

SEQ ID NO: 48644 - DNA, 22 bp, Homo sapiens
ggattggctctaagggctgggt

SEQ ID NO: 48645 - DNA, 25 bp, Homo sapiens
ggattggctctaagggctgggtcgg

SEQ ID NO: 48646 - DNA, 29 bp, Homo sapiens
ggattggctctaagggctgggtcggtcgg

SEQ ID NO: 48647 - DNA, 30 bp, Homo sapiens
ggattggctctaagggctgggtcggtcggg

SEQ ID NO: 48648 - DNA, 19 bp, Homo sapiens
gattggctctaagggctgg

SEQ ID NO: 48649 - DNA, 20 bp, Homo sapiens
gattggctctaagggctggg

SEQ ID NO: 48650 - DNA, 21 bp, Homo sapiens
gattggctctaagggctgggt

SEQ ID NO: 48651 - DNA, 22 bp, Homo sapiens
gattggctctaagggctgggtc

SEQ ID NO: 48652 - DNA, 24 bp, Homo sapiens
gattggctctaagggctgggtcgg

SEQ ID NO: 48653 - DNA, 25 bp, Homo sapiens
gattggctctaagggctgggtcggt

SEQ ID NO: 48654 - DNA, 28 bp, Homo sapiens
gattggctctaagggctgggtcggtcgg

SEQ ID NO: 48655 - DNA, 29 bp, Homo sapiens
gattggctctaagggctgggtcggtcggg

SEQ ID NO: 48656 - DNA, 30 bp, Homo sapiens
gattggctctaagggctgggtcggtcgggc

SEQ ID NO: 48657 - DNA, 17 bp, Homo sapiens
attggctctaagggctg

SEQ ID NO: 48658 - DNA, 18 bp, Homo sapiens
attggctctaagggctgg

SEQ ID NO: 48659 - DNA, 19 bp, Homo sapiens
attggctctaagggctggg

SEQ ID NO: 48660 - DNA, 20 bp, Homo sapiens
attggctctaagggctgggt

SEQ ID NO: 48661 - DNA, 21 bp, Homo sapiens
attggctctaagggctgggtc

SEQ ID NO: 48662 - DNA, 22 bp, Homo sapiens
attggctctaagggctgggtcg

SEQ ID NO: 48663 - DNA, 23 bp, Homo sapiens
attggctctaagggctgggtcgg

SEQ ID NO: 48664 - DNA, 24 bp, Homo sapiens
attggctctaagggctgggtcggt

SEQ ID NO: 48665 - DNA, 25 bp, Homo sapiens
attggctctaagggctgggtcggtc

SEQ ID NO: 48666 - DNA, 26 bp, Homo sapiens
attggctctaagggctgggtcggtcg

SEQ ID NO: 48667 - DNA, 27 bp, Homo sapiens
attggctctaagggctgggtcggtcgg

SEQ ID NO: 48668 - DNA, 28 bp, Homo sapiens
attggctctaagggctgggtcggtcggg

SEQ ID NO: 48669 - DNA, 29 bp, Homo sapiens
attggctctaagggctgggtcggtcgggc

SEQ ID NO: 48670 - DNA, 30 bp, Homo sapiens
attggctctaagggctgggtcggtcgggct

SEQ ID NO: 48671 - DNA, 16 bp, Homo sapiens
ttggctctaagggctg

SEQ ID NO: 48672 - DNA, 17 bp, Homo sapiens
ttggctctaagggctgg

SEQ ID NO: 48673 - DNA, 18 bp, Homo sapiens
ttggctctaagggctggg

SEQ ID NO: 48674 - DNA, 19 bp, Homo sapiens
ttggctctaagggctgggt

SEQ ID NO: 48675 - DNA, 20 bp, Homo sapiens
ttggctctaagggctgggtc

SEQ ID NO: 48676 - DNA, 21 bp, Homo sapiens
ttggctctaagggctgggtcg

SEQ ID NO: 48677 - DNA, 22 bp, Homo sapiens
ttggctctaagggctgggtcgg

SEQ ID NO: 48678 - DNA, 23 bp, Homo sapiens
ttggctctaagggctgggtcggt

SEQ ID NO: 48679 - DNA, 24 bp, Homo sapiens
ttggctctaagggctgggtcggtc

SEQ ID NO: 48680 - DNA, 25 bp, Homo sapiens
ttggctctaagggctgggtcggtcg

SEQ ID NO: 48681 - DNA, 26 bp, Homo sapiens
ttggctctaagggctgggtcggtcgg

SEQ ID NO: 48682 - DNA, 27 bp, Homo sapiens
ttggctctaagggctgggtcggtcggg

SEQ ID NO: 48683 - DNA, 30 bp, Homo sapiens
ttggctctaagggctgggtcggtcgggctg

SEQ ID NO: 48684 - DNA, 16 bp, Homo sapiens
tggctctaagggctgg

SEQ ID NO: 48685 - DNA, 17 bp, Homo sapiens
tggctctaagggctggg

SEQ ID NO: 48686 - DNA, 18 bp, Homo sapiens
tggctctaagggctgggt

SEQ ID NO: 48687 - DNA, 19 bp, Homo sapiens
tggctctaagggctgggtc

SEQ ID NO: 48688 - DNA, 20 bp, Homo sapiens
tggctctaagggctgggtcg

SEQ ID NO: 48689 - DNA, 21 bp, Homo sapiens
tggctctaagggctgggtcgg

SEQ ID NO: 48690 - DNA, 22 bp, Homo sapiens
tggctctaagggctgggtcggt

SEQ ID NO: 48691 - DNA, 23 bp, Homo sapiens
tggctctaagggctgggtcggtc

SEQ ID NO: 48692 - DNA, 24 bp, Homo sapiens
tggctctaagggctgggtcggtcg

SEQ ID NO: 48693 - DNA, 25 bp, Homo sapiens
tggctctaagggctgggtcggtcgg

SEQ ID NO: 48694 - DNA, 26 bp, Homo sapiens
tggctctaagggctgggtcggtcggg

SEQ ID NO: 48695 - DNA, 27 bp, Homo sapiens
tggctctaagggctgggtcggtcgggc

SEQ ID NO: 48696 - DNA, 29 bp, Homo sapiens
tggctctaagggctgggtcggtcgggctg

SEQ ID NO: 48697 - DNA, 30 bp, Homo sapiens; identical to SEQ ID NO: 23881

SEQ ID NO: 48698 - DNA, 16 bp, Homo sapiens
ggctctaagggctggg

SEQ ID NO: 48699 - DNA, 17 bp, Homo sapiens
ggctctaagggctgggt

SEQ ID NO: 48700 - DNA, 20 bp, Homo sapiens
ggctctaagggctgggtcgg

SEQ ID NO: 48701 - DNA, 23 bp, Homo sapiens
ggctctaagggctgggtcggtcg

SEQ ID NO: 48702 - DNA, 24 bp, Homo sapiens
ggctctaagggctgggtcggtcgg

SEQ ID NO: 48703 - DNA, 25 bp, Homo sapiens
ggctctaagggctgggtcggtcggg

SEQ ID NO: 48704 - DNA, 26 bp, Homo sapiens
ggctctaagggctgggtcggtcgggc

SEQ ID NO: 48705 - DNA, 27 bp, Homo sapiens
ggctctaagggctgggtcggtcgggct

SEQ ID NO: 48706 - DNA, 28 bp, Homo sapiens
ggctctaagggctgggtcggtcgggctg

SEQ ID NO: 48707 - DNA, 29 bp, Homo sapiens
ggctctaagggctgggtcggtcgggctgg

SEQ ID NO: 48708 - DNA, 30 bp, Homo sapiens
ggctctaagggctgggtcggtcgggctggg

SEQ ID NO: 48709 - DNA, 16 bp, Homo sapiens
gctctaagggctgggt

SEQ ID NO: 48710 - DNA, 18 bp, Homo sapiens
gctctaagggctgggtcg

SEQ ID NO: 48711 - DNA, 19 bp, Homo sapiens
gctctaagggctgggtcgg

SEQ ID NO: 48712 - DNA, 20 bp, Homo sapiens
gctctaagggctgggtcggt

SEQ ID NO: 48713 - DNA, 21 bp, Homo sapiens
gctctaagggctgggtcggtc

SEQ ID NO: 48714 - DNA, 22 bp, Homo sapiens
gctctaagggctgggtcggtcg

SEQ ID NO: 48715 - DNA, 23 bp, Homo sapiens
gctctaagggctgggtcggtcgg

SEQ ID NO: 48716 - DNA, 24 bp, Homo sapiens
gctctaagggctgggtcggtcggg

SEQ ID NO: 48717 - DNA, 25 bp, Homo sapiens
gctctaagggctgggtcggtcgggc

SEQ ID NO: 48718 - DNA, 26 bp, Homo sapiens
gctctaagggctgggtcggtcgggct

SEQ ID NO: 48719 - DNA, 27 bp, Homo sapiens
gctctaagggctgggtcggtcgggctg

SEQ ID NO: 48720 - DNA, 28 bp, Homo sapiens
gctctaagggctgggtcggtcgggctgg

SEQ ID NO: 48721 - DNA, 29 bp, Homo sapiens
gctctaagggctgggtcggtcgggctggg

SEQ ID NO: 48722 - DNA, 30 bp, Homo sapiens; identical to SEQ ID NO: 30177

SEQ ID NO: 48723 - DNA, 17 bp, Homo sapiens
ctctaagggctgggtcg

SEQ ID NO: 48724 - DNA, 18 bp, Homo sapiens
ctctaagggctgggtcgg

SEQ ID NO: 48725 - DNA, 19 bp, Homo sapiens
ctctaagggctgggtcggt

SEQ ID NO: 48726 - DNA, 20 bp, Homo sapiens
ctctaagggctgggtcggtc

SEQ ID NO: 48727 - DNA, 21 bp, Homo sapiens
ctctaagggctgggtcggtcg

SEQ ID NO: 48728 - DNA, 22 bp, Homo sapiens
ctctaagggctgggtcggtcgg

SEQ ID NO: 48729 - DNA, 23 bp, Homo sapiens
ctctaagggctgggtcggtcggg

SEQ ID NO: 48730 - DNA, 24 bp, Homo sapiens
ctctaagggctgggtcggtcgggc

SEQ ID NO: 48731 - DNA, 25 bp, Homo sapiens
ctctaagggctgggtcggtcgggct

SEQ ID NO: 48732 - DNA, 26 bp, Homo sapiens
ctctaagggctgggtcggtcgggctg

SEQ ID NO: 48733 - DNA, 27 bp, Homo sapiens
ctctaagggctgggtcggtcgggctgg

SEQ ID NO: 48734 - DNA, 28 bp, Homo sapiens
ctctaagggctgggtcggtcgggctggg

SEQ ID NO: 48735 - DNA, 29 bp, Homo sapiens
ctctaagggctgggtcggtcgggctgggg

SEQ ID NO: 48736 - DNA, 30 bp, Homo sapiens
ctctaagggctgggtcggtcgggctggggc

SEQ ID NO: 48737 - DNA, 16 bp, Homo sapiens
tctaagggctgggtcg

SEQ ID NO: 48738 - DNA, 17 bp, Homo sapiens
tctaagggctgggtcgg

SEQ ID NO: 48739 - DNA, 19 bp, Homo sapiens
tctaagggctgggtcggtc

SEQ ID NO: 48740 - DNA, 20 bp, Homo sapiens
tctaagggctgggtcggtcg

SEQ ID NO: 48741 - DNA, 21 bp, Homo sapiens
tctaagggctgggtcggtcgg

SEQ ID NO: 48742 - DNA, 22 bp, Homo sapiens
tctaagggctgggtcggtcggg

SEQ ID NO: 48743 - DNA, 23 bp, Homo sapiens
tctaagggctgggtcggtcgggc

SEQ ID NO: 48744 - DNA, 24 bp, Homo sapiens
tctaagggctgggtcggtcgggct

SEQ ID NO: 48745 - DNA, 25 bp, Homo sapiens
tctaagggctgggtcggtcgggctg

SEQ ID NO: 48746 - DNA, 26 bp, Homo sapiens
tctaagggctgggtcggtcgggctgg

SEQ ID NO: 48747 - DNA, 27 bp, Homo sapiens
tctaagggctgggtcggtcgggctggg

SEQ ID NO: 48748 - DNA, 28 bp, Homo sapiens
tctaagggctgggtcggtcgggctgggg

SEQ ID NO: 48749 - DNA, 29 bp, Homo sapiens
tctaagggctgggtcggtcgggctggggc

SEQ ID NO: 48750 - DNA, 30 bp, Homo sapiens
tctaagggctgggtcggtcgggctggggcg

SEQ ID NO: 48751 - DNA, 16 bp, Homo sapiens
ctaagggctgggtcgg

SEQ ID NO: 48752 - DNA, 17 bp, Homo sapiens
ctaagggctgggtcggt

SEQ ID NO: 48753 - DNA, 18 bp, Homo sapiens
ctaagggctgggtcggtc

SEQ ID NO: 48754 - DNA, 19 bp, Homo sapiens
ctaagggctgggtcggtcg

SEQ ID NO: 48755 - DNA, 20 bp, Homo sapiens
ctaagggctgggtcggtcgg

SEQ ID NO: 48756 - DNA, 21 bp, Homo sapiens
ctaagggctgggtcggtcggg

SEQ ID NO: 48757 - DNA, 22 bp, Homo sapiens
ctaagggctgggtcggtcgggc

SEQ ID NO: 48758 - DNA, 23 bp, Homo sapiens
ctaagggctgggtcggtcgggct

SEQ ID NO: 48759 - DNA, 24 bp, Homo sapiens
ctaagggctgggtcggtcgggctg

SEQ ID NO: 48760 - DNA, 25 bp, Homo sapiens
ctaagggctgggtcggtcgggctgg

SEQ ID NO: 48761 - DNA, 26 bp, Homo sapiens
ctaagggctgggtcggtcgggctggg

SEQ ID NO: 48762 - DNA, 27 bp, Homo sapiens
ctaagggctgggtcggtcgggctgggg

SEQ ID NO: 48763 - DNA, 28 bp, Homo sapiens
ctaagggctgggtcggtcgggctggggc

SEQ ID NO: 48764 - DNA, 29 bp, Homo sapiens
ctaagggctgggtcggtcgggctggggcg

SEQ ID NO: 48765 - DNA, 30 bp, Homo sapiens
ctaagggctgggtcggtcgggctggggcgc

SEQ ID NO: 48766 - DNA, 19 bp, Homo sapiens
taagggctgggtcggtcgg

SEQ ID NO: 48767 - DNA, 20 bp, Homo sapiens
taagggctgggtcggtcggg

SEQ ID NO: 48768 - DNA, 21 bp, Homo sapiens
taagggctgggtcggtcgggc

SEQ ID NO: 48769 - DNA, 22 bp, Homo sapiens
taagggctgggtcggtcgggct

SEQ ID NO: 48770 - DNA, 23 bp, Homo sapiens
taagggctgggtcggtcgggctg

SEQ ID NO: 48771 - DNA, 24 bp, Homo sapiens
taagggctgggtcggtcgggctgg

SEQ ID NO: 48772 - DNA, 25 bp, Homo sapiens
taagggctgggtcggtcgggctggg

SEQ ID NO: 48773 - DNA, 17 bp, Homo sapiens
aagggctgggtcggtcg

SEQ ID NO: 48774 - DNA, 18 bp, Homo sapiens
aagggctgggtcggtcgg

SEQ ID NO: 48775 - DNA, 19 bp, Homo sapiens
aagggctgggtcggtcggg

SEQ ID NO: 48776 - DNA, 20 bp, Homo sapiens
aagggctgggtcggtcgggc

SEQ ID NO: 48777 - DNA, 21 bp, Homo sapiens
aagggctgggtcggtcgggct

SEQ ID NO: 48778 - DNA, 22 bp, Homo sapiens
aagggctgggtcggtcgggctg

SEQ ID NO: 48779 - DNA, 23 bp, Homo sapiens
aagggctgggtcggtcgggctgg

SEQ ID NO: 48780 - DNA, 24 bp, Homo sapiens
aagggctgggtcggtcgggctggg

SEQ ID NO: 48781 - DNA, 25 bp, Homo sapiens
aagggctgggtcggtcgggctgggg

SEQ ID NO: 48782 - DNA, 26 bp, Homo sapiens
aagggctgggtcggtcgggctggggc

SEQ ID NO: 48783 - DNA, 29 bp, Homo sapiens
aagggctgggtcggtcgggctggggcgcg

SEQ ID NO: 48784 - DNA, 17 bp, Homo sapiens
agggctgggtcggtcgg

SEQ ID NO: 48785 - DNA, 18 bp, Homo sapiens
agggctgggtcggtcggg

SEQ ID NO: 48786 - DNA, 19 bp, Homo sapiens
agggctgggtcggtcgggc

SEQ ID NO: 48787 - DNA, 20 bp, Homo sapiens
agggctgggtcggtcgggct

SEQ ID NO: 48788 - DNA, 21 bp, Homo sapiens
agggctgggtcggtcgggctg

SEQ ID NO: 48789 - DNA, 22 bp, Homo sapiens
agggctgggtcggtcgggctgg

SEQ ID NO: 48790 - DNA, 23 bp, Homo sapiens
agggctgggtcggtcgggctggg

SEQ ID NO: 48791 - DNA, 24 bp, Homo sapiens
agggctgggtcggtcgggctgggg

SEQ ID NO: 48792 - DNA, 25 bp, Homo sapiens
agggctgggtcggtcgggctggggc

SEQ ID NO: 48793 - DNA, 26 bp, Homo sapiens
agggctgggtcggtcgggctggggcg

SEQ ID NO: 48794 - DNA, 27 bp, Homo sapiens
agggctgggtcggtcgggctggggcgc

SEQ ID NO: 48795 - DNA, 28 bp, Homo sapiens
agggctgggtcggtcgggctggggcgcg

SEQ ID NO: 48796 - DNA, 29 bp, Homo sapiens
agggctgggtcggtcgggctggggcgcga

SEQ ID NO: 48797 - DNA, 16 bp, Homo sapiens
gggctgggtcggtcgg

SEQ ID NO: 48798 - DNA, 17 bp, Homo sapiens
gggctgggtcggtcggg

SEQ ID NO: 48799 - DNA, 18 bp, Homo sapiens
gggctgggtcggtcgggc

SEQ ID NO: 48800 - DNA, 19 bp, Homo sapiens
gggctgggtcggtcgggct

SEQ ID NO: 48801 - DNA, 20 bp, Homo sapiens
gggctgggtcggtcgggctg

SEQ ID NO: 48802 - DNA, 21 bp, Homo sapiens
gggctgggtcggtcgggctgg

SEQ ID NO: 48803 - DNA, 22 bp, Homo sapiens
gggctgggtcggtcgggctggg

SEQ ID NO: 48804 - DNA, 24 bp, Homo sapiens
gggctgggtcggtcgggctggggc

SEQ ID NO: 48805 - DNA, 25 bp, Homo sapiens
gggctgggtcggtcgggctggggcg

SEQ ID NO: 48806 - DNA, 26 bp, Homo sapiens
gggctgggtcggtcgggctggggcgc

SEQ ID NO: 48807 - DNA, 27 bp, Homo sapiens
gggctgggtcggtcgggctggggcgcg

SEQ ID NO: 48808 - DNA, 20 bp, Homo sapiens
ggctgggtcggtcgggctgg

SEQ ID NO: 48809 - DNA, 21 bp, Homo sapiens
ggctgggtcggtcgggctggg

SEQ ID NO: 48810 - DNA, 22 bp, Homo sapiens
ggctgggtcggtcgggctgggg

SEQ ID NO: 48811 - DNA, 23 bp, Homo sapiens
ggctgggtcggtcgggctggggc

SEQ ID NO: 48812 - DNA, 26 bp, Homo sapiens
ggctgggtcggtcgggctggggcgcg

SEQ ID NO: 48813 - DNA, 30 bp, Homo sapiens
ggctgggtcggtcgggctggggcgcgaagc

SEQ ID NO: 48814 - DNA, 16 bp, Homo sapiens
gctgggtcggtcgggc

SEQ ID NO: 48815 - DNA, 17 bp, Homo sapiens
gctgggtcggtcgggct

SEQ ID NO: 48816 - DNA, 18 bp, Homo sapiens
gctgggtcggtcgggctg

SEQ ID NO: 48817 - DNA, 19 bp, Homo sapiens
gctgggtcggtcgggctgg

SEQ ID NO: 48818 - DNA, 20 bp, Homo sapiens
gctgggtcggtcgggctggg

SEQ ID NO: 48819 - DNA, 21 bp, Homo sapiens
gctgggtcggtcgggctgggg

SEQ ID NO: 48820 - DNA, 22 bp, Homo sapiens
gctgggtcggtcgggctggggc

SEQ ID NO: 48821 - DNA, 23 bp, Homo sapiens
gctgggtcggtcgggctggggcg

SEQ ID NO: 48822 - DNA, 24 bp, Homo sapiens
gctgggtcggtcgggctggggcgc

SEQ ID NO: 48823 - DNA, 25 bp, Homo sapiens
gctgggtcggtcgggctggggcgcg

SEQ ID NO: 48824 - DNA, 26 bp, Homo sapiens
gctgggtcggtcgggctggggcgcga

SEQ ID NO: 48825 - DNA, 27 bp, Homo sapiens
gctgggtcggtcgggctggggcgcgaa

SEQ ID NO: 48826 - DNA, 28 bp, Homo sapiens
gctgggtcggtcgggctggggcgcgaag

SEQ ID NO: 48827 - DNA, 29 bp, Homo sapiens
gctgggtcggtcgggctggggcgcgaagc

SEQ ID NO: 48828 - DNA, 30 bp, Homo sapiens
gctgggtcggtcgggctggggcgcgaagcg

SEQ ID NO: 48829 - DNA, 16 bp, Homo sapiens
ctgggtcggtcgggct

SEQ ID NO: 48830 - DNA, 17 bp, Homo sapiens
ctgggtcggtcgggctg

SEQ ID NO: 48831 - DNA, 18 bp, Homo sapiens
ctgggtcggtcgggctgg

SEQ ID NO: 48832 - DNA, 19 bp, Homo sapiens
ctgggtcggtcgggctggg

SEQ ID NO: 48833 - DNA, 20 bp, Homo sapiens
ctgggtcggtcgggctgggg

SEQ ID NO: 48834 - DNA, 21 bp, Homo sapiens
ctgggtcggtcgggctggggc

SEQ ID NO: 48835 - DNA, 22 bp, Homo sapiens
ctgggtcggtcgggctggggcg

SEQ ID NO: 48836 - DNA, 23 bp, Homo sapiens
ctgggtcggtcgggctggggcgc

SEQ ID NO: 48837 - DNA, 24 bp, Homo sapiens
ctgggtcggtcgggctggggcgcg

SEQ ID NO: 48838 - DNA, 25 bp, Homo sapiens
ctgggtcggtcgggctggggcgcga

SEQ ID NO: 48839 - DNA, 26 bp, Homo sapiens
ctgggtcggtcgggctggggcgcgaa

SEQ ID NO: 48840 - DNA, 27 bp, Homo sapiens
ctgggtcggtcgggctggggcgcgaag

SEQ ID NO: 48841 - DNA, 28 bp, Homo sapiens
ctgggtcggtcgggctggggcgcgaagc

SEQ ID NO: 48842 - DNA, 29 bp, Homo sapiens
ctgggtcggtcgggctggggcgcgaagcg

SEQ ID NO: 48843 - DNA, 30 bp, Homo sapiens
ctgggtcggtcgggctggggcgcgaagcgg

SEQ ID NO: 48844 - DNA, 16 bp, Homo sapiens
tgggtcggtcgggctg

SEQ ID NO: 48845 - DNA, 17 bp, Homo sapiens
tgggtcggtcgggctgg

SEQ ID NO: 48846 - DNA, 18 bp, Homo sapiens
tgggtcggtcgggctggg

SEQ ID NO: 48847 - DNA, 19 bp, Homo sapiens
tgggtcggtcgggctgggg

SEQ ID NO: 48848 - DNA, 20 bp, Homo sapiens
tgggtcggtcgggctggggc

SEQ ID NO: 48849 - DNA, 21 bp, Homo sapiens
tgggtcggtcgggctggggcg

SEQ ID NO: 48850 - DNA, 22 bp, Homo sapiens
tgggtcggtcgggctggggcgc

SEQ ID NO: 48851 - DNA, 23 bp, Homo sapiens
tgggtcggtcgggctggggcgcg

SEQ ID NO: 48852 - DNA, 24 bp, Homo sapiens
tgggtcggtcgggctggggcgcga

SEQ ID NO: 48853 - DNA, 25 bp, Homo sapiens
tgggtcggtcgggctggggcgcgaa

SEQ ID NO: 48854 - DNA, 26 bp, Homo sapiens
tgggtcggtcgggctggggcgcgaag

SEQ ID NO: 48855 - DNA, 27 bp, Homo sapiens
tgggtcggtcgggctggggcgcgaagc

SEQ ID NO: 48856 - DNA, 28 bp, Homo sapiens
tgggtcggtcgggctggggcgcgaagcg

SEQ ID NO: 48857 - DNA, 29 bp, Homo sapiens
tgggtcggtcgggctggggcgcgaagcgg

SEQ ID NO: 48858 - DNA, 30 bp, Homo sapiens
tgggtcggtcgggctggggcgcgaagcggg

SEQ ID NO: 48859 - DNA, 16 bp, Homo sapiens
gggtcggtcgggctgg

SEQ ID NO: 48860 - DNA, 17 bp, Homo sapiens
gggtcggtcgggctggg

SEQ ID NO: 48861 - DNA, 18 bp, Homo sapiens
gggtcggtcgggctgggg

SEQ ID NO: 48862 - DNA, 19 bp, Homo sapiens
gggtcggtcgggctggggc

SEQ ID NO: 48863 - DNA, 20 bp, Homo sapiens
gggtcggtcgggctggggcg

SEQ ID NO: 48864 - DNA, 21 bp, Homo sapiens
gggtcggtcgggctggggcgc

SEQ ID NO: 48865 - DNA, 22 bp, Homo sapiens
gggtcggtcgggctggggcgcg

SEQ ID NO: 48866 - DNA, 23 bp, Homo sapiens
gggtcggtcgggctggggcgcga

SEQ ID NO: 48867 - DNA, 24 bp, Homo sapiens
gggtcggtcgggctggggcgcgaa

SEQ ID NO: 48868 - DNA, 25 bp, Homo sapiens
gggtcggtcgggctggggcgcgaag

SEQ ID NO: 48869 - DNA, 26 bp, Homo sapiens
gggtcggtcgggctggggcgcgaagc

SEQ ID NO: 48870 - DNA, 27 bp, Homo sapiens
gggtcggtcgggctggggcgcgaagcg

SEQ ID NO: 48871 - DNA, 28 bp, Homo sapiens
gggtcggtcgggctggggcgcgaagcgg

SEQ ID NO: 48872 - DNA, 29 bp, Homo sapiens
gggtcggtcgggctggggcgcgaagcggg

SEQ ID NO: 48873 - DNA, 30 bp, Homo sapiens; identical to SEQ ID NO: 30235

SEQ ID NO: 48874 - DNA, 16 bp, Homo sapiens
ggtcggtcgggctggg

SEQ ID NO: 48875 - DNA, 17 bp, Homo sapiens
ggtcggtcgggctgggg

SEQ ID NO: 48876 - DNA, 18 bp, Homo sapiens
ggtcggtcgggctggggc

SEQ ID NO: 48877 - DNA, 19 bp, Homo sapiens
ggtcggtcgggctggggcg

SEQ ID NO: 48878 - DNA, 20 bp, Homo sapiens
ggtcggtcgggctggggcgc

SEQ ID NO: 48879 - DNA, 21 bp, Homo sapiens
ggtcggtcgggctggggcgcg

SEQ ID NO: 48880 - DNA, 22 bp, Homo sapiens
ggtcggtcgggctggggcgcga

SEQ ID NO: 48881 - DNA, 23 bp, Homo sapiens
ggtcggtcgggctggggcgcgaa

SEQ ID NO: 48882 - DNA, 24 bp, Homo sapiens
ggtcggtcgggctggggcgcgaag

SEQ ID NO: 48883 - DNA, 25 bp, Homo sapiens
ggtcggtcgggctggggcgcgaagc

SEQ ID NO: 48884 - DNA, 26 bp, Homo sapiens
ggtcggtcgggctggggcgcgaagcg

SEQ ID NO: 48885 - DNA, 27 bp, Homo sapiens
ggtcggtcgggctggggcgcgaagcgg

SEQ ID NO: 48886 - DNA, 28 bp, Homo sapiens
ggtcggtcgggctggggcgcgaagcggg

SEQ ID NO: 48887 - DNA, 29 bp, Homo sapiens
ggtcggtcgggctggggcgcgaagcgggg

SEQ ID NO: 48888 - DNA, 30 bp, Homo sapiens
ggtcggtcgggctggggcgcgaagcggggc

SEQ ID NO: 48889 - DNA, 16 bp, Homo sapiens
gtcggtcgggctgggg

SEQ ID NO: 48890 - DNA, 17 bp, Homo sapiens
gtcggtcgggctggggc

SEQ ID NO: 48891 - DNA, 18 bp, Homo sapiens
gtcggtcgggctggggcg

SEQ ID NO: 48892 - DNA, 19 bp, Homo sapiens
gtcggtcgggctggggcgc

SEQ ID NO: 48893 - DNA, 20 bp, Homo sapiens
gtcggtcgggctggggcgcg

SEQ ID NO: 48894 - DNA, 21 bp, Homo sapiens
gtcggtcgggctggggcgcga

SEQ ID NO: 48895 - DNA, 22 bp, Homo sapiens
gtcggtcgggctggggcgcgaa

SEQ ID NO: 48896 - DNA, 23 bp, Homo sapiens
gtcggtcgggctggggcgcgaag

SEQ ID NO: 48897 - DNA, 24 bp, Homo sapiens
gtcggtcgggctggggcgcgaagc

SEQ ID NO: 48898 - DNA, 25 bp, Homo sapiens
gtcggtcgggctggggcgcgaagcg

SEQ ID NO: 48899 - DNA, 26 bp, Homo sapiens
gtcggtcgggctggggcgcgaagcgg

SEQ ID NO: 48900 - DNA, 27 bp, Homo sapiens
gtcggtcgggctggggcgcgaagcggg

SEQ ID NO: 48901 - DNA, 28 bp, Homo sapiens
gtcggtcgggctggggcgcgaagcgggg

SEQ ID NO: 48902 - DNA, 29 bp, Homo sapiens
gtcggtcgggctggggcgcgaagcggggc

SEQ ID NO: 48903 - DNA, 30 bp, Homo sapiens; identical to SEQ ID NO: 5227

SEQ ID NO: 48904 - DNA, 16 bp, Homo sapiens
tcggtcgggctggggc

SEQ ID NO: 48905 - DNA, 17 bp, Homo sapiens
tcggtcgggctggggcg

SEQ ID NO: 48906 - DNA, 18 bp, Homo sapiens
tcggtcgggctggggcgc

SEQ ID NO: 48907 - DNA, 19 bp, Homo sapiens
tcggtcgggctggggcgcg

SEQ ID NO: 48908 - DNA, 20 bp, Homo sapiens
tcggtcgggctggggcgcga

SEQ ID NO: 48909 - DNA, 21 bp, Homo sapiens
tcggtcgggctggggcgcgaa

SEQ ID NO: 48910 - DNA, 22 bp, Homo sapiens
tcggtcgggctggggcgcgaag

SEQ ID NO: 48911 - DNA, 23 bp, Homo sapiens
tcggtcgggctggggcgcgaagc

SEQ ID NO: 48912 - DNA, 24 bp, Homo sapiens
tcggtcgggctggggcgcgaagcg

SEQ ID NO: 48913 - DNA, 25 bp, Homo sapiens
tcggtcgggctggggcgcgaagcgg

SEQ ID NO: 48914 - DNA, 26 bp, Homo sapiens
tcggtcgggctggggcgcgaagcggg

SEQ ID NO: 48915 - DNA, 27 bp, Homo sapiens
tcggtcgggctggggcgcgaagcgggg

SEQ ID NO: 48916 - DNA, 28 bp, Homo sapiens
tcggtcgggctggggcgcgaagcggggc

SEQ ID NO: 48917 - DNA, 29 bp, Homo sapiens
tcggtcgggctggggcgcgaagcggggct

SEQ ID NO: 48918 - DNA, 30 bp, Homo sapiens
tcggtcgggctggggcgcgaagcggggctg

SEQ ID NO: 48919 - DNA, 16 bp, Homo sapiens
cggtcgggctggggcg

SEQ ID NO: 48920 - DNA, 17 bp, Homo sapiens
cggtcgggctggggcgc

SEQ ID NO: 48921 - DNA, 18 bp, Homo sapiens
cggtcgggctggggcgcg

SEQ ID NO: 48922 - DNA, 19 bp, Homo sapiens
cggtcgggctggggcgcga

SEQ ID NO: 48923 - DNA, 20 bp, Homo sapiens
cggtcgggctggggcgcgaa

SEQ ID NO: 48924 - DNA, 21 bp, Homo sapiens
cggtcgggctggggcgcgaag

SEQ ID NO: 48925 - DNA, 22 bp, Homo sapiens
cggtcgggctggggcgcgaagc

SEQ ID NO: 48926 - DNA, 23 bp, Homo sapiens
cggtcgggctggggcgcgaagcg

SEQ ID NO: 48927 - DNA, 24 bp, Homo sapiens
cggtcgggctggggcgcgaagcgg

SEQ ID NO: 48928 - DNA, 25 bp, Homo sapiens
cggtcgggctggggcgcgaagcggg

SEQ ID NO: 48929 - DNA, 26 bp, Homo sapiens
cggtcgggctggggcgcgaagcgggg

SEQ ID NO: 48930 - DNA, 27 bp, Homo sapiens
cggtcgggctggggcgcgaagcggggc

SEQ ID NO: 48931 - DNA, 28 bp, Homo sapiens
cggtcgggctggggcgcgaagcggggct

SEQ ID NO: 48932 - DNA, 29 bp, Homo sapiens
cggtcgggctggggcgcgaagcggggctg

SEQ ID NO: 48933 - DNA, 30 bp, Homo sapiens
cggtcgggctggggcgcgaagcggggctgg

SEQ ID NO: 48934 - DNA, 16 bp, Homo sapiens
ggtcgggctggggcgc

SEQ ID NO: 48935 - DNA, 17 bp, Homo sapiens
ggtcgggctggggcgcg

SEQ ID NO: 48936 - DNA, 18 bp, Homo sapiens
ggtcgggctggggcgcga

SEQ ID NO: 48937 - DNA, 19 bp, Homo sapiens
ggtcgggctggggcgcgaa

SEQ ID NO: 48938 - DNA, 20 bp, Homo sapiens
ggtcgggctggggcgcgaag

SEQ ID NO: 48939 - DNA, 21 bp, Homo sapiens
ggtcgggctggggcgcgaagc

SEQ ID NO: 48940 - DNA, 22 bp, Homo sapiens
ggtcgggctggggcgcgaagcg

SEQ ID NO: 48941 - DNA, 23 bp, Homo sapiens
ggtcgggctggggcgcgaagcgg

SEQ ID NO: 48942 - DNA, 24 bp, Homo sapiens
ggtcgggctggggcgcgaagcggg

SEQ ID NO: 48943 - DNA, 25 bp, Homo sapiens
ggtcgggctggggcgcgaagcgggg

SEQ ID NO: 48944 - DNA, 26 bp, Homo sapiens
ggtcgggctggggcgcgaagcggggc

SEQ ID NO: 48945 - DNA, 27 bp, Homo sapiens
ggtcgggctggggcgcgaagcggggct

SEQ ID NO: 48946 - DNA, 28 bp, Homo sapiens
ggtcgggctggggcgcgaagcggggctg

SEQ ID NO: 48947 - DNA, 29 bp, Homo sapiens
ggtcgggctggggcgcgaagcggggctgg

SEQ ID NO: 48948 - DNA, 16 bp, Homo sapiens
gtcgggctggggcgcg

SEQ ID NO: 48949 - DNA, 17 bp, Homo sapiens
gtcgggctggggcgcga

SEQ ID NO: 48950 - DNA, 19 bp, Homo sapiens
gtcgggctggggcgcgaag

SEQ ID NO: 48951 - DNA, 20 bp, Homo sapiens
gtcgggctggggcgcgaagc

SEQ ID NO: 48952 - DNA, 21 bp, Homo sapiens
gtcgggctggggcgcgaagcg

SEQ ID NO: 48953 - DNA, 22 bp, Homo sapiens
gtcgggctggggcgcgaagcgg

SEQ ID NO: 48954 - DNA, 23 bp, Homo sapiens
gtcgggctggggcgcgaagcggg

SEQ ID NO: 48955 - DNA, 24 bp, Homo sapiens
gtcgggctggggcgcgaagcgggg

SEQ ID NO: 48956 - DNA, 25 bp, Homo sapiens
gtcgggctggggcgcgaagcggggc

SEQ ID NO: 48957 - DNA, 26 bp, Homo sapiens
gtcgggctggggcgcgaagcggggct

SEQ ID NO: 48958 - DNA, 27 bp, Homo sapiens
gtcgggctggggcgcgaagcggggctg

SEQ ID NO: 48959 - DNA, 19 bp, Homo sapiens
tcgggctggggcgcgaagc

SEQ ID NO: 48960 - DNA, 20 bp, Homo sapiens
tcgggctggggcgcgaagcg

SEQ ID NO: 48961 - DNA, 21 bp, Homo sapiens
tcgggctggggcgcgaagcgg

SEQ ID NO: 48962 - DNA, 22 bp, Homo sapiens
tcgggctggggcgcgaagcggg

SEQ ID NO: 48963 - DNA, 23 bp, Homo sapiens
tcgggctggggcgcgaagcgggg

SEQ ID NO: 48964 - DNA, 24 bp, Homo sapiens
tcgggctggggcgcgaagcggggc

SEQ ID NO: 48965 - DNA, 19 bp, Homo sapiens
cgggctggggcgcgaagcg

SEQ ID NO: 48966 - DNA, 20 bp, Homo sapiens
cgggctggggcgcgaagcgg

SEQ ID NO: 48967 - DNA, 21 bp, Homo sapiens
cgggctggggcgcgaagcggg

SEQ ID NO: 48968 - DNA, 22 bp, Homo sapiens
cgggctggggcgcgaagcgggg

SEQ ID NO: 48969 - DNA, 23 bp, Homo sapiens
cgggctggggcgcgaagcggggc

SEQ ID NO: 48970 - DNA, 18 bp, Homo sapiens
gggctggggcgcgaagcg

SEQ ID NO: 48971 - DNA, 19 bp, Homo sapiens
gggctggggcgcgaagcgg

SEQ ID NO: 48972 - DNA, 20 bp, Homo sapiens
gggctggggcgcgaagcggg

SEQ ID NO: 48973 - DNA, 21 bp, Homo sapiens
gggctggggcgcgaagcgggg

SEQ ID NO: 48974 - DNA, 22 bp, Homo sapiens
gggctggggcgcgaagcggggc

SEQ ID NO: 48975 - DNA, 23 bp, Homo sapiens
gggctggggcgcgaagcggggct

SEQ ID NO: 48976 - DNA, 17 bp, Homo sapiens
ggctggggcgcgaagcg

SEQ ID NO: 48977 - DNA, 18 bp, Homo sapiens
ggctggggcgcgaagcgg

SEQ ID NO: 48978 - DNA, 19 bp, Homo sapiens
ggctggggcgcgaagcggg

SEQ ID NO: 48979 - DNA, 20 bp, Homo sapiens
ggctggggcgcgaagcgggg

SEQ ID NO: 48980 - DNA, 21 bp, Homo sapiens
ggctggggcgcgaagcggggc

SEQ ID NO: 48981 - DNA, 22 bp, Homo sapiens
ggctggggcgcgaagcggggct

SEQ ID NO: 48982 - DNA, 17 bp, Homo sapiens
gctggggcgcgaagcgg

SEQ ID NO: 48983 - DNA, 18 bp, Homo sapiens
gctggggcgcgaagcggg

SEQ ID NO: 48984 - DNA, 19 bp, Homo sapiens
gctggggcgcgaagcgggg

SEQ ID NO: 48985 - DNA, 20 bp, Homo sapiens
gctggggcgcgaagcggggc

SEQ ID NO: 48986 - DNA, 21 bp, Homo sapiens
gctggggcgcgaagcggggct

SEQ ID NO: 48987 - DNA, 22 bp, Homo sapiens
gctggggcgcgaagcggggctg

SEQ ID NO: 48988 - DNA, 23 bp, Homo sapiens
gctggggcgcgaagcggggctgg

SEQ ID NO: 48989 - DNA, 25 bp, Homo sapiens
gctggggcgcgaagcggggctgggc

SEQ ID NO: 48990 - DNA, 16 bp, Homo sapiens
ctggggcgcgaagcgg

SEQ ID NO: 48991 - DNA, 17 bp, Homo sapiens
ctggggcgcgaagcggg

SEQ ID NO: 48992 - DNA, 18 bp, Homo sapiens
ctggggcgcgaagcgggg

SEQ ID NO: 48993 - DNA, 19 bp, Homo sapiens
ctggggcgcgaagcggggc

SEQ ID NO: 48994 - DNA, 20 bp, Homo sapiens
ctggggcgcgaagcggggct

SEQ ID NO: 48995 - DNA, 21 bp, Homo sapiens
ctggggcgcgaagcggggctg

SEQ ID NO: 48996 - DNA, 22 bp, Homo sapiens
ctggggcgcgaagcggggctgg

SEQ ID NO: 48997 - DNA, 23 bp, Homo sapiens
ctggggcgcgaagcggggctggg

SEQ ID NO: 48998 - DNA, 24 bp, Homo sapiens
ctggggcgcgaagcggggctgggc

SEQ ID NO: 48999 - DNA, 17 bp, Homo sapiens
tggggcgcgaagcgggg

SEQ ID NO: 49000 - DNA, 18 bp, Homo sapiens
tggggcgcgaagcggggc

SEQ ID NO: 49001 - DNA, 19 bp, Homo sapiens
tggggcgcgaagcggggct

SEQ ID NO: 49002 - DNA, 21 bp, Homo sapiens
tggggcgcgaagcggggctgg

SEQ ID NO: 49003 - DNA, 23 bp, Homo sapiens
tggggcgcgaagcggggctgggc

SEQ ID NO: 49004 - DNA, 16 bp, Homo sapiens
ggggcgcgaagcgggg

SEQ ID NO: 49005 - DNA, 17 bp, Homo sapiens
ggggcgcgaagcggggc

SEQ ID NO: 49006 - DNA, 18 bp, Homo sapiens
ggggcgcgaagcggggct

SEQ ID NO: 49007 - DNA, 19 bp, Homo sapiens
ggggcgcgaagcggggctg

SEQ ID NO: 49008 - DNA, 20 bp, Homo sapiens
ggggcgcgaagcggggctgg

SEQ ID NO: 49009 - DNA, 21 bp, Homo sapiens
ggggcgcgaagcggggctggg

SEQ ID NO: 49010 - DNA, 22 bp, Homo sapiens
ggggcgcgaagcggggctgggc

SEQ ID NO: 49011 - DNA, 16 bp, Homo sapiens
gggcgcgaagcggggc

SEQ ID NO: 49012 - DNA, 17 bp, Homo sapiens
gggcgcgaagcggggct

SEQ ID NO: 49013 - DNA, 18 bp, Homo sapiens
gggcgcgaagcggggctg

SEQ ID NO: 49014 - DNA, 19 bp, Homo sapiens
gggcgcgaagcggggctgg

SEQ ID NO: 49015 - DNA, 20 bp, Homo sapiens
gggcgcgaagcggggctggg

SEQ ID NO: 49016 - DNA, 21 bp, Homo sapiens
gggcgcgaagcggggctgggc

SEQ ID NO: 49017 - DNA, 22 bp, Homo sapiens
gggcgcgaagcggggctgggcg

SEQ ID NO: 49018 - DNA, 23 bp, Homo sapiens
gggcgcgaagcggggctgggcgc

SEQ ID NO: 49019 - DNA, 16 bp, Homo sapiens
ggcgcgaagcggggct

SEQ ID NO: 49020 - DNA, 17 bp, Homo sapiens
ggcgcgaagcggggctg

SEQ ID NO: 49021 - DNA, 18 bp, Homo sapiens
ggcgcgaagcggggctgg

SEQ ID NO: 49022 - DNA, 19 bp, Homo sapiens
ggcgcgaagcggggctggg

SEQ ID NO: 49023 - DNA, 20 bp, Homo sapiens
ggcgcgaagcggggctgggc

SEQ ID NO: 49024 - DNA, 21 bp, Homo sapiens
ggcgcgaagcggggctgggcg

SEQ ID NO: 49025 - DNA, 22 bp, Homo sapiens
ggcgcgaagcggggctgggcgc

SEQ ID NO: 49026 - DNA, 23 bp, Homo sapiens
ggcgcgaagcggggctgggcgcg

SEQ ID NO: 49027 - DNA, 24 bp, Homo sapiens
ggcgcgaagcggggctgggcgcgc

SEQ ID NO: 49028 - DNA, 25 bp, Homo sapiens
ggcgcgaagcggggctgggcgcgcg

SEQ ID NO: 49029 - DNA, 26 bp, Homo sapiens
ggcgcgaagcggggctgggcgcgcgc

SEQ ID NO: 49030 - DNA, 27 bp, Homo sapiens
ggcgcgaagcggggctgggcgcgcgcc

SEQ ID NO: 49031 - DNA, 30 bp, Homo sapiens
ggcgcgaagcggggctgggcgcgcgccgcg

SEQ ID NO: 49032 - DNA, 16 bp, Homo sapiens
gcgcgaagcggggctg

SEQ ID NO: 49033 - DNA, 17 bp, Homo sapiens
gcgcgaagcggggctgg

SEQ ID NO: 49034 - DNA, 18 bp, Homo sapiens
gcgcgaagcggggctggg

SEQ ID NO: 49035 - DNA, 19 bp, Homo sapiens
gcgcgaagcggggctgggc

SEQ ID NO: 49036 - DNA, 20 bp, Homo sapiens
gcgcgaagcggggctgggcg

SEQ ID NO: 49037 - DNA, 16 bp, Homo sapiens
cgcgaagcggggctgg

SEQ ID NO: 49038 - DNA, 17 bp, Homo sapiens
cgcgaagcggggctggg

SEQ ID NO: 49039 - DNA, 16 bp, Homo sapiens
gcgaagcggggctggg

SEQ ID NO: 49040 - DNA, 20 bp, Homo sapiens
cggggctgggcgcgcgccgc

SEQ ID NO: 49041 - DNA, 21 bp, Homo sapiens
cggggctgggcgcgcgccgcg

SEQ ID NO: 49042 - DNA, 20 bp, Homo sapiens
ggggctgggcgcgcgccgcg

SEQ ID NO: 49043 - DNA, 21 bp, Homo sapiens
ggggctgggcgcgcgccgcgg

SEQ ID NO: 49044 - DNA, 22 bp, Homo sapiens
ggggctgggcgcgcgccgcggc

SEQ ID NO: 49045 - DNA, 19 bp, Homo sapiens
gggctgggcgcgcgccgcg

SEQ ID NO: 49046 - DNA, 21 bp, Homo sapiens
gggctgggcgcgcgccgcggc

SEQ ID NO: 49047 - DNA, 18 bp, Homo sapiens
ggctgggcgcgcgccgcg

SEQ ID NO: 49048 - DNA, 19 bp, Homo sapiens
ggctgggcgcgcgccgcgg

SEQ ID NO: 49049 - DNA, 20 bp, Homo sapiens
ggctgggcgcgcgccgcggc

SEQ ID NO: 49050 - DNA, 18 bp, Homo sapiens
gctgggcgcgcgccgcgg

SEQ ID NO: 49051 - DNA, 19 bp, Homo sapiens
gctgggcgcgcgccgcggc

SEQ ID NO: 49052 - DNA, 27 bp, Homo sapiens
gctgggcgcgcgccgcggctggacgag

SEQ ID NO: 49053 - DNA, 18 bp, Homo sapiens
ctgggcgcgcgccgcggc

SEQ ID NO: 49054 - DNA, 21 bp, Homo sapiens
ctgggcgcgcgccgcggctgg

SEQ ID NO: 49055 - DNA, 23 bp, Homo sapiens
ctgggcgcgcgccgcggctggac

SEQ ID NO: 49056 - DNA, 24 bp, Homo sapiens
ctgggcgcgcgccgcggctggacg

SEQ ID NO: 49057 - DNA, 26 bp, Homo sapiens
ctgggcgcgcgccgcggctggacgag

SEQ ID NO: 49058 - DNA, 28 bp, Homo sapiens
ctgggcgcgcgccgcggctggacgaggc

SEQ ID NO: 49059 - DNA, 17 bp, Homo sapiens
tgggcgcgcgccgcggc

SEQ ID NO: 49060 - DNA, 21 bp, Homo sapiens
tgggcgcgcgccgcggctgga

SEQ ID NO: 49061 - DNA, 22 bp, Homo sapiens
tgggcgcgcgccgcggctggac

SEQ ID NO: 49062 - DNA, 23 bp, Homo sapiens
tgggcgcgcgccgcggctggacg

SEQ ID NO: 49063 - DNA, 24 bp, Homo sapiens
tgggcgcgcgccgcggctggacga

SEQ ID NO: 49064 - DNA, 25 bp, Homo sapiens
tgggcgcgcgccgcggctggacgag

SEQ ID NO: 49065 - DNA, 16 bp, Homo sapiens
gggcgcgcgccgcggc

SEQ ID NO: 49066 - DNA, 17 bp, Homo sapiens
gggcgcgcgccgcggct

SEQ ID NO: 49067 - DNA, 18 bp, Homo sapiens
gggcgcgcgccgcggctg

SEQ ID NO: 49068 - DNA, 19 bp, Homo sapiens
gggcgcgcgccgcggctgg

SEQ ID NO: 49069 - DNA, 20 bp, Homo sapiens
gggcgcgcgccgcggctgga

SEQ ID NO: 49070 - DNA, 21 bp, Homo sapiens
gggcgcgcgccgcggctggac

SEQ ID NO: 49071 - DNA, 22 bp, Homo sapiens
gggcgcgcgccgcggctggacg

SEQ ID NO: 49072 - DNA, 23 bp, Homo sapiens
gggcgcgcgccgcggctggacga

SEQ ID NO: 49073 - DNA, 24 bp, Homo sapiens
gggcgcgcgccgcggctggacgag

SEQ ID NO: 49074 - DNA, 25 bp, Homo sapiens
gggcgcgcgccgcggctggacgagg

SEQ ID NO: 49075 - DNA, 26 bp, Homo sapiens
gggcgcgcgccgcggctggacgaggc

SEQ ID NO: 49076 - DNA, 27 bp, Homo sapiens
gggcgcgcgccgcggctggacgaggcg

SEQ ID NO: 49077 - DNA, 28 bp, Homo sapiens
gggcgcgcgccgcggctggacgaggcgc

SEQ ID NO: 49078 - DNA, 29 bp, Homo sapiens
gggcgcgcgccgcggctggacgaggcgcc

SEQ ID NO: 49079 - DNA, 30 bp, Homo sapiens; identical to SEQ ID NO: 23994

SEQ ID NO: 49080 - DNA, 16 bp, Homo sapiens
ggcgcgcgccgcggct

SEQ ID NO: 49081 - DNA, 17 bp, Homo sapiens
ggcgcgcgccgcggctg

SEQ ID NO: 49082 - DNA, 18 bp, Homo sapiens
ggcgcgcgccgcggctgg

SEQ ID NO: 49083 - DNA, 19 bp, Homo sapiens
ggcgcgcgccgcggctgga

SEQ ID NO: 49084 - DNA, 20 bp, Homo sapiens
ggcgcgcgccgcggctggac

SEQ ID NO: 49085 - DNA, 21 bp, Homo sapiens
ggcgcgcgccgcggctggacg

SEQ ID NO: 49086 - DNA, 22 bp, Homo sapiens
ggcgcgcgccgcggctggacga

SEQ ID NO: 49087 - DNA, 23 bp, Homo sapiens
ggcgcgcgccgcggctggacgag

SEQ ID NO: 49088 - DNA, 24 bp, Homo sapiens
ggcgcgcgccgcggctggacgagg

SEQ ID NO: 49089 - DNA, 25 bp, Homo sapiens
ggcgcgcgccgcggctggacgaggc

SEQ ID NO: 49090 - DNA, 26 bp, Homo sapiens
ggcgcgcgccgcggctggacgaggcg

SEQ ID NO: 49091 - DNA, 27 bp, Homo sapiens
ggcgcgcgccgcggctggacgaggcgc

SEQ ID NO: 49092 - DNA, 28 bp, Homo sapiens
ggcgcgcgccgcggctggacgaggcgcc

SEQ ID NO: 49093 - DNA, 29 bp, Homo sapiens
ggcgcgcgccgcggctggacgaggcgccg

SEQ ID NO: 49094 - DNA, 17 bp, Homo sapiens
gcgcgcgccgcggctgg

SEQ ID NO: 49095 - DNA, 18 bp, Homo sapiens
gcgcgcgccgcggctgga

SEQ ID NO: 49096 - DNA, 19 bp, Homo sapiens
gcgcgcgccgcggctggac

SEQ ID NO: 49097 - DNA, 20 bp, Homo sapiens
gcgcgcgccgcggctggacg

SEQ ID NO: 49098 - DNA, 21 bp, Homo sapiens
gcgcgcgccgcggctggacga

SEQ ID NO: 49099 - DNA, 22 bp, Homo sapiens
gcgcgcgccgcggctggacgag

SEQ ID NO: 49100 - DNA, 23 bp, Homo sapiens
gcgcgcgccgcggctggacgagg

SEQ ID NO: 49101 - DNA, 17 bp, Homo sapiens
cgcgcgccgcggctgga

SEQ ID NO: 49102 - DNA, 18 bp, Homo sapiens
cgcgcgccgcggctggac

SEQ ID NO: 49103 - DNA, 19 bp, Homo sapiens
cgcgcgccgcggctggacg

SEQ ID NO: 49104 - DNA, 20 bp, Homo sapiens
cgcgcgccgcggctggacga

SEQ ID NO: 49105 - DNA, 21 bp, Homo sapiens
cgcgcgccgcggctggacgag

SEQ ID NO: 49106 - DNA, 22 bp, Homo sapiens
cgcgcgccgcggctggacgagg

SEQ ID NO: 49107 - DNA, 18 bp, Homo sapiens
gcgcgccgcggctggacg

SEQ ID NO: 49108 - DNA, 19 bp, Homo sapiens
gcgcgccgcggctggacga

SEQ ID NO: 49109 - DNA, 20 bp, Homo sapiens
gcgcgccgcggctggacgag

SEQ ID NO: 49110 - DNA, 22 bp, Homo sapiens
gcgcgccgcggctggacgaggc

SEQ ID NO: 49111 - DNA, 17 bp, Homo sapiens
cgcgccgcggctggacg

SEQ ID NO: 49112 - DNA, 18 bp, Homo sapiens
cgcgccgcggctggacga

SEQ ID NO: 49113 - DNA, 19 bp, Homo sapiens
cgcgccgcggctggacgag

SEQ ID NO: 49114 - DNA, 20 bp, Homo sapiens
cgcgccgcggctggacgagg

SEQ ID NO: 49115 - DNA, 16 bp, Homo sapiens
gcgccgcggctggacg

SEQ ID NO: 49116 - DNA, 17 bp, Homo sapiens
gcgccgcggctggacga

SEQ ID NO: 49117 - DNA, 18 bp, Homo sapiens
gcgccgcggctggacgag

SEQ ID NO: 49118 - DNA, 16 bp, Homo sapiens
cgccgcggctggacga

SEQ ID NO: 49119 - DNA, 17 bp, Homo sapiens
cgccgcggctggacgag

SEQ ID NO: 49120 - DNA, 21 bp, Homo sapiens
cgcggctggacgaggcgccgc

SEQ ID NO: 49121 - DNA, 23 bp, Homo sapiens
cgcggctggacgaggcgccgccg

SEQ ID NO: 49122 - DNA, 24 bp, Homo sapiens
cgcggctggacgaggcgccgccgc

SEQ ID NO: 49123 - DNA, 16 bp, Homo sapiens
gcggctggacgaggcg

SEQ ID NO: 49124 - DNA, 17 bp, Homo sapiens
gcggctggacgaggcgc

SEQ ID NO: 49125 - DNA, 18 bp, Homo sapiens
gcggctggacgaggcgcc

SEQ ID NO: 49126 - DNA, 19 bp, Homo sapiens
gcggctggacgaggcgccg

SEQ ID NO: 49127 - DNA, 20 bp, Homo sapiens
gcggctggacgaggcgccgc

SEQ ID NO: 49128 - DNA, 21 bp, Homo sapiens
gcggctggacgaggcgccgcc

SEQ ID NO: 49129 - DNA, 30 bp, Homo sapiens
gcggctggacgaggcgccgccgcccccccc

SEQ ID NO: 49130 - DNA, 16 bp, Homo sapiens
cggctggacgaggcgc

SEQ ID NO: 49131 - DNA, 17 bp, Homo sapiens
cggctggacgaggcgcc

SEQ ID NO: 49132 - DNA, 18 bp, Homo sapiens
cggctggacgaggcgccg

SEQ ID NO: 49133 - DNA, 19 bp, Homo sapiens
cggctggacgaggcgccgc

SEQ ID NO: 49134 - DNA, 20 bp, Homo sapiens
cggctggacgaggcgccgcc

SEQ ID NO: 49135 - DNA, 21 bp, Homo sapiens
cggctggacgaggcgccgccg

SEQ ID NO: 49136 - DNA, 22 bp, Homo sapiens
cggctggacgaggcgccgccgc

SEQ ID NO: 49137 - DNA, 23 bp, Homo sapiens
cggctggacgaggcgccgccgcc

SEQ ID NO: 49138 - DNA, 24 bp, Homo sapiens
cggctggacgaggcgccgccgccc

SEQ ID NO: 49139 - DNA, 25 bp, Homo sapiens
cggctggacgaggcgccgccgcccc

SEQ ID NO: 49140 - DNA, 26 bp, Homo sapiens
cggctggacgaggcgccgccgccccc

SEQ ID NO: 49141 - DNA, 27 bp, Homo sapiens
cggctggacgaggcgccgccgcccccc

SEQ ID NO: 49142 - DNA, 18 bp, Homo sapiens
ggctggacgaggcgccgc

SEQ ID NO: 49143 - DNA, 19 bp, Homo sapiens
ggctggacgaggcgccgcc

SEQ ID NO: 49144 - DNA, 24 bp, Homo sapiens
ggctggacgaggcgccgccgcccc

SEQ ID NO: 49145 - DNA, 16 bp, Homo sapiens
gctggacgaggcgccg

SEQ ID NO: 49146 - DNA, 17 bp, Homo sapiens
gctggacgaggcgccgc

SEQ ID NO: 49147 - DNA, 18 bp, Homo sapiens
gctggacgaggcgccgcc

SEQ ID NO: 49148 - DNA, 19 bp, Homo sapiens
gctggacgaggcgccgccg

SEQ ID NO: 49149 - DNA, 20 bp, Homo sapiens
gctggacgaggcgccgccgc

SEQ ID NO: 49150 - DNA, 21 bp, Homo sapiens
gctggacgaggcgccgccgcc

SEQ ID NO: 49151 - DNA, 22 bp, Homo sapiens
gctggacgaggcgccgccgccc

SEQ ID NO: 49152 - DNA, 23 bp, Homo sapiens
gctggacgaggcgccgccgcccc

SEQ ID NO: 49153 - DNA, 24 bp, Homo sapiens
gctggacgaggcgccgccgccccc

SEQ ID NO: 49154 - DNA, 25 bp, Homo sapiens
gctggacgaggcgccgccgcccccc

SEQ ID NO: 49155 - DNA, 26 bp, Homo sapiens
gctggacgaggcgccgccgccccccc

SEQ ID NO: 49156 - DNA, 27 bp, Homo sapiens
gctggacgaggcgccgccgcccccccc

SEQ ID NO: 49157 - DNA, 29 bp, Homo sapiens
gctggacgaggcgccgccgccccccccac

SEQ ID NO: 49158 - DNA, 30 bp, Homo sapiens
gctggacgaggcgccgccgccccccccacg

SEQ ID NO: 49159 - DNA, 16 bp, Homo sapiens
ctggacgaggcgccgc

SEQ ID NO: 49160 - DNA, 17 bp, Homo sapiens
ctggacgaggcgccgcc

SEQ ID NO: 49161 - DNA, 18 bp, Homo sapiens
ctggacgaggcgccgccg

SEQ ID NO: 49162 - DNA, 19 bp, Homo sapiens
ctggacgaggcgccgccgc

SEQ ID NO: 49163 - DNA, 20 bp, Homo sapiens
ctggacgaggcgccgccgcc

SEQ ID NO: 49164 - DNA, 21 bp, Homo sapiens
ctggacgaggcgccgccgccc

SEQ ID NO: 49165 - DNA, 22 bp, Homo sapiens
ctggacgaggcgccgccgcccc

SEQ ID NO: 49166 - DNA, 23 bp, Homo sapiens
ctggacgaggcgccgccgccccc

SEQ ID NO: 49167 - DNA, 24 bp, Homo sapiens
ctggacgaggcgccgccgcccccc

SEQ ID NO: 49168 - DNA, 25 bp, Homo sapiens
ctggacgaggcgccgccgccccccc

SEQ ID NO: 49169 - DNA, 26 bp, Homo sapiens
ctggacgaggcgccgccgcccccccc

SEQ ID NO: 49170 - DNA, 30 bp, Homo sapiens
ctggacgaggcgccgccgccccccccacgc

SEQ ID NO: 49171 - DNA, 18 bp, Homo sapiens
tggacgaggcgccgccgc

SEQ ID NO: 49172 - DNA, 19 bp, Homo sapiens
tggacgaggcgccgccgcc

SEQ ID NO: 49173 - DNA, 20 bp, Homo sapiens
tggacgaggcgccgccgccc

SEQ ID NO: 49174 - DNA, 21 bp, Homo sapiens
tggacgaggcgccgccgcccc

SEQ ID NO: 49175 - DNA, 22 bp, Homo sapiens
tggacgaggcgccgccgccccc

SEQ ID NO: 49176 - DNA, 23 bp, Homo sapiens
tggacgaggcgccgccgcccccc

SEQ ID NO: 49177 - DNA, 24 bp, Homo sapiens
tggacgaggcgccgccgccccccc

SEQ ID NO: 49178 - DNA, 25 bp, Homo sapiens
tggacgaggcgccgccgcccccccc

SEQ ID NO: 49179 - DNA, 26 bp, Homo sapiens
tggacgaggcgccgccgcccccccca

SEQ ID NO: 49180 - DNA, 28 bp, Homo sapiens
tggacgaggcgccgccgccccccccacg

SEQ ID NO: 49181 - DNA, 29 bp, Homo sapiens
tggacgaggcgccgccgccccccccacgc

SEQ ID NO: 49182 - DNA, 30 bp, Homo sapiens
tggacgaggcgccgccgccccccccacgcc

SEQ ID NO: 49183 - DNA, 16 bp, Homo sapiens
ggacgaggcgccgccg

SEQ ID NO: 49184 - DNA, 17 bp, Homo sapiens
ggacgaggcgccgccgc

SEQ ID NO: 49185 - DNA, 18 bp, Homo sapiens
ggacgaggcgccgccgcc

SEQ ID NO: 49186 - DNA, 19 bp, Homo sapiens
ggacgaggcgccgccgccc

SEQ ID NO: 49187 - DNA, 20 bp, Homo sapiens
ggacgaggcgccgccgcccc

SEQ ID NO: 49188 - DNA, 21 bp, Homo sapiens
ggacgaggcgccgccgccccc

SEQ ID NO: 49189 - DNA, 22 bp, Homo sapiens
ggacgaggcgccgccgcccccc

SEQ ID NO: 49190 - DNA, 23 bp, Homo sapiens
ggacgaggcgccgccgccccccc

SEQ ID NO: 49191 - DNA, 24 bp, Homo sapiens
ggacgaggcgccgccgcccccccc

SEQ ID NO: 49192 - DNA, 27 bp, Homo sapiens
ggacgaggcgccgccgccccccccacg

SEQ ID NO: 49193 - DNA, 28 bp, Homo sapiens
ggacgaggcgccgccgccccccccacgc

SEQ ID NO: 49194 - DNA, 17 bp, Homo sapiens
gacgaggcgccgccgcc

SEQ ID NO: 49195 - DNA, 18 bp, Homo sapiens
gacgaggcgccgccgccc

SEQ ID NO: 49196 - DNA, 19 bp, Homo sapiens
gacgaggcgccgccgcccc

SEQ ID NO: 49197 - DNA, 20 bp, Homo sapiens
gacgaggcgccgccgccccc

SEQ ID NO: 49198 - DNA, 21 bp, Homo sapiens
gacgaggcgccgccgcccccc

SEQ ID NO: 49199 - DNA, 22 bp, Homo sapiens
gacgaggcgccgccgccccccc

SEQ ID NO: 49200 - DNA, 19 bp, Homo sapiens
acgaggcgccgccgccccc

SEQ ID NO: 49201 - DNA, 16 bp, Homo sapiens
gaggcgccgccgcccc

SEQ ID NO: 49202 - DNA, 17 bp, Homo sapiens
gaggcgccgccgccccc

SEQ ID NO: 49203 - DNA, 18 bp, Homo sapiens
gaggcgccgccgcccccc

SEQ ID NO: 49204 - DNA, 19 bp, Homo sapiens
gaggcgccgccgccccccc

SEQ ID NO: 49205 - DNA, 20 bp, Homo sapiens
gaggcgccgccgcccccccc

SEQ ID NO: 49206 - DNA, 23 bp, Homo sapiens
gaggcgccgccgccccccccacg

SEQ ID NO: 49207 - DNA, 16 bp, Homo sapiens
aggcgccgccgccccc

SEQ ID NO: 49208 - DNA, 17 bp, Homo sapiens
aggcgccgccgcccccc

SEQ ID NO: 49209 - DNA, 18 bp, Homo sapiens
aggcgccgccgccccccc

SEQ ID NO: 49210 - DNA, 19 bp, Homo sapiens
aggcgccgccgcccccccc

SEQ ID NO: 49211 - DNA, 21 bp, Homo sapiens
aggcgccgccgccccccccac

SEQ ID NO: 49212 - DNA, 22 bp, Homo sapiens
aggcgccgccgccccccccacg

SEQ ID NO: 49213 - DNA, 23 bp, Homo sapiens
aggcgccgccgccccccccacgc

SEQ ID NO: 49214 - DNA, 24 bp, Homo sapiens
aggcgccgccgccccccccacgcc

SEQ ID NO: 49215 - DNA, 30 bp, Homo sapiens; identical to SEQ ID NO: 24033

SEQ ID NO: 49216 - DNA, 21 bp, Homo sapiens
ggcgccgccgccccccccacg

SEQ ID NO: 49217 - DNA, 16 bp, Homo sapiens
gcgccgccgccccccc

SEQ ID NO: 49218 - DNA, 17 bp, Homo sapiens
gcgccgccgcccccccc

SEQ ID NO: 49219 - DNA, 18 bp, Homo sapiens
gcgccgccgcccccccca

SEQ ID NO: 49220 - DNA, 19 bp, Homo sapiens
gcgccgccgccccccccac

SEQ ID NO: 49221 - DNA, 20 bp, Homo sapiens
gcgccgccgccccccccacg

SEQ ID NO: 49222 - DNA, 21 bp, Homo sapiens
gcgccgccgccccccccacgc

SEQ ID NO: 49223 - DNA, 22 bp, Homo sapiens
gcgccgccgccccccccacgcc

SEQ ID NO: 49224 - DNA, 23 bp, Homo sapiens
gcgccgccgccccccccacgccc

SEQ ID NO: 49225 - DNA, 24 bp, Homo sapiens
gcgccgccgccccccccacgcccg

SEQ ID NO: 49226 - DNA, 28 bp, Homo sapiens
gcgccgccgccccccccacgcccggggc

SEQ ID NO: 49227 - DNA, 29 bp, Homo sapiens
gcgccgccgccccccccacgcccggggca

SEQ ID NO: 49228 - DNA, 16 bp, Homo sapiens
cgccgccgcccccccc

SEQ ID NO: 49229 - DNA, 17 bp, Homo sapiens
cgccgccgcccccccca

SEQ ID NO: 49230 - DNA, 18 bp, Homo sapiens
cgccgccgccccccccac

SEQ ID NO: 49231 - DNA, 25 bp, Homo sapiens
cgccgccgccccccccacgcccggg

SEQ ID NO: 49232 - DNA, 27 bp, Homo sapiens
cgccgccgccccccccacgcccggggc

SEQ ID NO: 49233 - DNA, 17 bp, Homo sapiens
gccgccgccccccccac

SEQ ID NO: 49234 - DNA, 18 bp, Homo sapiens
gccgccgccccccccacg

SEQ ID NO: 49235 - DNA, 24 bp, Homo sapiens
gccgccgccccccccacgcccggg

SEQ ID NO: 49236 - DNA, 26 bp, Homo sapiens
gccgccgccccccccacgcccggggc

SEQ ID NO: 49237 - DNA, 16 bp, Homo sapiens
ccgccgccccccccac

SEQ ID NO: 49238 - DNA, 21 bp, Homo sapiens
ccgccgccccccccacgcccg

SEQ ID NO: 49239 - DNA, 23 bp, Homo sapiens
ccgccgccccccccacgcccggg

SEQ ID NO: 49240 - DNA, 22 bp, Homo sapiens
cgccgccccccccacgcccggg

SEQ ID NO: 49241 - DNA, 23 bp, Homo sapiens
cgccgccccccccacgcccgggg

SEQ ID NO: 49242 - DNA, 23 bp, Homo sapiens
gccgccccccccacgcccggggc

SEQ ID NO: 49243 - DNA, 22 bp, Homo sapiens
ccgccccccccacgcccggggc

SEQ ID NO: 49244 - DNA, 19 bp, Homo sapiens
cgccccccccacgcccggg

SEQ ID NO: 49245 - DNA, 21 bp, Homo sapiens
cgccccccccacgcccggggc

SEQ ID NO: 49246 - DNA, 20 bp, Homo sapiens
gccccccccacgcccggggc

SEQ ID NO: 49247 - DNA, 27 bp, Homo sapiens
ccacgcccggggcacccccctcgcggc

SEQ ID NO: 49248 - DNA, 28 bp, Homo sapiens
ccacgcccggggcacccccctcgcggcc

SEQ ID NO: 49249 - DNA, 24 bp, Homo sapiens
cgcccggggcacccccctcgcggc

SEQ ID NO: 49250 - DNA, 25 bp, Homo sapiens
cgcccggggcacccccctcgcggcc

SEQ ID NO: 49251 - DNA, 23 bp, Homo sapiens
gcccggggcacccccctcgcggc

SEQ ID NO: 49252 - DNA, 24 bp, Homo sapiens
gcccggggcacccccctcgcggcc

SEQ ID NO: 49253 - DNA, 23 bp, Homo sapiens
cccggggcacccccctcgcggcc

SEQ ID NO: 49254 - DNA, 28 bp, Homo sapiens
cccggggcacccccctcgcggccctccc

SEQ ID NO: 49255 - DNA, 21 bp, Homo sapiens
ccggggcacccccctcgcggc

SEQ ID NO: 49256 - DNA, 22 bp, Homo sapiens
ccggggcacccccctcgcggcc

SEQ ID NO: 49257 - DNA, 23 bp, Homo sapiens
ccggggcacccccctcgcggccc

SEQ ID NO: 49258 - DNA, 26 bp, Homo sapiens
ccggggcacccccctcgcggccctcc

SEQ ID NO: 49259 - DNA, 27 bp, Homo sapiens
ccggggcacccccctcgcggccctccc

SEQ ID NO: 49260 - DNA, 30 bp, Homo sapiens
ccggggcacccccctcgcggccctcccccg

SEQ ID NO: 49261 - DNA, 19 bp, Homo sapiens
cggggcacccccctcgcgg

SEQ ID NO: 49262 - DNA, 20 bp, Homo sapiens
cggggcacccccctcgcggc

SEQ ID NO: 49263 - DNA, 21 bp, Homo sapiens
cggggcacccccctcgcggcc

SEQ ID NO: 49264 - DNA, 22 bp, Homo sapiens
cggggcacccccctcgcggccc

SEQ ID NO: 49265 - DNA, 18 bp, Homo sapiens
ggggcacccccctcgcgg

SEQ ID NO: 49266 - DNA, 19 bp, Homo sapiens
ggggcacccccctcgcggc

SEQ ID NO: 49267 - DNA, 20 bp, Homo sapiens
ggggcacccccctcgcggcc

SEQ ID NO: 49268 - DNA, 21 bp, Homo sapiens
ggggcacccccctcgcggccc

SEQ ID NO: 49269 - DNA, 24 bp, Homo sapiens
ggggcacccccctcgcggccctcc

SEQ ID NO: 49270 - DNA, 25 bp, Homo sapiens
ggggcacccccctcgcggccctccc

SEQ ID NO: 49271 - DNA, 26 bp, Homo sapiens
ggggcacccccctcgcggccctcccc

SEQ ID NO: 49272 - DNA, 27 bp, Homo sapiens
ggggcacccccctcgcggccctccccc

SEQ ID NO: 49273 - DNA, 30 bp, Homo sapiens
ggggcacccccctcgcggccctcccccgcc

SEQ ID NO: 49274 - DNA, 16 bp, Homo sapiens
gggcacccccctcgcg

SEQ ID NO: 49275 - DNA, 17 bp, Homo sapiens
gggcacccccctcgcgg

SEQ ID NO: 49276 - DNA, 18 bp, Homo sapiens
gggcacccccctcgcggc

SEQ ID NO: 49277 - DNA, 19 bp, Homo sapiens
gggcacccccctcgcggcc

SEQ ID NO: 49278 - DNA, 20 bp, Homo sapiens
gggcacccccctcgcggccc

SEQ ID NO: 49279 - DNA, 23 bp, Homo sapiens
gggcacccccctcgcggccctcc

SEQ ID NO: 49280 - DNA, 24 bp, Homo sapiens
gggcacccccctcgcggccctccc

SEQ ID NO: 49281 - DNA, 25 bp, Homo sapiens
gggcacccccctcgcggccctcccc

SEQ ID NO: 49282 - DNA, 26 bp, Homo sapiens
gggcacccccctcgcggccctccccc

SEQ ID NO: 49283 - DNA, 27 bp, Homo sapiens
gggcacccccctcgcggccctcccccg

SEQ ID NO: 49284 - DNA, 29 bp, Homo sapiens
gggcacccccctcgcggccctcccccgcc

SEQ ID NO: 49285 - DNA, 30 bp, Homo sapiens
gggcacccccctcgcggccctcccccgccc

SEQ ID NO: 49286 - DNA, 17 bp, Homo sapiens
ggcacccccctcgcggc

SEQ ID NO: 49287 - DNA, 18 bp, Homo sapiens
ggcacccccctcgcggcc

SEQ ID NO: 49288 - DNA, 19 bp, Homo sapiens
ggcacccccctcgcggccc

SEQ ID NO: 49289 - DNA, 22 bp, Homo sapiens
ggcacccccctcgcggccctcc

SEQ ID NO: 49290 - DNA, 23 bp, Homo sapiens
ggcacccccctcgcggccctccc

SEQ ID NO: 49291 - DNA, 24 bp, Homo sapiens
ggcacccccctcgcggccctcccc

SEQ ID NO: 49292 - DNA, 25 bp, Homo sapiens
ggcacccccctcgcggccctccccc

SEQ ID NO: 49293 - DNA, 16 bp, Homo sapiens
gcacccccctcgcggc

SEQ ID NO: 49294 - DNA, 17 bp, Homo sapiens
gcacccccctcgcggcc

SEQ ID NO: 49295 - DNA, 18 bp, Homo sapiens
gcacccccctcgcggccc

SEQ ID NO: 49296 - DNA, 16 bp, Homo sapiens
cacccccctcgcggcc

SEQ ID NO: 49297 - DNA, 19 bp, Homo sapiens
cacccccctcgcggccctc

SEQ ID NO: 49298 - DNA, 20 bp, Homo sapiens
cacccccctcgcggccctcc

SEQ ID NO: 49299 - DNA, 21 bp, Homo sapiens
cacccccctcgcggccctccc

SEQ ID NO: 49300 - DNA, 22 bp, Homo sapiens
cacccccctcgcggccctcccc

SEQ ID NO: 49301 - DNA, 23 bp, Homo sapiens
cacccccctcgcggccctccccc

SEQ ID NO: 49302 - DNA, 19 bp, Homo sapiens
acccccctcgcggccctcc

SEQ ID NO: 49303 - DNA, 20 bp, Homo sapiens
acccccctcgcggccctccc

SEQ ID NO: 49304 - DNA, 17 bp, Homo sapiens
cccccctcgcggccctc

SEQ ID NO: 49305 - DNA, 18 bp, Homo sapiens
cccccctcgcggccctcc

SEQ ID NO: 49306 - DNA, 19 bp, Homo sapiens
cccccctcgcggccctccc

SEQ ID NO: 49307 - DNA, 20 bp, Homo sapiens
cccccctcgcggccctcccc

SEQ ID NO: 49308 - DNA, 21 bp, Homo sapiens
cccccctcgcggccctccccc

SEQ ID NO: 49309 - DNA, 22 bp, Homo sapiens
cccccctcgcggccctcccccg

SEQ ID NO: 49310 - DNA, 23 bp, Homo sapiens
cccccctcgcggccctcccccgc

SEQ ID NO: 49311 - DNA, 24 bp, Homo sapiens
cccccctcgcggccctcccccgcc

SEQ ID NO: 49312 - DNA, 25 bp, Homo sapiens
cccccctcgcggccctcccccgccc

SEQ ID NO: 49313 - DNA, 26 bp, Homo sapiens
cccccctcgcggccctcccccgcccc

SEQ ID NO: 49314 - DNA, 27 bp, Homo sapiens
cccccctcgcggccctcccccgcccca

SEQ ID NO: 49315 - DNA, 29 bp, Homo sapiens
cccccctcgcggccctcccccgccccacc

SEQ ID NO: 49316 - DNA, 30 bp, Homo sapiens
cccccctcgcggccctcccccgccccaccc

SEQ ID NO: 49317 - DNA, 16 bp, Homo sapiens
ccccctcgcggccctc

SEQ ID NO: 49318 - DNA, 17 bp, Homo sapiens
ccccctcgcggccctcc

SEQ ID NO: 49319 - DNA, 18 bp, Homo sapiens
ccccctcgcggccctccc

SEQ ID NO: 49320 - DNA, 19 bp, Homo sapiens
ccccctcgcggccctcccc

SEQ ID NO: 49321 - DNA, 20 bp, Homo sapiens
ccccctcgcggccctccccc

SEQ ID NO: 49322 - DNA, 21 bp, Homo sapiens
ccccctcgcggccctcccccg

SEQ ID NO: 49323 - DNA, 22 bp, Homo sapiens
ccccctcgcggccctcccccgc

SEQ ID NO: 49324 - DNA, 23 bp, Homo sapiens
ccccctcgcggccctcccccgcc

SEQ ID NO: 49325 - DNA, 24 bp, Homo sapiens
ccccctcgcggccctcccccgccc

SEQ ID NO: 49326 - DNA, 25 bp, Homo sapiens
ccccctcgcggccctcccccgcccc

SEQ ID NO: 49327 - DNA, 26 bp, Homo sapiens
ccccctcgcggccctcccccgcccca

SEQ ID NO: 49328 - DNA, 28 bp, Homo sapiens
ccccctcgcggccctcccccgccccacc

SEQ ID NO: 49329 - DNA, 29 bp, Homo sapiens
ccccctcgcggccctcccccgccccaccc

SEQ ID NO: 49330 - DNA, 30 bp, Homo sapiens
ccccctcgcggccctcccccgccccacccc

SEQ ID NO: 49331 - DNA, 16 bp, Homo sapiens
cccctcgcggccctcc

SEQ ID NO: 49332 - DNA, 17 bp, Homo sapiens
cccctcgcggccctccc

SEQ ID NO: 49333 - DNA, 18 bp, Homo sapiens
cccctcgcggccctcccc

SEQ ID NO: 49334 - DNA, 19 bp, Homo sapiens
cccctcgcggccctccccc

SEQ ID NO: 49335 - DNA, 20 bp, Homo sapiens
cccctcgcggccctcccccg

SEQ ID NO: 49336 - DNA, 21 bp, Homo sapiens
cccctcgcggccctcccccgc

SEQ ID NO: 49337 - DNA, 22 bp, Homo sapiens
cccctcgcggccctcccccgcc

SEQ ID NO: 49338 - DNA, 23 bp, Homo sapiens
cccctcgcggccctcccccgccc

SEQ ID NO: 49339 - DNA, 24 bp, Homo sapiens
cccctcgcggccctcccccgcccc

SEQ ID NO: 49340 - DNA, 25 bp, Homo sapiens
cccctcgcggccctcccccgcccca

SEQ ID NO: 49341 - DNA, 26 bp, Homo sapiens
cccctcgcggccctcccccgccccac

SEQ ID NO: 49342 - DNA, 27 bp, Homo sapiens
cccctcgcggccctcccccgccccacc

SEQ ID NO: 49343 - DNA, 28 bp, Homo sapiens
cccctcgcggccctcccccgccccaccc

SEQ ID NO: 49344 - DNA, 30 bp, Homo sapiens
cccctcgcggccctcccccgccccaccccg

SEQ ID NO: 49345 - DNA, 16 bp, Homo sapiens
ccctcgcggccctccc

SEQ ID NO: 49346 - DNA, 17 bp, Homo sapiens
ccctcgcggccctcccc

SEQ ID NO: 49347 - DNA, 18 bp, Homo sapiens
ccctcgcggccctccccc

SEQ ID NO: 49348 - DNA, 19 bp, Homo sapiens
ccctcgcggccctcccccg

SEQ ID NO: 49349 - DNA, 20 bp, Homo sapiens
ccctcgcggccctcccccgc

SEQ ID NO: 49350 - DNA, 21 bp, Homo sapiens
ccctcgcggccctcccccgcc

SEQ ID NO: 49351 - DNA, 22 bp, Homo sapiens
ccctcgcggccctcccccgccc

SEQ ID NO: 49352 - DNA, 23 bp, Homo sapiens
ccctcgcggccctcccccgcccc

SEQ ID NO: 49353 - DNA, 26 bp, Homo sapiens
ccctcgcggccctcccccgccccacc

SEQ ID NO: 49354 - DNA, 27 bp, Homo sapiens
ccctcgcggccctcccccgccccaccc

SEQ ID NO: 49355 - DNA, 30 bp, Homo sapiens
ccctcgcggccctcccccgccccaccccgc

SEQ ID NO: 49356 - DNA, 16 bp, Homo sapiens
cctcgcggccctcccc

SEQ ID NO: 49357 - DNA, 17 bp, Homo sapiens
cctcgcggccctccccc

SEQ ID NO: 49358 - DNA, 18 bp, Homo sapiens
cctcgcggccctcccccg

SEQ ID NO: 49359 - DNA, 19 bp, Homo sapiens
cctcgcggccctcccccgc

SEQ ID NO: 49360 - DNA, 20 bp, Homo sapiens
cctcgcggccctcccccgcc

SEQ ID NO: 49361 - DNA, 21 bp, Homo sapiens
cctcgcggccctcccccgccc

SEQ ID NO: 49362 - DNA, 22 bp, Homo sapiens
cctcgcggccctcccccgcccc

SEQ ID NO: 49363 - DNA, 25 bp, Homo sapiens
cctcgcggccctcccccgccccacc

SEQ ID NO: 49364 - DNA, 26 bp, Homo sapiens
cctcgcggccctcccccgccccaccc

SEQ ID NO: 49365 - DNA, 30 bp, Homo sapiens
cctcgcggccctcccccgccccaccccgcg

SEQ ID NO: 49366 - DNA, 18 bp, Homo sapiens
ctcgcggccctcccccgc

SEQ ID NO: 49367 - DNA, 19 bp, Homo sapiens
ctcgcggccctcccccgcc

SEQ ID NO: 49368 - DNA, 20 bp, Homo sapiens
ctcgcggccctcccccgccc

SEQ ID NO: 49369 - DNA, 21 bp, Homo sapiens
ctcgcggccctcccccgcccc

SEQ ID NO: 49370 - DNA, 24 bp, Homo sapiens
ctcgcggccctcccccgccccacc

SEQ ID NO: 49371 - DNA, 25 bp, Homo sapiens
ctcgcggccctcccccgccccaccc

SEQ ID NO: 49372 - DNA, 22 bp, Homo sapiens
cgcggccctcccccgccccacc

SEQ ID NO: 49373 - DNA, 20 bp, Homo sapiens
ggggtggggcgggggagggc

SEQ ID NO: 49374 - DNA, 22 bp, Homo sapiens
cctcccccgccccaccccgcgc

SEQ ID NO: 49375 - DNA, 20 bp, Homo sapiens
ctcccccgccccaccccgcg

SEQ ID NO: 49376 - DNA, 21 bp, Homo sapiens
ctcccccgccccaccccgcgc

SEQ ID NO: 49377 - DNA, 22 bp, Homo sapiens
ctcccccgccccaccccgcgcg

SEQ ID NO: 49378 - DNA, 23 bp, Homo sapiens
ctcccccgccccaccccgcgcgc

SEQ ID NO: 49379 - DNA, 24 bp, Homo sapiens
ctcccccgccccaccccgcgcgcg

SEQ ID NO: 49380 - DNA, 25 bp, Homo sapiens
ctcccccgccccaccccgcgcgcgc

SEQ ID NO: 49381 - DNA, 26 bp, Homo sapiens
ctcccccgccccaccccgcgcgcgcc

SEQ ID NO: 49382 - DNA, 30 bp, Homo sapiens
ctcccccgccccaccccgcgcgcgccgctc

SEQ ID NO: 49383 - DNA, 18 bp, Homo sapiens
tcccccgccccaccccgc

SEQ ID NO: 49384 - DNA, 19 bp, Homo sapiens
tcccccgccccaccccgcg

SEQ ID NO: 49385 - DNA, 20 bp, Homo sapiens
tcccccgccccaccccgcgc

SEQ ID NO: 49386 - DNA, 21 bp, Homo sapiens
tcccccgccccaccccgcgcg

SEQ ID NO: 49387 - DNA, 22 bp, Homo sapiens
tcccccgccccaccccgcgcgc

SEQ ID NO: 49388 - DNA, 23 bp, Homo sapiens
tcccccgccccaccccgcgcgcg

SEQ ID NO: 49389 - DNA, 24 bp, Homo sapiens
tcccccgccccaccccgcgcgcgc

SEQ ID NO: 49390 - DNA, 27 bp, Homo sapiens
tcccccgccccaccccgcgcgcgccgc

SEQ ID NO: 49391 - DNA, 30 bp, Homo sapiens
tcccccgccccaccccgcgcgcgccgctcg

SEQ ID NO: 49392 - DNA, 17 bp, Homo sapiens
cccccgccccaccccgc

SEQ ID NO: 49393 - DNA, 18 bp, Homo sapiens
cccccgccccaccccgcg

SEQ ID NO: 49394 - DNA, 19 bp, Homo sapiens
cccccgccccaccccgcgc

SEQ ID NO: 49395 - DNA, 20 bp, Homo sapiens
cccccgccccaccccgcgcg

SEQ ID NO: 49396 - DNA, 21 bp, Homo sapiens
cccccgccccaccccgcgcgc

SEQ ID NO: 49397 - DNA, 22 bp, Homo sapiens
cccccgccccaccccgcgcgcg

SEQ ID NO: 49398 - DNA, 23 bp, Homo sapiens
cccccgccccaccccgcgcgcgc

SEQ ID NO: 49399 - DNA, 24 bp, Homo sapiens
cccccgccccaccccgcgcgcgcc

SEQ ID NO: 49400 - DNA, 25 bp, Homo sapiens
cccccgccccaccccgcgcgcgccg

SEQ ID NO: 49401 - DNA, 26 bp, Homo sapiens
cccccgccccaccccgcgcgcgccgc

SEQ ID NO: 49402 - DNA, 18 bp, Homo sapiens
ccccgccccaccccgcgc

SEQ ID NO: 49403 - DNA, 20 bp, Homo sapiens
ccccgccccaccccgcgcgc

SEQ ID NO: 49404 - DNA, 21 bp, Homo sapiens
ccccgccccaccccgcgcgcg

SEQ ID NO: 49405 - DNA, 22 bp, Homo sapiens
ccccgccccaccccgcgcgcgc

SEQ ID NO: 49406 - DNA, 23 bp, Homo sapiens
ccccgccccaccccgcgcgcgcc

SEQ ID NO: 49407 - DNA, 24 bp, Homo sapiens
ccccgccccaccccgcgcgcgccg

SEQ ID NO: 49408 - DNA, 25 bp, Homo sapiens
ccccgccccaccccgcgcgcgccgc

SEQ ID NO: 49409 - DNA, 17 bp, Homo sapiens
cccgccccaccccgcgc

SEQ ID NO: 49410 - DNA, 18 bp, Homo sapiens
cccgccccaccccgcgcg

SEQ ID NO: 49411 - DNA, 19 bp, Homo sapiens
cccgccccaccccgcgcgc

SEQ ID NO: 49412 - DNA, 20 bp, Homo sapiens
cccgccccaccccgcgcgcg

SEQ ID NO: 49413 - DNA, 21 bp, Homo sapiens
cccgccccaccccgcgcgcgc

SEQ ID NO: 49414 - DNA, 22 bp, Homo sapiens
cccgccccaccccgcgcgcgcc

SEQ ID NO: 49415 - DNA, 23 bp, Homo sapiens
cccgccccaccccgcgcgcgccg

SEQ ID NO: 49416 - DNA, 24 bp, Homo sapiens
cccgccccaccccgcgcgcgccgc

SEQ ID NO: 49417 - DNA, 25 bp, Homo sapiens
cccgccccaccccgcgcgcgccgct

SEQ ID NO: 49418 - DNA, 18 bp, Homo sapiens
ccgccccaccccgcgcgc

SEQ ID NO: 49419 - DNA, 19 bp, Homo sapiens
ccgccccaccccgcgcgcg

SEQ ID NO: 49420 - DNA, 20 bp, Homo sapiens
ccgccccaccccgcgcgcgc

SEQ ID NO: 49421 - DNA, 21 bp, Homo sapiens
ccgccccaccccgcgcgcgcc

SEQ ID NO: 49422 - DNA, 22 bp, Homo sapiens
ccgccccaccccgcgcgcgccg

SEQ ID NO: 49423 - DNA, 23 bp, Homo sapiens
ccgccccaccccgcgcgcgccgc

SEQ ID NO: 49424 - DNA, 24 bp, Homo sapiens
ccgccccaccccgcgcgcgccgct

SEQ ID NO: 49425 - DNA, 17 bp, Homo sapiens
cgccccaccccgcgcgc

SEQ ID NO: 49426 - DNA, 18 bp, Homo sapiens
cgccccaccccgcgcgcg

SEQ ID NO: 49427 - DNA, 19 bp, Homo sapiens
cgccccaccccgcgcgcgc

SEQ ID NO: 49428 - DNA, 20 bp, Homo sapiens
cgccccaccccgcgcgcgcc

SEQ ID NO: 49429 - DNA, 21 bp, Homo sapiens
cgccccaccccgcgcgcgccg

SEQ ID NO: 49430 - DNA, 22 bp, Homo sapiens
cgccccaccccgcgcgcgccgc

SEQ ID NO: 49431 - DNA, 23 bp, Homo sapiens
cgccccaccccgcgcgcgccgct

SEQ ID NO: 49432 - DNA, 26 bp, Homo sapiens
cgccccaccccgcgcgcgccgctcgc

SEQ ID NO: 49433 - DNA, 27 bp, Homo sapiens
cgccccaccccgcgcgcgccgctcgct

SEQ ID NO: 49434 - DNA, 28 bp, Homo sapiens
cgccccaccccgcgcgcgccgctcgctc

SEQ ID NO: 49435 - DNA, 17 bp, Homo sapiens
gccccaccccgcgcgcg

SEQ ID NO: 49436 - DNA, 18 bp, Homo sapiens
gccccaccccgcgcgcgc

SEQ ID NO: 49437 - DNA, 19 bp, Homo sapiens
gccccaccccgcgcgcgcc

SEQ ID NO: 49438 - DNA, 20 bp, Homo sapiens
gccccaccccgcgcgcgccg

SEQ ID NO: 49439 - DNA, 21 bp, Homo sapiens
gccccaccccgcgcgcgccgc

SEQ ID NO: 49440 - DNA, 20 bp, Homo sapiens
ccccaccccgcgcgcgccgc

SEQ ID NO: 49441 - DNA, 21 bp, Homo sapiens
ccaccccgcgcgcgccgctcg

SEQ ID NO: 49442 - DNA, 20 bp, Homo sapiens
caccccgcgcgcgccgctcg

SEQ ID NO: 49443 - DNA, 21 bp, Homo sapiens
caccccgcgcgcgccgctcgc

SEQ ID NO: 49444 - DNA, 22 bp, Homo sapiens
caccccgcgcgcgccgctcgct

SEQ ID NO: 49445 - DNA, 23 bp, Homo sapiens
caccccgcgcgcgccgctcgctc

SEQ ID NO: 49446 - DNA, 26 bp, Homo sapiens
caccccgcgcgcgccgctcgctccct

SEQ ID NO: 49447 - DNA, 17 bp, Homo sapiens
accccgcgcgcgccgct

SEQ ID NO: 49448 - DNA, 19 bp, Homo sapiens
accccgcgcgcgccgctcg

SEQ ID NO: 49449 - DNA, 20 bp, Homo sapiens
accccgcgcgcgccgctcgc

SEQ ID NO: 49450 - DNA, 21 bp, Homo sapiens
accccgcgcgcgccgctcgct

SEQ ID NO: 49451 - DNA, 22 bp, Homo sapiens
accccgcgcgcgccgctcgctc

SEQ ID NO: 49452 - DNA, 23 bp, Homo sapiens
accccgcgcgcgccgctcgctcc

SEQ ID NO: 49453 - DNA, 24 bp, Homo sapiens
accccgcgcgcgccgctcgctccc

SEQ ID NO: 49454 - DNA, 25 bp, Homo sapiens
accccgcgcgcgccgctcgctccct

SEQ ID NO: 49455 - DNA, 16 bp, Homo sapiens
ccccgcgcgcgccgct

SEQ ID NO: 49456 - DNA, 17 bp, Homo sapiens
ccccgcgcgcgccgctc

SEQ ID NO: 49457 - DNA, 18 bp, Homo sapiens
ccccgcgcgcgccgctcg

SEQ ID NO: 49458 - DNA, 19 bp, Homo sapiens
ccccgcgcgcgccgctcgc

SEQ ID NO: 49459 - DNA, 20 bp, Homo sapiens
ccccgcgcgcgccgctcgct

SEQ ID NO: 49460 - DNA, 21 bp, Homo sapiens
ccccgcgcgcgccgctcgctc

SEQ ID NO: 49461 - DNA, 22 bp, Homo sapiens
ccccgcgcgcgccgctcgctcc

SEQ ID NO: 49462 - DNA, 23 bp, Homo sapiens
ccccgcgcgcgccgctcgctccc

SEQ ID NO: 49463 - DNA, 18 bp, Homo sapiens
cccgcgcgcgccgctcgc

SEQ ID NO: 49464 - DNA, 19 bp, Homo sapiens
cccgcgcgcgccgctcgct

SEQ ID NO: 49465 - DNA, 20 bp, Homo sapiens
cccgcgcgcgccgctcgctc

SEQ ID NO: 49466 - DNA, 21 bp, Homo sapiens
cccgcgcgcgccgctcgctcc

SEQ ID NO: 49467 - DNA, 22 bp, Homo sapiens
cccgcgcgcgccgctcgctccc

SEQ ID NO: 49468 - DNA, 23 bp, Homo sapiens
cccgcgcgcgccgctcgctccct

SEQ ID NO: 49469 - DNA, 24 bp, Homo sapiens
cccgcgcgcgccgctcgctccctc

SEQ ID NO: 49470 - DNA, 16 bp, Homo sapiens
ccgcgcgcgccgctcg

SEQ ID NO: 49471 - DNA, 17 bp, Homo sapiens
ccgcgcgcgccgctcgc

SEQ ID NO: 49472 - DNA, 19 bp, Homo sapiens
ccgcgcgcgccgctcgctc

SEQ ID NO: 49473 - DNA, 20 bp, Homo sapiens
ccgcgcgcgccgctcgctcc

SEQ ID NO: 49474 - DNA, 21 bp, Homo sapiens
ccgcgcgcgccgctcgctccc

SEQ ID NO: 49475 - DNA, 22 bp, Homo sapiens
ccgcgcgcgccgctcgctccct

SEQ ID NO: 49476 - DNA, 23 bp, Homo sapiens
ccgcgcgcgccgctcgctccctc

SEQ ID NO: 49477 - DNA, 24 bp, Homo sapiens
ccgcgcgcgccgctcgctccctcc

SEQ ID NO: 49478 - DNA, 25 bp, Homo sapiens
ccgcgcgcgccgctcgctccctccc

SEQ ID NO: 49479 - DNA, 26 bp, Homo sapiens
ccgcgcgcgccgctcgctccctcccc

SEQ ID NO: 49480 - DNA, 16 bp, Homo sapiens
cgcgcgcgccgctcgc

SEQ ID NO: 49481 - DNA, 19 bp, Homo sapiens
cgcgcgcgccgctcgctcc

SEQ ID NO: 49482 - DNA, 20 bp, Homo sapiens
cgcgcgcgccgctcgctccc

SEQ ID NO: 49483 - DNA, 21 bp, Homo sapiens
cgcgcgcgccgctcgctccct

SEQ ID NO: 49484 - DNA, 22 bp, Homo sapiens
cgcgcgcgccgctcgctccctc

SEQ ID NO: 49485 - DNA, 23 bp, Homo sapiens
cgcgcgcgccgctcgctccctcc

SEQ ID NO: 49486 - DNA, 24 bp, Homo sapiens
cgcgcgcgccgctcgctccctccc

SEQ ID NO: 49487 - DNA, 25 bp, Homo sapiens
cgcgcgcgccgctcgctccctcccc

SEQ ID NO: 49488 - DNA, 18 bp, Homo sapiens
gcgcgcgccgctcgctcc

SEQ ID NO: 49489 - DNA, 19 bp, Homo sapiens
gcgcgcgccgctcgctccc

SEQ ID NO: 49490 - DNA, 20 bp, Homo sapiens
gcgcgcgccgctcgctccct

SEQ ID NO: 49491 - DNA, 21 bp, Homo sapiens
gcgcgcgccgctcgctccctc

SEQ ID NO: 49492 - DNA, 22 bp, Homo sapiens
gcgcgcgccgctcgctccctcc

SEQ ID NO: 49493 - DNA, 23 bp, Homo sapiens
gcgcgcgccgctcgctccctccc

SEQ ID NO: 49494 - DNA, 24 bp, Homo sapiens
gcgcgcgccgctcgctccctcccc

SEQ ID NO: 49495 - DNA, 21 bp, Homo sapiens
cgcgcgccgctcgctccctcc

SEQ ID NO: 49496 - DNA, 22 bp, Homo sapiens
cgcgcgccgctcgctccctccc

SEQ ID NO: 49497 - DNA, 17 bp, Homo sapiens
gcgcgccgctcgctccc

SEQ ID NO: 49498 - DNA, 18 bp, Homo sapiens
gcgcgccgctcgctccct

SEQ ID NO: 49499 - DNA, 19 bp, Homo sapiens
gcgcgccgctcgctccctc

SEQ ID NO: 49500 - DNA, 20 bp, Homo sapiens
gcgcgccgctcgctccctcc

SEQ ID NO: 49501 - DNA, 21 bp, Homo sapiens
gcgcgccgctcgctccctccc

SEQ ID NO: 49502 - DNA, 16 bp, Homo sapiens
cgcgccgctcgctccc

SEQ ID NO: 49503 - DNA, 18 bp, Homo sapiens
cgcgccgctcgctccctc

SEQ ID NO: 49504 - DNA, 19 bp, Homo sapiens
cgcgccgctcgctccctcc

SEQ ID NO: 49505 - DNA, 20 bp, Homo sapiens
cgcgccgctcgctccctccc

SEQ ID NO: 49506 - DNA, 16 bp, Homo sapiens
gcgccgctcgctccct

SEQ ID NO: 49507 - DNA, 18 bp, Homo sapiens
gcgccgctcgctccctcc

SEQ ID NO: 49508 - DNA, 19 bp, Homo sapiens
gcgccgctcgctccctccc

SEQ ID NO: 49509 - DNA, 20 bp, Homo sapiens
gcgccgctcgctccctcccc

SEQ ID NO: 49510 - DNA, 17 bp, Homo sapiens
cgccgctcgctccctcc

SEQ ID NO: 49511 - DNA, 18 bp, Homo sapiens
cgccgctcgctccctccc

SEQ ID NO: 49512 - DNA, 19 bp, Homo sapiens
cgccgctcgctccctcccc

SEQ ID NO: 49513 - DNA, 21 bp, Homo sapiens
cgccgctcgctccctccccgc

SEQ ID NO: 49514 - DNA, 22 bp, Homo sapiens
cgccgctcgctccctccccgcc

SEQ ID NO: 49515 - DNA, 16 bp, Homo sapiens
gccgctcgctccctcc

SEQ ID NO: 49516 - DNA, 17 bp, Homo sapiens
gccgctcgctccctccc

SEQ ID NO: 49517 - DNA, 18 bp, Homo sapiens
gccgctcgctccctcccc

SEQ ID NO: 49518 - DNA, 16 bp, Homo sapiens
ccgctcgctccctccc

SEQ ID NO: 49519 - DNA, 17 bp, Homo sapiens
ccgctcgctccctcccc

SEQ ID NO: 49520 - DNA, 26 bp, Homo sapiens
ccgctcgctccctccccgccccgcgc

SEQ ID NO: 49521 - DNA, 24 bp, Homo sapiens
cgctcgctccctccccgccccgcg

SEQ ID NO: 49522 - DNA, 25 bp, Homo sapiens
cgctcgctccctccccgccccgcgc

SEQ ID NO: 49523 - DNA, 26 bp, Homo sapiens
cgctcgctccctccccgccccgcgcc

SEQ ID NO: 49524 - DNA, 18 bp, Homo sapiens
gctcgctccctccccgcc

SEQ ID NO: 49525 - DNA, 21 bp, Homo sapiens
gctcgctccctccccgccccg

SEQ ID NO: 49526 - DNA, 22 bp, Homo sapiens
gctcgctccctccccgccccgc

SEQ ID NO: 49527 - DNA, 23 bp, Homo sapiens
gctcgctccctccccgccccgcg

SEQ ID NO: 49528 - DNA, 24 bp, Homo sapiens
gctcgctccctccccgccccgcgc

SEQ ID NO: 49529 - DNA, 25 bp, Homo sapiens
gctcgctccctccccgccccgcgcc

SEQ ID NO: 49530 - DNA, 23 bp, Homo sapiens
ctcgctccctccccgccccgcgc

SEQ ID NO: 49531 - DNA, 20 bp, Homo sapiens
cgctccctccccgccccgcg

SEQ ID NO: 49532 - DNA, 21 bp, Homo sapiens
cgctccctccccgccccgcgc

SEQ ID NO: 49533 - DNA, 24 bp, Homo sapiens
ctccctccccgccccgcgccctct

SEQ ID NO: 49534 - DNA, 16 bp, Homo sapiens
cccgccccgcgccctc

SEQ ID NO: 49535 - DNA, 20 bp, Homo sapiens
cccgccccgcgccctctctc

SEQ ID NO: 49536 - DNA, 21 bp, Homo sapiens
cccgccccgcgccctctctct

SEQ ID NO: 49537 - DNA, 23 bp, Homo sapiens
cccgccccgcgccctctctctct

SEQ ID NO: 49538 - DNA, 16 bp, Homo sapiens
ccgccccgcgccctct

SEQ ID NO: 49539 - DNA, 17 bp, Homo sapiens
ccgccccgcgccctctc

SEQ ID NO: 49540 - DNA, 18 bp, Homo sapiens
ccgccccgcgccctctct

SEQ ID NO: 49541 - DNA, 19 bp, Homo sapiens
ccgccccgcgccctctctc

SEQ ID NO: 49542 - DNA, 20 bp, Homo sapiens
ccgccccgcgccctctctct

SEQ ID NO: 49543 - DNA, 21 bp, Homo sapiens
ccgccccgcgccctctctctc

SEQ ID NO: 49544 - DNA, 22 bp, Homo sapiens
ccgccccgcgccctctctctct

SEQ ID NO: 49545 - DNA, 23 bp, Homo sapiens
ccgccccgcgccctctctctctc

SEQ ID NO: 49546 - DNA, 24 bp, Homo sapiens
ccgccccgcgccctctctctctct

SEQ ID NO: 49547 - DNA, 25 bp, Homo sapiens
ccgccccgcgccctctctctctctc

SEQ ID NO: 49548 - DNA, 26 bp, Homo sapiens
ccgccccgcgccctctctctctctct

SEQ ID NO: 49549 - DNA, 16 bp, Homo sapiens
cgccccgcgccctctc

SEQ ID NO: 49550 - DNA, 17 bp, Homo sapiens
cgccccgcgccctctct

SEQ ID NO: 49551 - DNA, 18 bp, Homo sapiens
cgccccgcgccctctctc

SEQ ID NO: 49552 - DNA, 19 bp, Homo sapiens
cgccccgcgccctctctct

SEQ ID NO: 49553 - DNA, 20 bp, Homo sapiens
cgccccgcgccctctctctc

SEQ ID NO: 49554 - DNA, 21 bp, Homo sapiens
cgccccgcgccctctctctct

SEQ ID NO: 49555 - DNA, 22 bp, Homo sapiens
cgccccgcgccctctctctctc

SEQ ID NO: 49556 - DNA, 23 bp, Homo sapiens
cgccccgcgccctctctctctct

SEQ ID NO: 49557 - DNA, 24 bp, Homo sapiens
cgccccgcgccctctctctctctc

SEQ ID NO: 49558 - DNA, 25 bp, Homo sapiens
cgccccgcgccctctctctctctct

SEQ ID NO: 49559 - DNA, 16 bp, Homo sapiens
gccccgcgccctctct

SEQ ID NO: 49560 - DNA, 19 bp, Homo sapiens
gccccgcgccctctctctc

SEQ ID NO: 49561 - DNA, 20 bp, Homo sapiens
gccccgcgccctctctctct

SEQ ID NO: 49562 - DNA, 21 bp, Homo sapiens
gccccgcgccctctctctctc

SEQ ID NO: 49563 - DNA, 22 bp, Homo sapiens
gccccgcgccctctctctctct

SEQ ID NO: 49564 - DNA, 23 bp, Homo sapiens
gccccgcgccctctctctctctc

SEQ ID NO: 49565 - DNA, 16 bp, Homo sapiens
ccccgcgccctctctc

SEQ ID NO: 49566 - DNA, 17 bp, Homo sapiens
ccccgcgccctctctct

SEQ ID NO: 49567 - DNA, 18 bp, Homo sapiens
ccccgcgccctctctctc

SEQ ID NO: 49568 - DNA, 19 bp, Homo sapiens
ccccgcgccctctctctct

SEQ ID NO: 49569 - DNA, 20 bp, Homo sapiens
ccccgcgccctctctctctc

SEQ ID NO: 49570 - DNA, 21 bp, Homo sapiens
ccccgcgccctctctctctct

SEQ ID NO: 49571 - DNA, 22 bp, Homo sapiens
ccccgcgccctctctctctctc

SEQ ID NO: 49572 - DNA, 17 bp, Homo sapiens
cccgcgccctctctctc

SEQ ID NO: 49573 - DNA, 19 bp, Homo sapiens
cccgcgccctctctctctc

SEQ ID NO: 49574 - DNA, 20 bp, Homo sapiens
cccgcgccctctctctctct

SEQ ID NO: 49575 - DNA, 21 bp, Homo sapiens
cctctctctctctctctcccc

SEQ ID NO: 49576 - DNA, 22 bp, Homo sapiens
cctctctctctctctctccccc

SEQ ID NO: 49577 - DNA, 25 bp, Homo sapiens
cctctctctctctctctcccccgct

SEQ ID NO: 49578 - DNA, 30 bp, Homo sapiens
cctctctctctctctctcccccgctccccg

SEQ ID NO: 49579 - DNA, 21 bp, Homo sapiens
ctctctctctctctctccccc

SEQ ID NO: 49580 - DNA, 24 bp, Homo sapiens
ctctctctctctctctcccccgct

SEQ ID NO: 49581 - DNA, 30 bp, Homo sapiens
ctctctctctctctctcccccgctccccgt

SEQ ID NO: 49582 - DNA, 19 bp, Homo sapiens
ctctctctctctctccccc

SEQ ID NO: 49583 - DNA, 21 bp, Homo sapiens
ctctctctctctctcccccgc

SEQ ID NO: 49584 - DNA, 29 bp, Homo sapiens
ctctctctctctctcccccgctccccgtc

SEQ ID NO: 49585 - DNA, 19 bp, Homo sapiens
tctctctctctctcccccg

SEQ ID NO: 49586 - DNA, 26 bp, Homo sapiens
tctctctctctctcccccgctccccg

SEQ ID NO: 49587 - DNA, 28 bp, Homo sapiens
tctctctctctctcccccgctccccgtc

SEQ ID NO: 49588 - DNA, 17 bp, Homo sapiens
ctctctctctctccccc

SEQ ID NO: 49589 - DNA, 18 bp, Homo sapiens
ctctctctctctcccccg

SEQ ID NO: 49590 - DNA, 19 bp, Homo sapiens
ctctctctctctcccccgc

SEQ ID NO: 49591 - DNA, 20 bp, Homo sapiens
ctctctctctctcccccgct

SEQ ID NO: 49592 - DNA, 21 bp, Homo sapiens
ctctctctctctcccccgctc

SEQ ID NO: 49593 - DNA, 22 bp, Homo sapiens
ctctctctctctcccccgctcc

SEQ ID NO: 49594 - DNA, 23 bp, Homo sapiens
ctctctctctctcccccgctccc

SEQ ID NO: 49595 - DNA, 24 bp, Homo sapiens
ctctctctctctcccccgctcccc

SEQ ID NO: 49596 - DNA, 25 bp, Homo sapiens
ctctctctctctcccccgctccccg

SEQ ID NO: 49597 - DNA, 26 bp, Homo sapiens
ctctctctctctcccccgctccccgt

SEQ ID NO: 49598 - DNA, 27 bp, Homo sapiens
ctctctctctctcccccgctccccgtc

SEQ ID NO: 49599 - DNA, 28 bp, Homo sapiens
ctctctctctctcccccgctccccgtcc

SEQ ID NO: 49600 - DNA, 30 bp, Homo sapiens
ctctctctctctcccccgctccccgtcctc

SEQ ID NO: 49601 - DNA, 16 bp, Homo sapiens
tctctctctctccccc

SEQ ID NO: 49602 - DNA, 17 bp, Homo sapiens
tctctctctctcccccg

SEQ ID NO: 49603 - DNA, 18 bp, Homo sapiens
tctctctctctcccccgc

SEQ ID NO: 49604 - DNA, 19 bp, Homo sapiens
tctctctctctcccccgct

SEQ ID NO: 49605 - DNA, 20 bp, Homo sapiens
tctctctctctcccccgctc

SEQ ID NO: 49606 - DNA, 21 bp, Homo sapiens
tctctctctctcccccgctcc

SEQ ID NO: 49607 - DNA, 22 bp, Homo sapiens
tctctctctctcccccgctccc

SEQ ID NO: 49608 - DNA, 24 bp, Homo sapiens
tctctctctctcccccgctccccg

SEQ ID NO: 49609 - DNA, 25 bp, Homo sapiens
tctctctctctcccccgctccccgt

SEQ ID NO: 49610 - DNA, 26 bp, Homo sapiens
tctctctctctcccccgctccccgtc

SEQ ID NO: 49611 - DNA, 27 bp, Homo sapiens
tctctctctctcccccgctccccgtcc

SEQ ID NO: 49612 - DNA, 16 bp, Homo sapiens
ctctctctctcccccg

SEQ ID NO: 49613 - DNA, 17 bp, Homo sapiens
ctctctctctcccccgc

SEQ ID NO: 49614 - DNA, 18 bp, Homo sapiens
ctctctctctcccccgct

SEQ ID NO: 49615 - DNA, 19 bp, Homo sapiens
ctctctctctcccccgctc

SEQ ID NO: 49616 - DNA, 20 bp, Homo sapiens
ctctctctctcccccgctcc

SEQ ID NO: 49617 - DNA, 21 bp, Homo sapiens
ctctctctctcccccgctccc

SEQ ID NO: 49618 - DNA, 22 bp, Homo sapiens
ctctctctctcccccgctcccc

SEQ ID NO: 49619 - DNA, 23 bp, Homo sapiens
ctctctctctcccccgctccccg

SEQ ID NO: 49620 - DNA, 24 bp, Homo sapiens
ctctctctctcccccgctccccgt

SEQ ID NO: 49621 - DNA, 25 bp, Homo sapiens
ctctctctctcccccgctccccgtc

SEQ ID NO: 49622 - DNA, 26 bp, Homo sapiens
ctctctctctcccccgctccccgtcc

SEQ ID NO: 49623 - DNA, 27 bp, Homo sapiens
ctctctctctcccccgctccccgtcct

SEQ ID NO: 49624 - DNA, 28 bp, Homo sapiens
ctctctctctcccccgctccccgtcctc

SEQ ID NO: 49625 - DNA, 29 bp, Homo sapiens
ctctctctctcccccgctccccgtcctcc

SEQ ID NO: 49626 - DNA, 30 bp, Homo sapiens
ctctctctctcccccgctccccgtcctccc

SEQ ID NO: 49627 - DNA, 17 bp, Homo sapiens
tctctctctcccccgct

SEQ ID NO: 49628 - DNA, 18 bp, Homo sapiens
tctctctctcccccgctc

SEQ ID NO: 49629 - DNA, 19 bp, Homo sapiens
tctctctctcccccgctcc

SEQ ID NO: 49630 - DNA, 20 bp, Homo sapiens
tctctctctcccccgctccc

SEQ ID NO: 49631 - DNA, 21 bp, Homo sapiens
tctctctctcccccgctcccc

SEQ ID NO: 49632 - DNA, 22 bp, Homo sapiens
tctctctctcccccgctccccg

SEQ ID NO: 49633 - DNA, 23 bp, Homo sapiens
tctctctctcccccgctccccgt

SEQ ID NO: 49634 - DNA, 24 bp, Homo sapiens
tctctctctcccccgctccccgtc

SEQ ID NO: 49635 - DNA, 25 bp, Homo sapiens
tctctctctcccccgctccccgtcc

SEQ ID NO: 49636 - DNA, 28 bp, Homo sapiens
tctctctctcccccgctccccgtcctcc

SEQ ID NO: 49637 - DNA, 16 bp, Homo sapiens
ctctctctcccccgct

SEQ ID NO: 49638 - DNA, 17 bp, Homo sapiens
ctctctctcccccgctc

SEQ ID NO: 49639 - DNA, 18 bp, Homo sapiens
ctctctctcccccgctcc

SEQ ID NO: 49640 - DNA, 19 bp, Homo sapiens
ctctctctcccccgctccc

SEQ ID NO: 49641 - DNA, 20 bp, Homo sapiens
ctctctctcccccgctcccc

SEQ ID NO: 49642 - DNA, 21 bp, Homo sapiens
ctctctctcccccgctccccg

SEQ ID NO: 49643 - DNA, 22 bp, Homo sapiens
ctctctctcccccgctccccgt

SEQ ID NO: 49644 - DNA, 23 bp, Homo sapiens
ctctctctcccccgctccccgtc

SEQ ID NO: 49645 - DNA, 24 bp, Homo sapiens
ctctctctcccccgctccccgtcc

SEQ ID NO: 49646 - DNA, 25 bp, Homo sapiens
ctctctctcccccgctccccgtcct

SEQ ID NO: 49647 - DNA, 26 bp, Homo sapiens
ctctctctcccccgctccccgtcctc

SEQ ID NO: 49648 - DNA, 27 bp, Homo sapiens
ctctctctcccccgctccccgtcctcc

SEQ ID NO: 49649 - DNA, 28 bp, Homo sapiens
ctctctctcccccgctccccgtcctccc

SEQ ID NO: 49650 - DNA, 29 bp, Homo sapiens
ctctctctcccccgctccccgtcctcccc

SEQ ID NO: 49651 - DNA, 30 bp, Homo sapiens
ctctctctcccccgctccccgtcctccccc

SEQ ID NO: 49652 - DNA, 17 bp, Homo sapiens
tctctctcccccgctcc

SEQ ID NO: 49653 - DNA, 18 bp, Homo sapiens
tctctctcccccgctccc

SEQ ID NO: 49654 - DNA, 19 bp, Homo sapiens
tctctctcccccgctcccc

SEQ ID NO: 49655 - DNA, 20 bp, Homo sapiens
tctctctcccccgctccccg

SEQ ID NO: 49656 - DNA, 22 bp, Homo sapiens
tctctctcccccgctccccgtc

SEQ ID NO: 49657 - DNA, 23 bp, Homo sapiens
tctctctcccccgctccccgtcc

SEQ ID NO: 49658 - DNA, 24 bp, Homo sapiens
tctctctcccccgctccccgtcct

SEQ ID NO: 49659 - DNA, 25 bp, Homo sapiens
tctctctcccccgctccccgtcctc

SEQ ID NO: 49660 - DNA, 26 bp, Homo sapiens
tctctctcccccgctccccgtcctcc

SEQ ID NO: 49661 - DNA, 27 bp, Homo sapiens
tctctctcccccgctccccgtcctccc

SEQ ID NO: 49662 - DNA, 16 bp, Homo sapiens
ctctctcccccgctcc

SEQ ID NO: 49663 - DNA, 17 bp, Homo sapiens
ctctctcccccgctccc

SEQ ID NO: 49664 - DNA, 18 bp, Homo sapiens
ctctctcccccgctcccc

SEQ ID NO: 49665 - DNA, 19 bp, Homo sapiens
ctctctcccccgctccccg

SEQ ID NO: 49666 - DNA, 20 bp, Homo sapiens
ctctctcccccgctccccgt

SEQ ID NO: 49667 - DNA, 21 bp, Homo sapiens
ctctctcccccgctccccgtc

SEQ ID NO: 49668 - DNA, 22 bp, Homo sapiens
ctctctcccccgctccccgtcc

SEQ ID NO: 49669 - DNA, 23 bp, Homo sapiens
ctctctcccccgctccccgtcct

SEQ ID NO: 49670 - DNA, 24 bp, Homo sapiens
ctctctcccccgctccccgtcctc

SEQ ID NO: 49671 - DNA, 25 bp, Homo sapiens
ctctctcccccgctccccgtcctcc

SEQ ID NO: 49672 - DNA, 26 bp, Homo sapiens
ctctctcccccgctccccgtcctccc

SEQ ID NO: 49673 - DNA, 27 bp, Homo sapiens
ctctctcccccgctccccgtcctcccc

SEQ ID NO: 49674 - DNA, 28 bp, Homo sapiens
ctctctcccccgctccccgtcctccccc

SEQ ID NO: 49675 - DNA, 30 bp, Homo sapiens; identical to SEQ ID NO: 24072

SEQ ID NO: 49676 - DNA, 16 bp, Homo sapiens
tctctcccccgctccc

SEQ ID NO: 49677 - DNA, 18 bp, Homo sapiens
tctctcccccgctccccg

SEQ ID NO: 49678 - DNA, 19 bp, Homo sapiens
tctctcccccgctccccgt

SEQ ID NO: 49679 - DNA, 20 bp, Homo sapiens
tctctcccccgctccccgtc

SEQ ID NO: 49680 - DNA, 21 bp, Homo sapiens
tctctcccccgctccccgtcc

SEQ ID NO: 49681 - DNA, 22 bp, Homo sapiens
tctctcccccgctccccgtcct

SEQ ID NO: 49682 - DNA, 23 bp, Homo sapiens
tctctcccccgctccccgtcctc

SEQ ID NO: 49683 - DNA, 24 bp, Homo sapiens
tctctcccccgctccccgtcctcc

SEQ ID NO: 49684 - DNA, 25 bp, Homo sapiens
tctctcccccgctccccgtcctccc

SEQ ID NO: 49685 - DNA, 26 bp, Homo sapiens
tctctcccccgctccccgtcctcccc

SEQ ID NO: 49686 - DNA, 29 bp, Homo sapiens
tctctcccccgctccccgtcctcccccct

SEQ ID NO: 49687 - DNA, 16 bp, Homo sapiens
ctctcccccgctcccc

SEQ ID NO: 49688 - DNA, 17 bp, Homo sapiens
ctctcccccgctccccg

SEQ ID NO: 49689 - DNA, 18 bp, Homo sapiens
ctctcccccgctccccgt

SEQ ID NO: 49690 - DNA, 19 bp, Homo sapiens
ctctcccccgctccccgtc

SEQ ID NO: 49691 - DNA, 20 bp, Homo sapiens
ctctcccccgctccccgtcc

SEQ ID NO: 49692 - DNA, 21 bp, Homo sapiens
ctctcccccgctccccgtcct

SEQ ID NO: 49693 - DNA, 22 bp, Homo sapiens
ctctcccccgctccccgtcctc

SEQ ID NO: 49694 - DNA, 23 bp, Homo sapiens
ctctcccccgctccccgtcctcc

SEQ ID NO: 49695 - DNA, 24 bp, Homo sapiens
ctctcccccgctccccgtcctccc

SEQ ID NO: 49696 - DNA, 25 bp, Homo sapiens
ctctcccccgctccccgtcctcccc

SEQ ID NO: 49697 - DNA, 26 bp, Homo sapiens
ctctcccccgctccccgtcctccccc

SEQ ID NO: 49698 - DNA, 27 bp, Homo sapiens
ctctcccccgctccccgtcctcccccc

SEQ ID NO: 49699 - DNA, 28 bp, Homo sapiens
ctctcccccgctccccgtcctcccccct

SEQ ID NO: 49700 - DNA, 29 bp, Homo sapiens
ctctcccccgctccccgtcctcccccctc

SEQ ID NO: 49701 - DNA, 30 bp, Homo sapiens
ctctcccccgctccccgtcctcccccctcc

SEQ ID NO: 49702 - DNA, 16 bp, Homo sapiens
tctcccccgctccccg

SEQ ID NO: 49703 - DNA, 17 bp, Homo sapiens
tctcccccgctccccgt

SEQ ID NO: 49704 - DNA, 18 bp, Homo sapiens
tctcccccgctccccgtc

SEQ ID NO: 49705 - DNA, 19 bp, Homo sapiens
tctcccccgctccccgtcc

SEQ ID NO: 49706 - DNA, 20 bp, Homo sapiens
tctcccccgctccccgtcct

SEQ ID NO: 49707 - DNA, 21 bp, Homo sapiens
tctcccccgctccccgtcctc

SEQ ID NO: 49708 - DNA, 22 bp, Homo sapiens
tctcccccgctccccgtcctcc

SEQ ID NO: 49709 - DNA, 23 bp, Homo sapiens
tctcccccgctccccgtcctccc

SEQ ID NO: 49710 - DNA, 24 bp, Homo sapiens
tctcccccgctccccgtcctcccc

SEQ ID NO: 49711 - DNA, 26 bp, Homo sapiens
tctcccccgctccccgtcctcccccc

SEQ ID NO: 49712 - DNA, 27 bp, Homo sapiens
tctcccccgctccccgtcctcccccct

SEQ ID NO: 49713 - DNA, 28 bp, Homo sapiens
tctcccccgctccccgtcctcccccctc

SEQ ID NO: 49714 - DNA, 16 bp, Homo sapiens
ctcccccgctccccgt

SEQ ID NO: 49715 - DNA, 17 bp, Homo sapiens
ctcccccgctccccgtc

SEQ ID NO: 49716 - DNA, 18 bp, Homo sapiens
ctcccccgctccccgtcc

SEQ ID NO: 49717 - DNA, 19 bp, Homo sapiens
ctcccccgctccccgtcct

SEQ ID NO: 49718 - DNA, 20 bp, Homo sapiens
ctcccccgctccccgtcctc

SEQ ID NO: 49719 - DNA, 21 bp, Homo sapiens
ctcccccgctccccgtcctcc

SEQ ID NO: 49720 - DNA, 22 bp, Homo sapiens
ctcccccgctccccgtcctccc

SEQ ID NO: 49721 - DNA, 23 bp, Homo sapiens
ctcccccgctccccgtcctcccc

SEQ ID NO: 49722 - DNA, 24 bp, Homo sapiens
ctcccccgctccccgtcctccccc

SEQ ID NO: 49723 - DNA, 25 bp, Homo sapiens
ctcccccgctccccgtcctcccccc

SEQ ID NO: 49724 - DNA, 26 bp, Homo sapiens
ctcccccgctccccgtcctcccccct

SEQ ID NO: 49725 - DNA, 27 bp, Homo sapiens
ctcccccgctccccgtcctcccccctc

SEQ ID NO: 49726 - DNA, 28 bp, Homo sapiens
ctcccccgctccccgtcctcccccctcc

SEQ ID NO: 49727 - DNA, 29 bp, Homo sapiens
ctcccccgctccccgtcctcccccctccc

SEQ ID NO: 49728 - DNA, 16 bp, Homo sapiens
tcccccgctccccgtc

SEQ ID NO: 49729 - DNA, 17 bp, Homo sapiens
tcccccgctccccgtcc

SEQ ID NO: 49730 - DNA, 18 bp, Homo sapiens
tcccccgctccccgtcct

SEQ ID NO: 49731 - DNA, 19 bp, Homo sapiens
tcccccgctccccgtcctc

SEQ ID NO: 49732 - DNA, 20 bp, Homo sapiens
tcccccgctccccgtcctcc

SEQ ID NO: 49733 - DNA, 21 bp, Homo sapiens
tcccccgctccccgtcctccc

SEQ ID NO: 49734 - DNA, 22 bp, Homo sapiens
tcccccgctccccgtcctcccc

SEQ ID NO: 49735 - DNA, 23 bp, Homo sapiens
tcccccgctccccgtcctccccc

SEQ ID NO: 49736 - DNA, 25 bp, Homo sapiens
tcccccgctccccgtcctcccccct

SEQ ID NO: 49737 - DNA, 26 bp, Homo sapiens
tcccccgctccccgtcctcccccctc

SEQ ID NO: 49738 - DNA, 16 bp, Homo sapiens
cccccgctccccgtcc

SEQ ID NO: 49739 - DNA, 17 bp, Homo sapiens
cccccgctccccgtcct

SEQ ID NO: 49740 - DNA, 18 bp, Homo sapiens
cccccgctccccgtcctc

SEQ ID NO: 49741 - DNA, 19 bp, Homo sapiens
cccccgctccccgtcctcc

SEQ ID NO: 49742 - DNA, 20 bp, Homo sapiens
cccccgctccccgtcctccc

SEQ ID NO: 49743 - DNA, 21 bp, Homo sapiens
cccccgctccccgtcctcccc

SEQ ID NO: 49744 - DNA, 22 bp, Homo sapiens
cccccgctccccgtcctccccc

SEQ ID NO: 49745 - DNA, 23 bp, Homo sapiens
cccccgctccccgtcctcccccc

SEQ ID NO: 49746 - DNA, 24 bp, Homo sapiens
cccccgctccccgtcctcccccct

SEQ ID NO: 49747 - DNA, 25 bp, Homo sapiens
cccccgctccccgtcctcccccctc

SEQ ID NO: 49748 - DNA, 26 bp, Homo sapiens
cccccgctccccgtcctcccccctcc

SEQ ID NO: 49749 - DNA, 27 bp, Homo sapiens
cccccgctccccgtcctcccccctccc

SEQ ID NO: 49750 - DNA, 18 bp, Homo sapiens
ccccgctccccgtcctcc

SEQ ID NO: 49751 - DNA, 19 bp, Homo sapiens
ccccgctccccgtcctccc

SEQ ID NO: 49752 - DNA, 20 bp, Homo sapiens
ccccgctccccgtcctcccc

SEQ ID NO: 49753 - DNA, 21 bp, Homo sapiens
ccccgctccccgtcctccccc

SEQ ID NO: 49754 - DNA, 22 bp, Homo sapiens
ccccgctccccgtcctcccccc

SEQ ID NO: 49755 - DNA, 23 bp, Homo sapiens
ccccgctccccgtcctcccccct

SEQ ID NO: 49756 - DNA, 24 bp, Homo sapiens
ccccgctccccgtcctcccccctc

SEQ ID NO: 49757 - DNA, 25 bp, Homo sapiens
ccccgctccccgtcctcccccctcc

SEQ ID NO: 49758 - DNA, 26 bp, Homo sapiens
ccccgctccccgtcctcccccctccc

SEQ ID NO: 49759 - DNA, 16 bp, Homo sapiens
cccgctccccgtcctc

SEQ ID NO: 49760 - DNA, 17 bp, Homo sapiens
cccgctccccgtcctcc

SEQ ID NO: 49761 - DNA, 18 bp, Homo sapiens
cccgctccccgtcctccc

SEQ ID NO: 49762 - DNA, 19 bp, Homo sapiens
cccgctccccgtcctcccc

SEQ ID NO: 49763 - DNA, 20 bp, Homo sapiens
cccgctccccgtcctccccc

SEQ ID NO: 49764 - DNA, 21 bp, Homo sapiens
cccgctccccgtcctcccccc

SEQ ID NO: 49765 - DNA, 22 bp, Homo sapiens
cccgctccccgtcctcccccct

SEQ ID NO: 49766 - DNA, 23 bp, Homo sapiens
cccgctccccgtcctcccccctc

SEQ ID NO: 49767 - DNA, 24 bp, Homo sapiens
cccgctccccgtcctcccccctcc

SEQ ID NO: 49768 - DNA, 25 bp, Homo sapiens
cccgctccccgtcctcccccctccc

SEQ ID NO: 49769 - DNA, 26 bp, Homo sapiens
cccgctccccgtcctcccccctcccc

SEQ ID NO: 49770 - DNA, 16 bp, Homo sapiens
ccgctccccgtcctcc

SEQ ID NO: 49771 - DNA, 17 bp, Homo sapiens
ccgctccccgtcctccc

SEQ ID NO: 49772 - DNA, 18 bp, Homo sapiens
ccgctccccgtcctcccc

SEQ ID NO: 49773 - DNA, 19 bp, Homo sapiens
ccgctccccgtcctccccc

SEQ ID NO: 49774 - DNA, 20 bp, Homo sapiens
ccgctccccgtcctcccccc

SEQ ID NO: 49775 - DNA, 21 bp, Homo sapiens
ccgctccccgtcctcccccct

SEQ ID NO: 49776 - DNA, 22 bp, Homo sapiens
ccgctccccgtcctcccccctc

SEQ ID NO: 49777 - DNA, 23 bp, Homo sapiens
ccgctccccgtcctcccccctcc

SEQ ID NO: 49778 - DNA, 24 bp, Homo sapiens
ccgctccccgtcctcccccctccc

SEQ ID NO: 49779 - DNA, 25 bp, Homo sapiens
ccgctccccgtcctcccccctcccc

SEQ ID NO: 49780 - DNA, 16 bp, Homo sapiens
cgctccccgtcctccc

SEQ ID NO: 49781 - DNA, 17 bp, Homo sapiens
cgctccccgtcctcccc

SEQ ID NO: 49782 - DNA, 18 bp, Homo sapiens
cgctccccgtcctccccc

SEQ ID NO: 49783 - DNA, 19 bp, Homo sapiens
cgctccccgtcctcccccc

SEQ ID NO: 49784 - DNA, 20 bp, Homo sapiens
cgctccccgtcctcccccct

SEQ ID NO: 49785 - DNA, 21 bp, Homo sapiens
cgctccccgtcctcccccctc

SEQ ID NO: 49786 - DNA, 22 bp, Homo sapiens
cgctccccgtcctcccccctcc

SEQ ID NO: 49787 - DNA, 23 bp, Homo sapiens
cgctccccgtcctcccccctccc

SEQ ID NO: 49788 - DNA, 24 bp, Homo sapiens
cgctccccgtcctcccccctcccc

SEQ ID NO: 49789 - DNA, 16 bp, Homo sapiens
gctccccgtcctcccc

SEQ ID NO: 49790 - DNA, 17 bp, Homo sapiens
gctccccgtcctccccc

SEQ ID NO: 49791 - DNA, 18 bp, Homo sapiens
gctccccgtcctcccccc

SEQ ID NO: 49792 - DNA, 19 bp, Homo sapiens
gctccccgtcctcccccct

SEQ ID NO: 49793 - DNA, 20 bp, Homo sapiens
gctccccgtcctcccccctc

SEQ ID NO: 49794 - DNA, 21 bp, Homo sapiens
gctccccgtcctcccccctcc

SEQ ID NO: 49795 - DNA, 22 bp, Homo sapiens
gctccccgtcctcccccctccc

SEQ ID NO: 49796 - DNA, 23 bp, Homo sapiens
gctccccgtcctcccccctcccc

SEQ ID NO: 49797 - DNA, 24 bp, Homo sapiens
gctccccgtcctcccccctccccg

SEQ ID NO: 49798 - DNA, 25 bp, Homo sapiens
gctccccgtcctcccccctccccgg

SEQ ID NO: 49799 - DNA, 17 bp, Homo sapiens
ctccccgtcctcccccc

SEQ ID NO: 49800 - DNA, 18 bp, Homo sapiens
ctccccgtcctcccccct

SEQ ID NO: 49801 - DNA, 19 bp, Homo sapiens
ctccccgtcctcccccctc

SEQ ID NO: 49802 - DNA, 20 bp, Homo sapiens
ctccccgtcctcccccctcc

SEQ ID NO: 49803 - DNA, 21 bp, Homo sapiens
ctccccgtcctcccccctccc

SEQ ID NO: 49804 - DNA, 22 bp, Homo sapiens
ctccccgtcctcccccctcccc

SEQ ID NO: 49805 - DNA, 24 bp, Homo sapiens
ctccccgtcctcccccctccccgg

SEQ ID NO: 49806 - DNA, 17 bp, Homo sapiens
tccccgtcctcccccct

SEQ ID NO: 49807 - DNA, 16 bp, Homo sapiens
ccccgtcctcccccct

SEQ ID NO: 49808 - DNA, 18 bp, Homo sapiens
ccccgtcctcccccctcc

SEQ ID NO: 49809 - DNA, 20 bp, Homo sapiens
ccccgtcctcccccctcccc

SEQ ID NO: 49810 - DNA, 16 bp, Homo sapiens
cccgtcctcccccctc

SEQ ID NO: 49811 - DNA, 17 bp, Homo sapiens
cccgtcctcccccctcc

SEQ ID NO: 49812 - DNA, 18 bp, Homo sapiens
cccgtcctcccccctccc

SEQ ID NO: 49813 - DNA, 19 bp, Homo sapiens
cccgtcctcccccctcccc

SEQ ID NO: 49814 - DNA, 22 bp, Homo sapiens
cccgtcctcccccctccccggg

SEQ ID NO: 49815 - DNA, 18 bp, Homo sapiens
ccgtcctcccccctcccc

SEQ ID NO: 49816 - DNA, 20 bp, Homo sapiens
ccgtcctcccccctccccgg

SEQ ID NO: 49817 - DNA, 20 bp, Homo sapiens
cgtcctcccccctccccggg

SEQ ID NO: 49818 - DNA, 21 bp, Homo sapiens
cccctccccgggggagcgccg

SEQ ID NO: 49819 - DNA, 27 bp, Homo sapiens
cccctccccgggggagcgccgcgtggg

SEQ ID NO: 49820 - DNA, 16 bp, Homo sapiens
cctccccgggggagcg

SEQ ID NO: 49821 - DNA, 17 bp, Homo sapiens
cctccccgggggagcgc

SEQ ID NO: 49822 - DNA, 18 bp, Homo sapiens
cctccccgggggagcgcc

SEQ ID NO: 49823 - DNA, 21 bp, Homo sapiens
cctccccgggggagcgccgcg

SEQ ID NO: 49824 - DNA, 16 bp, Homo sapiens
ctccccgggggagcgc

SEQ ID NO: 49825 - DNA, 17 bp, Homo sapiens
ctccccgggggagcgcc

SEQ ID NO: 49826 - DNA, 19 bp, Homo sapiens
tccccgggggagcgccgcg

SEQ ID NO: 49827 - DNA, 16 bp, Homo sapiens
ccgggggagcgccgcg

SEQ ID NO: 49828 - DNA, 17 bp, Homo sapiens
cgggggagcgccgcgtg

SEQ ID NO: 49829 - DNA, 18 bp, Homo sapiens
cgggggagcgccgcgtgg

SEQ ID NO: 49830 - DNA, 19 bp, Homo sapiens
cgggggagcgccgcgtggg

SEQ ID NO: 49831 - DNA, 20 bp, Homo sapiens
cgggggagcgccgcgtgggg

SEQ ID NO: 49832 - DNA, 21 bp, Homo sapiens
cgggggagcgccgcgtggggg

SEQ ID NO: 49833 - DNA, 22 bp, Homo sapiens
cgggggagcgccgcgtgggggc

SEQ ID NO: 49834 - DNA, 23 bp, Homo sapiens
cgggggagcgccgcgtgggggcg

SEQ ID NO: 49835 - DNA, 24 bp, Homo sapiens
cgggggagcgccgcgtgggggcgg

SEQ ID NO: 49836 - DNA, 25 bp, Homo sapiens
cgggggagcgccgcgtgggggcggc

SEQ ID NO: 49837 - DNA, 26 bp, Homo sapiens
cgggggagcgccgcgtgggggcggcg

SEQ ID NO: 49838 - DNA, 27 bp, Homo sapiens
cgggggagcgccgcgtgggggcggcgg

SEQ ID NO: 49839 - DNA, 28 bp, Homo sapiens
cgggggagcgccgcgtgggggcggcggc

SEQ ID NO: 49840 - DNA, 29 bp, Homo sapiens
cgggggagcgccgcgtgggggcggcggcg

SEQ ID NO: 49841 - DNA, 30 bp, Homo sapiens
cgggggagcgccgcgtgggggcggcggcgg

SEQ ID NO: 49842 - DNA, 16 bp, Homo sapiens
gggggagcgccgcgtg

SEQ ID NO: 49843 - DNA, 17 bp, Homo sapiens
gggggagcgccgcgtgg

SEQ ID NO: 49844 - DNA, 18 bp, Homo sapiens
gggggagcgccgcgtggg

SEQ ID NO: 49845 - DNA, 19 bp, Homo sapiens
gggggagcgccgcgtgggg

SEQ ID NO: 49846 - DNA, 20 bp, Homo sapiens
gggggagcgccgcgtggggg

SEQ ID NO: 49847 - DNA, 21 bp, Homo sapiens
gggggagcgccgcgtgggggc

SEQ ID NO: 49848 - DNA, 22 bp, Homo sapiens
gggggagcgccgcgtgggggcg

SEQ ID NO: 49849 - DNA, 23 bp, Homo sapiens
gggggagcgccgcgtgggggcgg

SEQ ID NO: 49850 - DNA, 24 bp, Homo sapiens
gggggagcgccgcgtgggggcggc

SEQ ID NO: 49851 - DNA, 25 bp, Homo sapiens
gggggagcgccgcgtgggggcggcg

SEQ ID NO: 49852 - DNA, 26 bp, Homo sapiens
gggggagcgccgcgtgggggcggcgg

SEQ ID NO: 49853 - DNA, 27 bp, Homo sapiens
gggggagcgccgcgtgggggcggcggc

SEQ ID NO: 49854 - DNA, 28 bp, Homo sapiens
gggggagcgccgcgtgggggcggcggcg

SEQ ID NO: 49855 - DNA, 30 bp, Homo sapiens
gggggagcgccgcgtgggggcggcggcggg

SEQ ID NO: 49856 - DNA, 16 bp, Homo sapiens
ggggagcgccgcgtgg

SEQ ID NO: 49857 - DNA, 17 bp, Homo sapiens
ggggagcgccgcgtggg

SEQ ID NO: 49858 - DNA, 18 bp, Homo sapiens
ggggagcgccgcgtgggg

SEQ ID NO: 49859 - DNA, 19 bp, Homo sapiens
ggggagcgccgcgtggggg

SEQ ID NO: 49860 - DNA, 20 bp, Homo sapiens
ggggagcgccgcgtgggggc

SEQ ID NO: 49861 - DNA, 21 bp, Homo sapiens
ggggagcgccgcgtgggggcg

SEQ ID NO: 49862 - DNA, 23 bp, Homo sapiens
ggggagcgccgcgtgggggcggc

SEQ ID NO: 49863 - DNA, 24 bp, Homo sapiens
ggggagcgccgcgtgggggcggcg

SEQ ID NO: 49864 - DNA, 18 bp, Homo sapiens
gggagcgccgcgtggggg

SEQ ID NO: 49865 - DNA, 19 bp, Homo sapiens
gggagcgccgcgtgggggc

SEQ ID NO: 49866 - DNA, 22 bp, Homo sapiens
gggagcgccgcgtgggggcggc

SEQ ID NO: 49867 - DNA, 23 bp, Homo sapiens
gggagcgccgcgtgggggcggcg

SEQ ID NO: 49868 - DNA, 18 bp, Homo sapiens
ggagcgccgcgtgggggc

SEQ ID NO: 49869 - DNA, 21 bp, Homo sapiens
ggagcgccgcgtgggggcggc

SEQ ID NO: 49870 - DNA, 17 bp, Homo sapiens
gagcgccgcgtgggggc

SEQ ID NO: 49871 - DNA, 20 bp, Homo sapiens
gagcgccgcgtgggggcggc

SEQ ID NO: 49872 - DNA, 19 bp, Homo sapiens
agcgccgcgtgggggcggc

SEQ ID NO: 49873 - DNA, 18 bp, Homo sapiens
gcgccgcgtgggggcggc

SEQ ID NO: 49874 - DNA, 19 bp, Homo sapiens
gcgccgcgtgggggcggcg

SEQ ID NO: 49875 - DNA, 20 bp, Homo sapiens
gcgccgcgtgggggcggcgg

SEQ ID NO: 49876 - DNA, 21 bp, Homo sapiens
gcgccgcgtgggggcggcggc

SEQ ID NO: 49877 - DNA, 22 bp, Homo sapiens
gcgccgcgtgggggcggcggcg

SEQ ID NO: 49878 - DNA, 23 bp, Homo sapiens
gcgccgcgtgggggcggcggcgg

SEQ ID NO: 49879 - DNA, 24 bp, Homo sapiens
gcgccgcgtgggggcggcggcggg

SEQ ID NO: 49880 - DNA, 25 bp, Homo sapiens
gcgccgcgtgggggcggcggcgggg

SEQ ID NO: 49881 - DNA, 26 bp, Homo sapiens
gcgccgcgtgggggcggcggcggggg

SEQ ID NO: 49882 - DNA, 27 bp, Homo sapiens
gcgccgcgtgggggcggcggcgggggg

SEQ ID NO: 49883 - DNA, 29 bp, Homo sapiens
gcgccgcgtgggggcggcggcggggggag

SEQ ID NO: 49884 - DNA, 20 bp, Homo sapiens
gccgcgtgggggcggcggcg

SEQ ID NO: 49885 - DNA, 17 bp, Homo sapiens
cgcgtgggggcggcggc

SEQ ID NO: 49886 - DNA, 16 bp, Homo sapiens
gcgtgggggcggcggc

SEQ ID NO: 49887 - DNA, 17 bp, Homo sapiens
gcgtgggggcggcggcg

SEQ ID NO: 49888 - DNA, 18 bp, Homo sapiens
gcgtgggggcggcggcgg

SEQ ID NO: 49889 - DNA, 19 bp, Homo sapiens
gcgtgggggcggcggcggg

SEQ ID NO: 49890 - DNA, 20 bp, Homo sapiens
gcgtgggggcggcggcgggg

SEQ ID NO: 49891 - DNA, 21 bp, Homo sapiens
gcgtgggggcggcggcggggg

SEQ ID NO: 49892 - DNA, 22 bp, Homo sapiens
gcgtgggggcggcggcgggggg

SEQ ID NO: 49893 - DNA, 23 bp, Homo sapiens
gcgtgggggcggcggcgggggga

SEQ ID NO: 49894 - DNA, 24 bp, Homo sapiens
gcgtgggggcggcggcggggggag

SEQ ID NO: 49895 - DNA, 25 bp, Homo sapiens
gcgtgggggcggcggcggggggaga

SEQ ID NO: 49896 - DNA, 26 bp, Homo sapiens
gcgtgggggcggcggcggggggagaa

SEQ ID NO: 49897 - DNA, 27 bp, Homo sapiens
gcgtgggggcggcggcggggggagaag

SEQ ID NO: 49898 - DNA, 30 bp, Homo sapiens
gcgtgggggcggcggcggggggagaagggt

SEQ ID NO: 49899 - DNA, 22 bp, Homo sapiens
cgtgggggcggcggcgggggga

SEQ ID NO: 49900 - DNA, 23 bp, Homo sapiens
cgtgggggcggcggcggggggag

SEQ ID NO: 49901 - DNA, 24 bp, Homo sapiens
cgtgggggcggcggcggggggaga

SEQ ID NO: 49902 - DNA, 16 bp, Homo sapiens
tgggggcggcggcggg

SEQ ID NO: 49903 - DNA, 17 bp, Homo sapiens
tgggggcggcggcgggg

SEQ ID NO: 49904 - DNA, 18 bp, Homo sapiens
tgggggcggcggcggggg

SEQ ID NO: 49905 - DNA, 19 bp, Homo sapiens
tgggggcggcggcgggggg

SEQ ID NO: 49906 - DNA, 20 bp, Homo sapiens
tgggggcggcggcgggggga

SEQ ID NO: 49907 - DNA, 21 bp, Homo sapiens
tgggggcggcggcggggggag

SEQ ID NO: 49908 - DNA, 22 bp, Homo sapiens
tgggggcggcggcggggggaga

SEQ ID NO: 49909 - DNA, 23 bp, Homo sapiens
tgggggcggcggcggggggagaa

SEQ ID NO: 49910 - DNA, 18 bp, Homo sapiens
gggggcggcggcgggggg

SEQ ID NO: 49911 - DNA, 19 bp, Homo sapiens
gggggcggcggcgggggga

SEQ ID NO: 49912 - DNA, 20 bp, Homo sapiens
gggggcggcggcggggggag

SEQ ID NO: 49913 - DNA, 21 bp, Homo sapiens
gggggcggcggcggggggaga

SEQ ID NO: 49914 - DNA, 22 bp, Homo sapiens
gggggcggcggcggggggagaa

SEQ ID NO: 49915 - DNA, 23 bp, Homo sapiens
gggggcggcggcggggggagaag

SEQ ID NO: 49916 - DNA, 24 bp, Homo sapiens
gggggcggcggcggggggagaagg

SEQ ID NO: 49917 - DNA, 18 bp, Homo sapiens
ggggcggcggcgggggga

SEQ ID NO: 49918 - DNA, 19 bp, Homo sapiens
ggggcggcggcggggggag

SEQ ID NO: 49919 - DNA, 20 bp, Homo sapiens
ggggcggcggcggggggaga

SEQ ID NO: 49920 - DNA, 21 bp, Homo sapiens
ggggcggcggcggggggagaa

SEQ ID NO: 49921 - DNA, 22 bp, Homo sapiens
ggggcggcggcggggggagaag

SEQ ID NO: 49922 - DNA, 23 bp, Homo sapiens
ggggcggcggcggggggagaagg

SEQ ID NO: 49923 - DNA, 25 bp, Homo sapiens
ggggcggcggcggggggagaagggt

SEQ ID NO: 49924 - DNA, 17 bp, Homo sapiens
gggcggcggcgggggga

SEQ ID NO: 49925 - DNA, 18 bp, Homo sapiens
gggcggcggcggggggag

SEQ ID NO: 49926 - DNA, 19 bp, Homo sapiens
gggcggcggcggggggaga

SEQ ID NO: 49927 - DNA, 20 bp, Homo sapiens
gggcggcggcggggggagaa

SEQ ID NO: 49928 - DNA, 21 bp, Homo sapiens
gggcggcggcggggggagaag

SEQ ID NO: 49929 - DNA, 22 bp, Homo sapiens
gggcggcggcggggggagaagg

SEQ ID NO: 49930 - DNA, 23 bp, Homo sapiens
gggcggcggcggggggagaaggg

SEQ ID NO: 49931 - DNA, 24 bp, Homo sapiens
gggcggcggcggggggagaagggt

SEQ ID NO: 49932 - DNA, 26 bp, Homo sapiens
gggcggcggcggggggagaagggtcg

SEQ ID NO: 49933 - DNA, 27 bp, Homo sapiens
gggcggcggcggggggagaagggtcgg

SEQ ID NO: 49934 - DNA, 30 bp, Homo sapiens
gggcggcggcggggggagaagggtcggggc

SEQ ID NO: 49935 - DNA, 16 bp, Homo sapiens
ggcggcggcgggggga

SEQ ID NO: 49936 - DNA, 17 bp, Homo sapiens
ggcggcggcggggggag

SEQ ID NO: 49937 - DNA, 18 bp, Homo sapiens
ggcggcggcggggggaga

SEQ ID NO: 49938 - DNA, 19 bp, Homo sapiens
ggcggcggcggggggagaa

SEQ ID NO: 49939 - DNA, 20 bp, Homo sapiens
ggcggcggcggggggagaag

SEQ ID NO: 49940 - DNA, 21 bp, Homo sapiens
ggcggcggcggggggagaagg

SEQ ID NO: 49941 - DNA, 22 bp, Homo sapiens
ggcggcggcggggggagaaggg

SEQ ID NO: 49942 - DNA, 23 bp, Homo sapiens
ggcggcggcggggggagaagggt

SEQ ID NO: 49943 - DNA, 26 bp, Homo sapiens
ggcggcggcggggggagaagggtcgg

SEQ ID NO: 49944 - DNA, 30 bp, Homo sapiens
ggcggcggcggggggagaagggtcggggcg

SEQ ID NO: 49945 - DNA, 16 bp, Homo sapiens
gcggcggcggggggag

SEQ ID NO: 49946 - DNA, 17 bp, Homo sapiens
gcggcggcggggggaga

SEQ ID NO: 49947 - DNA, 18 bp, Homo sapiens
gcggcggcggggggagaa

SEQ ID NO: 49948 - DNA, 19 bp, Homo sapiens
gcggcggcggggggagaag

SEQ ID NO: 49949 - DNA, 20 bp, Homo sapiens
gcggcggcggggggagaagg

SEQ ID NO: 49950 - DNA, 21 bp, Homo sapiens
gcggcggcggggggagaaggg

SEQ ID NO: 49951 - DNA, 22 bp, Homo sapiens
gcggcggcggggggagaagggt

SEQ ID NO: 49952 - DNA, 16 bp, Homo sapiens
ggcggcggggggagaa

SEQ ID NO: 49953 - DNA, 17 bp, Homo sapiens
ggcggcggggggagaag

SEQ ID NO: 49954 - DNA, 18 bp, Homo sapiens
ggcggcggggggagaagg

SEQ ID NO: 49955 - DNA, 19 bp, Homo sapiens
ggcggcggggggagaaggg

SEQ ID NO: 49956 - DNA, 20 bp, Homo sapiens
ggcggcggggggagaagggt

SEQ ID NO: 49957 - DNA, 21 bp, Homo sapiens
ggcggcggggggagaagggtc

SEQ ID NO: 49958 - DNA, 22 bp, Homo sapiens
ggcggcggggggagaagggtcg

SEQ ID NO: 49959 - DNA, 23 bp, Homo sapiens
ggcggcggggggagaagggtcgg

SEQ ID NO: 49960 - DNA, 24 bp, Homo sapiens
ggcggcggggggagaagggtcggg

SEQ ID NO: 49961 - DNA, 29 bp, Homo sapiens
ggcggcggggggagaagggtcggggcggc

SEQ ID NO: 49962 - DNA, 19 bp, Homo sapiens
gcggcggggggagaagggt

SEQ ID NO: 49963 - DNA, 20 bp, Homo sapiens
gcggcggggggagaagggtc

SEQ ID NO: 49964 - DNA, 21 bp, Homo sapiens
gcggcggggggagaagggtcg

SEQ ID NO: 49965 - DNA, 22 bp, Homo sapiens
gcggcggggggagaagggtcgg

SEQ ID NO: 49966 - DNA, 23 bp, Homo sapiens
gcggcggggggagaagggtcggg

SEQ ID NO: 49967 - DNA, 25 bp, Homo sapiens
gcggcggggggagaagggtcggggc

SEQ ID NO: 49968 - DNA, 28 bp, Homo sapiens
gcggcggggggagaagggtcggggcggc

SEQ ID NO: 49969 - DNA, 29 bp, Homo sapiens
gcggcggggggagaagggtcggggcggca

SEQ ID NO: 49970 - DNA, 17 bp, Homo sapiens
ggcggggggagaagggt

SEQ ID NO: 49971 - DNA, 18 bp, Homo sapiens
ggcggggggagaagggtc

SEQ ID NO: 49972 - DNA, 19 bp, Homo sapiens
ggcggggggagaagggtcg

SEQ ID NO: 49973 - DNA, 20 bp, Homo sapiens
ggcggggggagaagggtcgg

SEQ ID NO: 49974 - DNA, 21 bp, Homo sapiens
ggcggggggagaagggtcggg

SEQ ID NO: 49975 - DNA, 22 bp, Homo sapiens
ggcggggggagaagggtcgggg

SEQ ID NO: 49976 - DNA, 23 bp, Homo sapiens
ggcggggggagaagggtcggggc

SEQ ID NO: 49977 - DNA, 24 bp, Homo sapiens
ggcggggggagaagggtcggggcg

SEQ ID NO: 49978 - DNA, 25 bp, Homo sapiens
ggcggggggagaagggtcggggcgg

SEQ ID NO: 49979 - DNA, 26 bp, Homo sapiens
ggcggggggagaagggtcggggcggc

SEQ ID NO: 49980 - DNA, 27 bp, Homo sapiens
ggcggggggagaagggtcggggcggca

SEQ ID NO: 49981 - DNA, 17 bp, Homo sapiens
gcggggggagaagggtc

SEQ ID NO: 49982 - DNA, 18 bp, Homo sapiens
gcggggggagaagggtcg

SEQ ID NO: 49983 - DNA, 19 bp, Homo sapiens
gcggggggagaagggtcgg

SEQ ID NO: 49984 - DNA, 20 bp, Homo sapiens
gcggggggagaagggtcggg

SEQ ID NO: 49985 - DNA, 21 bp, Homo sapiens
gcggggggagaagggtcgggg

SEQ ID NO: 49986 - DNA, 22 bp, Homo sapiens
gcggggggagaagggtcggggc

SEQ ID NO: 49987 - DNA, 23 bp, Homo sapiens
gcggggggagaagggtcggggcg

SEQ ID NO: 49988 - DNA, 24 bp, Homo sapiens
gcggggggagaagggtcggggcgg

SEQ ID NO: 49989 - DNA, 25 bp, Homo sapiens
gcggggggagaagggtcggggcggc

SEQ ID NO: 49990 - DNA, 26 bp, Homo sapiens
gcggggggagaagggtcggggcggca

SEQ ID NO: 49991 - DNA, 27 bp, Homo sapiens
gcggggggagaagggtcggggcggcag

SEQ ID NO: 49992 - DNA, 28 bp, Homo sapiens
gcggggggagaagggtcggggcggcagg

SEQ ID NO: 49993 - DNA, 30 bp, Homo sapiens
gcggggggagaagggtcggggcggcagggg

SEQ ID NO: 49994 - DNA, 18 bp, Homo sapiens
cggggggagaagggtcgg

SEQ ID NO: 49995 - DNA, 19 bp, Homo sapiens
cggggggagaagggtcggg

SEQ ID NO: 49996 - DNA, 20 bp, Homo sapiens
cggggggagaagggtcgggg

SEQ ID NO: 49997 - DNA, 21 bp, Homo sapiens
cggggggagaagggtcggggc

SEQ ID NO: 49998 - DNA, 22 bp, Homo sapiens
cggggggagaagggtcggggcg

SEQ ID NO: 49999 - DNA, 23 bp, Homo sapiens
cggggggagaagggtcggggcgg

SEQ ID NO: 50000 - DNA, 24 bp, Homo sapiens
cggggggagaagggtcggggcggc

SEQ ID NO: 50001 - DNA, 25 bp, Homo sapiens
cggggggagaagggtcggggcggca

SEQ ID NO: 50002 - DNA, 26 bp, Homo sapiens
cggggggagaagggtcggggcggcag

SEQ ID NO: 50003 - DNA, 16 bp, Homo sapiens
ggggggagaagggtcg

SEQ ID NO: 50004 - DNA, 17 bp, Homo sapiens
ggggggagaagggtcgg

SEQ ID NO: 50005 - DNA, 18 bp, Homo sapiens
ggggggagaagggtcggg

SEQ ID NO: 50006 - DNA, 19 bp, Homo sapiens
ggggggagaagggtcgggg

SEQ ID NO: 50007 - DNA, 20 bp, Homo sapiens
ggggggagaagggtcggggc

SEQ ID NO: 50008 - DNA, 21 bp, Homo sapiens
ggggggagaagggtcggggcg

SEQ ID NO: 50009 - DNA, 22 bp, Homo sapiens
ggggggagaagggtcggggcgg

SEQ ID NO: 50010 - DNA, 23 bp, Homo sapiens
ggggggagaagggtcggggcggc

SEQ ID NO: 50011 - DNA, 24 bp, Homo sapiens
ggggggagaagggtcggggcggca

SEQ ID NO: 50012 - DNA, 25 bp, Homo sapiens
ggggggagaagggtcggggcggcag

SEQ ID NO: 50013 - DNA, 26 bp, Homo sapiens
ggggggagaagggtcggggcggcagg

SEQ ID NO: 50014 - DNA, 16 bp, Homo sapiens
gggggagaagggtcgg

SEQ ID NO: 50015 - DNA, 17 bp, Homo sapiens
gggggagaagggtcggg

SEQ ID NO: 50016 - DNA, 18 bp, Homo sapiens
gggggagaagggtcgggg

SEQ ID NO: 50017 - DNA, 19 bp, Homo sapiens
gggggagaagggtcggggc

SEQ ID NO: 50018 - DNA, 20 bp, Homo sapiens
gggggagaagggtcggggcg

SEQ ID NO: 50019 - DNA, 21 bp, Homo sapiens
gggggagaagggtcggggcgg

SEQ ID NO: 50020 - DNA, 22 bp, Homo sapiens
gggggagaagggtcggggcggc

SEQ ID NO: 50021 - DNA, 23 bp, Homo sapiens
gggggagaagggtcggggcggca

SEQ ID NO: 50022 - DNA, 24 bp, Homo sapiens
gggggagaagggtcggggcggcag

SEQ ID NO: 50023 - DNA, 25 bp, Homo sapiens
gggggagaagggtcggggcggcagg

SEQ ID NO: 50024 - DNA, 26 bp, Homo sapiens
gggggagaagggtcggggcggcaggg

SEQ ID NO: 50025 - DNA, 29 bp, Homo sapiens
gggggagaagggtcggggcggcaggggcc

SEQ ID NO: 50026 - DNA, 30 bp, Homo sapiens
gggggagaagggtcggggcggcaggggccg

SEQ ID NO: 50027 - DNA, 17 bp, Homo sapiens
ggggagaagggtcgggg

SEQ ID NO: 50028 - DNA, 18 bp, Homo sapiens
ggggagaagggtcggggc

SEQ ID NO: 50029 - DNA, 19 bp, Homo sapiens
ggggagaagggtcggggcg

SEQ ID NO: 50030 - DNA, 20 bp, Homo sapiens
ggggagaagggtcggggcgg

SEQ ID NO: 50031 - DNA, 21 bp, Homo sapiens
ggggagaagggtcggggcggc

SEQ ID NO: 50032 - DNA, 22 bp, Homo sapiens
ggggagaagggtcggggcggca

SEQ ID NO: 50033 - DNA, 23 bp, Homo sapiens
ggggagaagggtcggggcggcag

SEQ ID NO: 50034 - DNA, 24 bp, Homo sapiens
ggggagaagggtcggggcggcagg

SEQ ID NO: 50035 - DNA, 19 bp, Homo sapiens
gggagaagggtcggggcgg

SEQ ID NO: 50036 - DNA, 20 bp, Homo sapiens
gggagaagggtcggggcggc

SEQ ID NO: 50037 - DNA, 21 bp, Homo sapiens
gggagaagggtcggggcggca

SEQ ID NO: 50038 - DNA, 16 bp, Homo sapiens
ggagaagggtcggggc

SEQ ID NO: 50039 - DNA, 18 bp, Homo sapiens
ggagaagggtcggggcgg

SEQ ID NO: 50040 - DNA, 19 bp, Homo sapiens
ggagaagggtcggggcggc

SEQ ID NO: 50041 - DNA, 21 bp, Homo sapiens
ggagaagggtcggggcggcag

SEQ ID NO: 50042 - DNA, 26 bp, Homo sapiens
ggagaagggtcggggcggcaggggcc

SEQ ID NO: 50043 - DNA, 16 bp, Homo sapiens
gagaagggtcggggcg

SEQ ID NO: 50044 - DNA, 17 bp, Homo sapiens
gagaagggtcggggcgg

SEQ ID NO: 50045 - DNA, 18 bp, Homo sapiens
gagaagggtcggggcggc

SEQ ID NO: 50046 - DNA, 19 bp, Homo sapiens
gagaagggtcggggcggca

SEQ ID NO: 50047 - DNA, 20 bp, Homo sapiens
gagaagggtcggggcggcag

SEQ ID NO: 50048 - DNA, 21 bp, Homo sapiens
gagaagggtcggggcggcagg

SEQ ID NO: 50049 - DNA, 22 bp, Homo sapiens
gagaagggtcggggcggcaggg

SEQ ID NO: 50050 - DNA, 24 bp, Homo sapiens
gagaagggtcggggcggcaggggc

SEQ ID NO: 50051 - DNA, 25 bp, Homo sapiens
gagaagggtcggggcggcaggggcc

SEQ ID NO: 50052 - DNA, 27 bp, Homo sapiens
gagaagggtcggggcggcaggggccgg

SEQ ID NO: 50053 - DNA, 16 bp, Homo sapiens
agaagggtcggggcgg

SEQ ID NO: 50054 - DNA, 17 bp, Homo sapiens
agaagggtcggggcggc

SEQ ID NO: 50055 - DNA, 18 bp, Homo sapiens
agaagggtcggggcggca

SEQ ID NO: 50056 - DNA, 19 bp, Homo sapiens
agaagggtcggggcggcag

SEQ ID NO: 50057 - DNA, 20 bp, Homo sapiens
agaagggtcggggcggcagg

SEQ ID NO: 50058 - DNA, 21 bp, Homo sapiens
agaagggtcggggcggcaggg

SEQ ID NO: 50059 - DNA, 22 bp, Homo sapiens
agaagggtcggggcggcagggg

SEQ ID NO: 50060 - DNA, 23 bp, Homo sapiens
agaagggtcggggcggcaggggc

SEQ ID NO: 50061 - DNA, 24 bp, Homo sapiens
agaagggtcggggcggcaggggcc

SEQ ID NO: 50062 - DNA, 26 bp, Homo sapiens
agaagggtcggggcggcaggggccgg

SEQ ID NO: 50063 - DNA, 28 bp, Homo sapiens
agaagggtcggggcggcaggggccggcg

SEQ ID NO: 50064 - DNA, 30 bp, Homo sapiens
agaagggtcggggcggcaggggccggcggc

SEQ ID NO: 50065 - DNA, 16 bp, Homo sapiens
gaagggtcggggcggc

SEQ ID NO: 50066 - DNA, 17 bp, Homo sapiens
gaagggtcggggcggca

SEQ ID NO: 50067 - DNA, 18 bp, Homo sapiens
gaagggtcggggcggcag

SEQ ID NO: 50068 - DNA, 19 bp, Homo sapiens
gaagggtcggggcggcagg

SEQ ID NO: 50069 - DNA, 20 bp, Homo sapiens
gaagggtcggggcggcaggg

SEQ ID NO: 50070 - DNA, 21 bp, Homo sapiens
gaagggtcggggcggcagggg

SEQ ID NO: 50071 - DNA, 22 bp, Homo sapiens
gaagggtcggggcggcaggggc

SEQ ID NO: 50072 - DNA, 23 bp, Homo sapiens
gaagggtcggggcggcaggggcc

SEQ ID NO: 50073 - DNA, 24 bp, Homo sapiens
gaagggtcggggcggcaggggccg

SEQ ID NO: 50074 - DNA, 25 bp, Homo sapiens
gaagggtcggggcggcaggggccgg

SEQ ID NO: 50075 - DNA, 16 bp, Homo sapiens
aagggtcggggcggca

SEQ ID NO: 50076 - DNA, 17 bp, Homo sapiens
aagggtcggggcggcag

SEQ ID NO: 50077 - DNA, 18 bp, Homo sapiens
aagggtcggggcggcagg

SEQ ID NO: 50078 - DNA, 19 bp, Homo sapiens
aagggtcggggcggcaggg

SEQ ID NO: 50079 - DNA, 20 bp, Homo sapiens
aagggtcggggcggcagggg

SEQ ID NO: 50080 - DNA, 21 bp, Homo sapiens
aagggtcggggcggcaggggc

SEQ ID NO: 50081 - DNA, 22 bp, Homo sapiens
aagggtcggggcggcaggggcc

SEQ ID NO: 50082 - DNA, 23 bp, Homo sapiens
aagggtcggggcggcaggggccg

SEQ ID NO: 50083 - DNA, 24 bp, Homo sapiens
aagggtcggggcggcaggggccgg

SEQ ID NO: 50084 - DNA, 26 bp, Homo sapiens
aagggtcggggcggcaggggccggcg

SEQ ID NO: 50085 - DNA, 16 bp, Homo sapiens
agggtcggggcggcag

SEQ ID NO: 50086 - DNA, 17 bp, Homo sapiens
agggtcggggcggcagg

SEQ ID NO: 50087 - DNA, 18 bp, Homo sapiens
agggtcggggcggcaggg

SEQ ID NO: 50088 - DNA, 19 bp, Homo sapiens
agggtcggggcggcagggg

SEQ ID NO: 50089 - DNA, 20 bp, Homo sapiens
agggtcggggcggcaggggc

SEQ ID NO: 50090 - DNA, 21 bp, Homo sapiens
agggtcggggcggcaggggcc

SEQ ID NO: 50091 - DNA, 22 bp, Homo sapiens
agggtcggggcggcaggggccg

SEQ ID NO: 50092 - DNA, 23 bp, Homo sapiens
agggtcggggcggcaggggccgg

SEQ ID NO: 50093 - DNA, 25 bp, Homo sapiens
agggtcggggcggcaggggccggcg

SEQ ID NO: 50094 - DNA, 16 bp, Homo sapiens
gggtcggggcggcagg

SEQ ID NO: 50095 - DNA, 18 bp, Homo sapiens
gggtcggggcggcagggg

SEQ ID NO: 50096 - DNA, 19 bp, Homo sapiens
gggtcggggcggcaggggc

SEQ ID NO: 50097 - DNA, 20 bp, Homo sapiens
gggtcggggcggcaggggcc

SEQ ID NO: 50098 - DNA, 21 bp, Homo sapiens
gggtcggggcggcaggggccg

SEQ ID NO: 50099 - DNA, 22 bp, Homo sapiens
gggtcggggcggcaggggccgg

SEQ ID NO: 50100 - DNA, 16 bp, Homo sapiens
ggtcggggcggcaggg

SEQ ID NO: 50101 - DNA, 17 bp, Homo sapiens
ggtcggggcggcagggg

SEQ ID NO: 50102 - DNA, 18 bp, Homo sapiens
ggtcggggcggcaggggc

SEQ ID NO: 50103 - DNA, 19 bp, Homo sapiens
ggtcggggcggcaggggcc

SEQ ID NO: 50104 - DNA, 20 bp, Homo sapiens
ggtcggggcggcaggggccg

SEQ ID NO: 50105 - DNA, 21 bp, Homo sapiens
ggtcggggcggcaggggccgg

SEQ ID NO: 50106 - DNA, 22 bp, Homo sapiens
ggtcggggcggcaggggccggc

SEQ ID NO: 50107 - DNA, 23 bp, Homo sapiens
ggtcggggcggcaggggccggcg

SEQ ID NO: 50108 - DNA, 24 bp, Homo sapiens
ggtcggggcggcaggggccggcgg

SEQ ID NO: 50109 - DNA, 25 bp, Homo sapiens
ggtcggggcggcaggggccggcggc

SEQ ID NO: 50110 - DNA, 26 bp, Homo sapiens
ggtcggggcggcaggggccggcggcg

SEQ ID NO: 50111 - DNA, 28 bp, Homo sapiens
ggtcggggcggcaggggccggcggcggc

SEQ ID NO: 50112 - DNA, 29 bp, Homo sapiens
ggtcggggcggcaggggccggcggcggcc

SEQ ID NO: 50113 - DNA, 18 bp, Homo sapiens
ggggcggcaggggccggc

SEQ ID NO: 50114 - DNA, 21 bp, Homo sapiens
ggggcggcaggggccggcggc

SEQ ID NO: 50115 - DNA, 18 bp, Homo sapiens
gcaggggccggcggcggc

SEQ ID NO: 50116 - DNA, 22 bp, Homo sapiens
gcaggggccggcggcggcccgc

SEQ ID NO: 50117 - DNA, 23 bp, Homo sapiens
gcaggggccggcggcggcccgcc

SEQ ID NO: 50118 - DNA, 16 bp, Homo sapiens
aggggccggcggcggc

SEQ ID NO: 50119 - DNA, 16 bp, Homo sapiens
ggggccggcggcggcc

SEQ ID NO: 50120 - DNA, 28 bp, Homo sapiens
ggggccggcggcggcccgccgcggggcc

SEQ ID NO: 50121 - DNA, 27 bp, Homo sapiens
gggccggcggcggcccgccgcggggcc

SEQ ID NO: 50122 - DNA, 25 bp, Homo sapiens
ggccggcggcggcccgccgcggggc

SEQ ID NO: 50123 - DNA, 26 bp, Homo sapiens
ggccggcggcggcccgccgcggggcc

SEQ ID NO: 50124 - DNA, 21 bp, Homo sapiens
cggcggcggcccgccgcgggg

SEQ ID NO: 50125 - DNA, 22 bp, Homo sapiens
cggcggcggcccgccgcggggc

SEQ ID NO: 50126 - DNA, 23 bp, Homo sapiens
cggcggcggcccgccgcggggcc

SEQ ID NO: 50127 - DNA, 18 bp, Homo sapiens
ggcggcggcccgccgcgg

SEQ ID NO: 50128 - DNA, 20 bp, Homo sapiens
ggcggcggcccgccgcgggg

SEQ ID NO: 50129 - DNA, 21 bp, Homo sapiens
ggcggcggcccgccgcggggc

SEQ ID NO: 50130 - DNA, 22 bp, Homo sapiens
ggcggcggcccgccgcggggcc

SEQ ID NO: 50131 - DNA, 23 bp, Homo sapiens
ggcggcggcccgccgcggggccc

SEQ ID NO: 50132 - DNA, 24 bp, Homo sapiens
ggcggcggcccgccgcggggcccc

SEQ ID NO: 50133 - DNA, 20 bp, Homo sapiens
gcggcggcccgccgcggggc

SEQ ID NO: 50134 - DNA, 21 bp, Homo sapiens
gcggcggcccgccgcggggcc

SEQ ID NO: 50135 - DNA, 22 bp, Homo sapiens
gcggcggcccgccgcggggccc

SEQ ID NO: 50136 - DNA, 23 bp, Homo sapiens
gcggcggcccgccgcggggcccc

SEQ ID NO: 50137 - DNA, 27 bp, Homo sapiens
gcggcggcccgccgcggggccccggcg

SEQ ID NO: 50138 - DNA, 28 bp, Homo sapiens
gcggcggcccgccgcggggccccggcgg

SEQ ID NO: 50139 - DNA, 17 bp, Homo sapiens
cggcggcccgccgcggg

SEQ ID NO: 50140 - DNA, 18 bp, Homo sapiens
cggcggcccgccgcgggg

SEQ ID NO: 50141 - DNA, 19 bp, Homo sapiens
cggcggcccgccgcggggc

SEQ ID NO: 50142 - DNA, 20 bp, Homo sapiens
cggcggcccgccgcggggcc

SEQ ID NO: 50143 - DNA, 21 bp, Homo sapiens
cggcggcccgccgcggggccc

SEQ ID NO: 50144 - DNA, 22 bp, Homo sapiens
cggcggcccgccgcggggcccc

SEQ ID NO: 50145 - DNA, 16 bp, Homo sapiens
ggcggcccgccgcggg

SEQ ID NO: 50146 - DNA, 17 bp, Homo sapiens
ggcggcccgccgcgggg

SEQ ID NO: 50147 - DNA, 18 bp, Homo sapiens
ggcggcccgccgcggggc

SEQ ID NO: 50148 - DNA, 19 bp, Homo sapiens
ggcggcccgccgcggggcc

SEQ ID NO: 50149 - DNA, 20 bp, Homo sapiens
ggcggcccgccgcggggccc

SEQ ID NO: 50150 - DNA, 21 bp, Homo sapiens
ggcggcccgccgcggggcccc

SEQ ID NO: 50151 - DNA, 25 bp, Homo sapiens
ggcggcccgccgcggggccccggcg

SEQ ID NO: 50152 - DNA, 16 bp, Homo sapiens
gcggcccgccgcgggg

SEQ ID NO: 50153 - DNA, 17 bp, Homo sapiens
gcggcccgccgcggggc

SEQ ID NO: 50154 - DNA, 18 bp, Homo sapiens
gcggcccgccgcggggcc

SEQ ID NO: 50155 - DNA, 19 bp, Homo sapiens
gcggcccgccgcggggccc

SEQ ID NO: 50156 - DNA, 20 bp, Homo sapiens
gcggcccgccgcggggcccc

SEQ ID NO: 50157 - DNA, 21 bp, Homo sapiens
gcggcccgccgcggggccccg

SEQ ID NO: 50158 - DNA, 22 bp, Homo sapiens
gcggcccgccgcggggccccgg

SEQ ID NO: 50159 - DNA, 23 bp, Homo sapiens
gcggcccgccgcggggccccggc

SEQ ID NO: 50160 - DNA, 24 bp, Homo sapiens
gcggcccgccgcggggccccggcg

SEQ ID NO: 50161 - DNA, 25 bp, Homo sapiens
gcggcccgccgcggggccccggcgg

SEQ ID NO: 50162 - DNA, 30 bp, Homo sapiens
gcggcccgccgcggggccccggcggcgggg

SEQ ID NO: 50163 - DNA, 16 bp, Homo sapiens
cggcccgccgcggggc

SEQ ID NO: 50164 - DNA, 17 bp, Homo sapiens
cggcccgccgcggggcc

SEQ ID NO: 50165 - DNA, 18 bp, Homo sapiens
cggcccgccgcggggccc

SEQ ID NO: 50166 - DNA, 19 bp, Homo sapiens
cggcccgccgcggggcccc

SEQ ID NO: 50167 - DNA, 21 bp, Homo sapiens
cggcccgccgcggggccccgg

SEQ ID NO: 50168 - DNA, 22 bp, Homo sapiens
cggcccgccgcggggccccggc

SEQ ID NO: 50169 - DNA, 23 bp, Homo sapiens
cggcccgccgcggggccccggcg

SEQ ID NO: 50170 - DNA, 24 bp, Homo sapiens
cggcccgccgcggggccccggcgg

SEQ ID NO: 50171 - DNA, 16 bp, Homo sapiens
ggcccgccgcggggcc

SEQ ID NO: 50172 - DNA, 17 bp, Homo sapiens
ggcccgccgcggggccc

SEQ ID NO: 50173 - DNA, 18 bp, Homo sapiens
ggcccgccgcggggcccc

SEQ ID NO: 50174 - DNA, 20 bp, Homo sapiens
ggcccgccgcggggccccgg

SEQ ID NO: 50175 - DNA, 21 bp, Homo sapiens
ggcccgccgcggggccccggc

SEQ ID NO: 50176 - DNA, 22 bp, Homo sapiens
ggcccgccgcggggccccggcg

SEQ ID NO: 50177 - DNA, 23 bp, Homo sapiens
ggcccgccgcggggccccggcgg

SEQ ID NO: 50178 - DNA, 19 bp, Homo sapiens
gcccgccgcggggccccgg

SEQ ID NO: 50179 - DNA, 19 bp, Homo sapiens
cccgccgcggggccccggc

SEQ ID NO: 50180 - DNA, 17 bp, Homo sapiens
ccgccgcggggccccgg

SEQ ID NO: 50181 - DNA, 18 bp, Homo sapiens
ccgccgcggggccccggc

SEQ ID NO: 50182 - DNA, 17 bp, Homo sapiens
cgccgcggggccccggc

SEQ ID NO: 50183 - DNA, 18 bp, Homo sapiens
gccgcggggccccggcgg

SEQ ID NO: 50184 - DNA, 19 bp, Homo sapiens
gccgcggggccccggcggc

SEQ ID NO: 50185 - DNA, 21 bp, Homo sapiens
gccgcggggccccggcggcgg

SEQ ID NO: 50186 - DNA, 25 bp, Homo sapiens
gccgcggggccccggcggcgggggc

SEQ ID NO: 50187 - DNA, 26 bp, Homo sapiens
gccgcggggccccggcggcgggggca

SEQ ID NO: 50188 - DNA, 17 bp, Homo sapiens
ccgcggggccccggcgg

SEQ ID NO: 50189 - DNA, 18 bp, Homo sapiens
ccgcggggccccggcggc

SEQ ID NO: 50190 - DNA, 19 bp, Homo sapiens
ccgcggggccccggcggcg

SEQ ID NO: 50191 - DNA, 20 bp, Homo sapiens
ccgcggggccccggcggcgg

SEQ ID NO: 50192 - DNA, 21 bp, Homo sapiens
ccgcggggccccggcggcggg

SEQ ID NO: 50193 - DNA, 24 bp, Homo sapiens
ccgcggggccccggcggcgggggc

SEQ ID NO: 50194 - DNA, 25 bp, Homo sapiens
ccgcggggccccggcggcgggggca

SEQ ID NO: 50195 - DNA, 16 bp, Homo sapiens
cgcggggccccggcgg

SEQ ID NO: 50196 - DNA, 17 bp, Homo sapiens
cgcggggccccggcggc

SEQ ID NO: 50197 - DNA, 18 bp, Homo sapiens
cgcggggccccggcggcg

SEQ ID NO: 50198 - DNA, 19 bp, Homo sapiens
cgcggggccccggcggcgg

SEQ ID NO: 50199 - DNA, 20 bp, Homo sapiens
cgcggggccccggcggcggg

SEQ ID NO: 50200 - DNA, 21 bp, Homo sapiens
cgcggggccccggcggcgggg

SEQ ID NO: 50201 - DNA, 22 bp, Homo sapiens
cgcggggccccggcggcggggg

SEQ ID NO: 50202 - DNA, 23 bp, Homo sapiens
cgcggggccccggcggcgggggc

SEQ ID NO: 50203 - DNA, 24 bp, Homo sapiens
cgcggggccccggcggcgggggca

SEQ ID NO: 50204 - DNA, 16 bp, Homo sapiens
gcggggccccggcggc

SEQ ID NO: 50205 - DNA, 17 bp, Homo sapiens
gcggggccccggcggcg

SEQ ID NO: 50206 - DNA, 18 bp, Homo sapiens
gcggggccccggcggcgg

SEQ ID NO: 50207 - DNA, 19 bp, Homo sapiens
gcggggccccggcggcggg

SEQ ID NO: 50208 - DNA, 22 bp, Homo sapiens
gcggggccccggcggcgggggc

SEQ ID NO: 50209 - DNA, 23 bp, Homo sapiens
gcggggccccggcggcgggggca

SEQ ID NO: 50210 - DNA, 25 bp, Homo sapiens
gcggggccccggcggcgggggcacg

SEQ ID NO: 50211 - DNA, 26 bp, Homo sapiens
gcggggccccggcggcgggggcacgg

SEQ ID NO: 50212 - DNA, 28 bp, Homo sapiens
gcggggccccggcggcgggggcacggtc

SEQ ID NO: 50213 - DNA, 18 bp, Homo sapiens
cggggccccggcggcggg

SEQ ID NO: 50214 - DNA, 19 bp, Homo sapiens
cggggccccggcggcgggg

SEQ ID NO: 50215 - DNA, 20 bp, Homo sapiens
cggggccccggcggcggggg

SEQ ID NO: 50216 - DNA, 21 bp, Homo sapiens
cggggccccggcggcgggggc

SEQ ID NO: 50217 - DNA, 22 bp, Homo sapiens
cggggccccggcggcgggggca

SEQ ID NO: 50218 - DNA, 24 bp, Homo sapiens
cggggccccggcggcgggggcacg

SEQ ID NO: 50219 - DNA, 16 bp, Homo sapiens
ggggccccggcggcgg

SEQ ID NO: 50220 - DNA, 17 bp, Homo sapiens
ggggccccggcggcggg

SEQ ID NO: 50221 - DNA, 20 bp, Homo sapiens
ggggccccggcggcgggggc

SEQ ID NO: 50222 - DNA, 19 bp, Homo sapiens
cggcggcgggggcacggtc

SEQ ID NO: 50223 - DNA, 20 bp, Homo sapiens
cggcggcgggggcacggtcc

SEQ ID NO: 50224 - DNA, 16 bp, Homo sapiens
ggcggcgggggcacgg

SEQ ID NO: 50225 - DNA, 18 bp, Homo sapiens
ggcggcgggggcacggtc

SEQ ID NO: 50226 - DNA, 19 bp, Homo sapiens
ggcggcgggggcacggtcc

SEQ ID NO: 50227 - DNA, 20 bp, Homo sapiens
ggcggcgggggcacggtccc

SEQ ID NO: 50228 - DNA, 21 bp, Homo sapiens
ggcggcgggggcacggtcccc

SEQ ID NO: 50229 - DNA, 22 bp, Homo sapiens
ggcggcgggggcacggtccccc

SEQ ID NO: 50230 - DNA, 30 bp, Homo sapiens
ggcggcgggggcacggtcccccgcgagggg

SEQ ID NO: 50231 - DNA, 20 bp, Homo sapiens
gcggcgggggcacggtcccc

SEQ ID NO: 50232 - DNA, 30 bp, Homo sapiens
cgggggcacggtcccccgcgaggggggccc

SEQ ID NO: 50233 - DNA, 16 bp, Homo sapiens
ggcacggtcccccgcg

SEQ ID NO: 50234 - DNA, 17 bp, Homo sapiens
ggcacggtcccccgcga

SEQ ID NO: 50235 - DNA, 18 bp, Homo sapiens
ggcacggtcccccgcgag

SEQ ID NO: 50236 - DNA, 19 bp, Homo sapiens
ggcacggtcccccgcgagg

SEQ ID NO: 50237 - DNA, 24 bp, Homo sapiens
ggcacggtcccccgcgaggggggc

SEQ ID NO: 50238 - DNA, 25 bp, Homo sapiens
ggcacggtcccccgcgaggggggcc

SEQ ID NO: 50239 - DNA, 26 bp, Homo sapiens
ggcacggtcccccgcgaggggggccc

SEQ ID NO: 50240 - DNA, 27 bp, Homo sapiens
ggcacggtcccccgcgaggggggcccg

SEQ ID NO: 50241 - DNA, 16 bp, Homo sapiens
gcacggtcccccgcga

SEQ ID NO: 50242 - DNA, 17 bp, Homo sapiens
gcacggtcccccgcgag

SEQ ID NO: 50243 - DNA, 18 bp, Homo sapiens
gcacggtcccccgcgagg

SEQ ID NO: 50244 - DNA, 19 bp, Homo sapiens
gcacggtcccccgcgaggg

SEQ ID NO: 50245 - DNA, 23 bp, Homo sapiens
gcacggtcccccgcgaggggggc

SEQ ID NO: 50246 - DNA, 24 bp, Homo sapiens
gcacggtcccccgcgaggggggcc

SEQ ID NO: 50247 - DNA, 25 bp, Homo sapiens
gcacggtcccccgcgaggggggccc

SEQ ID NO: 50248 - DNA, 26 bp, Homo sapiens
gcacggtcccccgcgaggggggcccg

SEQ ID NO: 50249 - DNA, 28 bp, Homo sapiens
gcacggtcccccgcgaggggggcccggg

SEQ ID NO: 50250 - DNA, 19 bp, Homo sapiens
ggtcccccgcgaggggggc

SEQ ID NO: 50251 - DNA, 22 bp, Homo sapiens
gtcccccgcgaggggggcccgg

SEQ ID NO: 50252 - DNA, 21 bp, Homo sapiens
tcccccgcgaggggggcccgg

SEQ ID NO: 50253 - DNA, 19 bp, Homo sapiens
cccccgcgaggggggcccg

SEQ ID NO: 50254 - DNA, 20 bp, Homo sapiens
cccccgcgaggggggcccgg

SEQ ID NO: 50255 - DNA, 18 bp, Homo sapiens
ccccgcgaggggggcccg

SEQ ID NO: 50256 - DNA, 19 bp, Homo sapiens
ccccgcgaggggggcccgg

SEQ ID NO: 50257 - DNA, 20 bp, Homo sapiens
ccccgcgaggggggcccggg

SEQ ID NO: 50258 - DNA, 21 bp, Homo sapiens
ccccgcgaggggggcccgggc

SEQ ID NO: 50259 - DNA, 22 bp, Homo sapiens
ccccgcgaggggggcccgggca

SEQ ID NO: 50260 - DNA, 23 bp, Homo sapiens
ccccgcgaggggggcccgggcac

SEQ ID NO: 50261 - DNA, 17 bp, Homo sapiens
cccgcgaggggggcccg

SEQ ID NO: 50262 - DNA, 18 bp, Homo sapiens
cccgcgaggggggcccgg

SEQ ID NO: 50263 - DNA, 19 bp, Homo sapiens
cccgcgaggggggcccggg

SEQ ID NO: 50264 - DNA, 20 bp, Homo sapiens
cccgcgaggggggcccgggc

SEQ ID NO: 50265 - DNA, 21 bp, Homo sapiens
cccgcgaggggggcccgggca

SEQ ID NO: 50266 - DNA, 22 bp, Homo sapiens
cccgcgaggggggcccgggcac

SEQ ID NO: 50267 - DNA, 16 bp, Homo sapiens
ccgcgaggggggcccg

SEQ ID NO: 50268 - DNA, 17 bp, Homo sapiens
ccgcgaggggggcccgg

SEQ ID NO: 50269 - DNA, 18 bp, Homo sapiens
ccgcgaggggggcccggg

SEQ ID NO: 50270 - DNA, 19 bp, Homo sapiens
ccgcgaggggggcccgggc

SEQ ID NO: 50271 - DNA, 20 bp, Homo sapiens
ccgcgaggggggcccgggca

SEQ ID NO: 50272 - DNA, 21 bp, Homo sapiens
ccgcgaggggggcccgggcac

SEQ ID NO: 50273 - DNA, 16 bp, Homo sapiens
cgcgaggggggcccgg

SEQ ID NO: 50274 - DNA, 17 bp, Homo sapiens
cgcgaggggggcccggg

SEQ ID NO: 50275 - DNA, 18 bp, Homo sapiens
cgcgaggggggcccgggc

SEQ ID NO: 50276 - DNA, 19 bp, Homo sapiens
cgcgaggggggcccgggca

SEQ ID NO: 50277 - DNA, 20 bp, Homo sapiens
cgcgaggggggcccgggcac

SEQ ID NO: 50278 - DNA, 21 bp, Homo sapiens
cgcgaggggggcccgggcacc

SEQ ID NO: 50279 - DNA, 22 bp, Homo sapiens
cgcgaggggggcccgggcaccc

SEQ ID NO: 50280 - DNA, 16 bp, Homo sapiens
gcgaggggggcccggg

SEQ ID NO: 50281 - DNA, 17 bp, Homo sapiens
gcgaggggggcccgggc

SEQ ID NO: 50282 - DNA, 18 bp, Homo sapiens
gcgaggggggcccgggca

SEQ ID NO: 50283 - DNA, 19 bp, Homo sapiens
gcgaggggggcccgggcac

SEQ ID NO: 50284 - DNA, 20 bp, Homo sapiens
gcgaggggggcccgggcacc

SEQ ID NO: 50285 - DNA, 16 bp, Homo sapiens
cgaggggggcccgggc

SEQ ID NO: 50286 - DNA, 17 bp, Homo sapiens
cgaggggggcccgggca

SEQ ID NO: 50287 - DNA, 19 bp, Homo sapiens
cgaggggggcccgggcacc

SEQ ID NO: 50288 - DNA, 20 bp, Homo sapiens
cgaggggggcccgggcaccc

SEQ ID NO: 50289 - DNA, 23 bp, Homo sapiens
ggggggcccgggcacccgggggg

SEQ ID NO: 50290 - DNA, 24 bp, Homo sapiens
ggggggcccgggcacccggggggc

SEQ ID NO: 50291 - DNA, 30 bp, Homo sapiens
ggcccgggcacccggggggccggcggcggc

SEQ ID NO: 50292 - DNA, 21 bp, Homo sapiens
cccgggcacccggggggccgg

SEQ ID NO: 50293 - DNA, 30 bp, Homo sapiens
cccgggcacccggggggccggcggcggcgg

SEQ ID NO: 50294 - DNA, 19 bp, Homo sapiens
ccgggcacccggggggccg

SEQ ID NO: 50295 - DNA, 20 bp, Homo sapiens
ccgggcacccggggggccgg

SEQ ID NO: 50296 - DNA, 28 bp, Homo sapiens
ccgggcacccggggggccggcggcggcg

SEQ ID NO: 50297 - DNA, 30 bp, Homo sapiens
ccgggcacccggggggccggcggcggcggc

SEQ ID NO: 50298 - DNA, 30 bp, Homo sapiens
cgggcacccggggggccggcggcggcggcg

SEQ ID NO: 50299 - DNA, 19 bp, Homo sapiens
gggcacccggggggccggc

SEQ ID NO: 50300 - DNA, 22 bp, Homo sapiens
gggcacccggggggccggcggc

SEQ ID NO: 50301 - DNA, 23 bp, Homo sapiens
gggcacccggggggccggcggcg

SEQ ID NO: 50302 - DNA, 24 bp, Homo sapiens
gggcacccggggggccggcggcgg

SEQ ID NO: 50303 - DNA, 25 bp, Homo sapiens
gggcacccggggggccggcggcggc

SEQ ID NO: 50304 - DNA, 29 bp, Homo sapiens
gggcacccggggggccggcggcggcggcg

SEQ ID NO: 50305 - DNA, 16 bp, Homo sapiens
ggcacccggggggccg

SEQ ID NO: 50306 - DNA, 17 bp, Homo sapiens
ggcacccggggggccgg

SEQ ID NO: 50307 - DNA, 18 bp, Homo sapiens
ggcacccggggggccggc

SEQ ID NO: 50308 - DNA, 19 bp, Homo sapiens
ggcacccggggggccggcg

SEQ ID NO: 50309 - DNA, 21 bp, Homo sapiens
ggcacccggggggccggcggc

SEQ ID NO: 50310 - DNA, 22 bp, Homo sapiens
ggcacccggggggccggcggcg

SEQ ID NO: 50311 - DNA, 23 bp, Homo sapiens
ggcacccggggggccggcggcgg

SEQ ID NO: 50312 - DNA, 24 bp, Homo sapiens
ggcacccggggggccggcggcggc

SEQ ID NO: 50313 - DNA, 25 bp, Homo sapiens
ggcacccggggggccggcggcggcg

SEQ ID NO: 50314 - DNA, 27 bp, Homo sapiens
ggcacccggggggccggcggcggcggc

SEQ ID NO: 50315 - DNA, 28 bp, Homo sapiens
ggcacccggggggccggcggcggcggcg

SEQ ID NO: 50316 - DNA, 29 bp, Homo sapiens
ggcacccggggggccggcggcggcggcga

SEQ ID NO: 50317 - DNA, 30 bp, Homo sapiens
ggcacccggggggccggcggcggcggcgac

SEQ ID NO: 50318 - DNA, 17 bp, Homo sapiens
gcacccggggggccggc

SEQ ID NO: 50319 - DNA, 20 bp, Homo sapiens
gcacccggggggccggcggc

SEQ ID NO: 50320 - DNA, 21 bp, Homo sapiens
gcacccggggggccggcggcg

SEQ ID NO: 50321 - DNA, 22 bp, Homo sapiens
gcacccggggggccggcggcgg

SEQ ID NO: 50322 - DNA, 23 bp, Homo sapiens
gcacccggggggccggcggcggc

SEQ ID NO: 50323 - DNA, 26 bp, Homo sapiens
gcacccggggggccggcggcggcggc

SEQ ID NO: 50324 - DNA, 27 bp, Homo sapiens
gcacccggggggccggcggcggcggcg

SEQ ID NO: 50325 - DNA, 29 bp, Homo sapiens
gcacccggggggccggcggcggcggcgac

SEQ ID NO: 50326 - DNA, 30 bp, Homo sapiens
gcacccggggggccggcggcggcggcgact

SEQ ID NO: 50327 - DNA, 19 bp, Homo sapiens
cacccggggggccggcggc

SEQ ID NO: 50328 - DNA, 21 bp, Homo sapiens
cacccggggggccggcggcgg

SEQ ID NO: 50329 - DNA, 28 bp, Homo sapiens
cacccggggggccggcggcggcggcgac

SEQ ID NO: 50330 - DNA, 29 bp, Homo sapiens
cacccggggggccggcggcggcggcgact

SEQ ID NO: 50331 - DNA, 30 bp, Homo sapiens
cacccggggggccggcggcggcggcgactc

SEQ ID NO: 50332 - DNA, 18 bp, Homo sapiens
acccggggggccggcggc

SEQ ID NO: 50333 - DNA, 21 bp, Homo sapiens
acccggggggccggcggcggc

SEQ ID NO: 50334 - DNA, 30 bp, Homo sapiens
acccggggggccggcggcggcggcgactct

SEQ ID NO: 50335 - DNA, 19 bp, Homo sapiens
cccggggggccggcggcgg

SEQ ID NO: 50336 - DNA, 21 bp, Homo sapiens
cccggggggccggcggcggcg

SEQ ID NO: 50337 - DNA, 24 bp, Homo sapiens
cccggggggccggcggcggcggcg

SEQ ID NO: 50338 - DNA, 26 bp, Homo sapiens
cccggggggccggcggcggcggcgac

SEQ ID NO: 50339 - DNA, 27 bp, Homo sapiens
cccggggggccggcggcggcggcgact

SEQ ID NO: 50340 - DNA, 30 bp, Homo sapiens
cccggggggccggcggcggcggcgactctg

SEQ ID NO: 50341 - DNA, 30 bp, Homo sapiens
ccggggggccggcggcggcggcgactctgg

SEQ ID NO: 50342 - DNA, 16 bp, Homo sapiens
cggggggccggcggcg

SEQ ID NO: 50343 - DNA, 17 bp, Homo sapiens
cggggggccggcggcgg

SEQ ID NO: 50344 - DNA, 18 bp, Homo sapiens
cggggggccggcggcggc

SEQ ID NO: 50345 - DNA, 19 bp, Homo sapiens
cggggggccggcggcggcg

SEQ ID NO: 50346 - DNA, 20 bp, Homo sapiens
cggggggccggcggcggcgg

SEQ ID NO: 50347 - DNA, 21 bp, Homo sapiens
cggggggccggcggcggcggc

SEQ ID NO: 50348 - DNA, 22 bp, Homo sapiens
cggggggccggcggcggcggcg

SEQ ID NO: 50349 - DNA, 23 bp, Homo sapiens
cggggggccggcggcggcggcga

SEQ ID NO: 50350 - DNA, 24 bp, Homo sapiens
cggggggccggcggcggcggcgac

SEQ ID NO: 50351 - DNA, 25 bp, Homo sapiens
cggggggccggcggcggcggcgact

SEQ ID NO: 50352 - DNA, 28 bp, Homo sapiens
cggggggccggcggcggcggcgactctg

SEQ ID NO: 50353 - DNA, 29 bp, Homo sapiens
cggggggccggcggcggcggcgactctgg

SEQ ID NO: 50354 - DNA, 16 bp, Homo sapiens
ggggggccggcggcgg

SEQ ID NO: 50355 - DNA, 17 bp, Homo sapiens
ggggggccggcggcggc

SEQ ID NO: 50356 - DNA, 18 bp, Homo sapiens
ggggggccggcggcggcg

SEQ ID NO: 50357 - DNA, 19 bp, Homo sapiens
ggggggccggcggcggcgg

SEQ ID NO: 50358 - DNA, 20 bp, Homo sapiens
ggggggccggcggcggcggc

SEQ ID NO: 50359 - DNA, 21 bp, Homo sapiens
ggggggccggcggcggcggcg

SEQ ID NO: 50360 - DNA, 22 bp, Homo sapiens
ggggggccggcggcggcggcga

SEQ ID NO: 50361 - DNA, 23 bp, Homo sapiens
ggggggccggcggcggcggcgac

SEQ ID NO: 50362 - DNA, 24 bp, Homo sapiens
ggggggccggcggcggcggcgact

SEQ ID NO: 50363 - DNA, 25 bp, Homo sapiens
ggggggccggcggcggcggcgactc

SEQ ID NO: 50364 - DNA, 26 bp, Homo sapiens
ggggggccggcggcggcggcgactct

SEQ ID NO: 50365 - DNA, 27 bp, Homo sapiens
ggggggccggcggcggcggcgactctg

SEQ ID NO: 50366 - DNA, 28 bp, Homo sapiens
ggggggccggcggcggcggcgactctgg

SEQ ID NO: 50367 - DNA, 30 bp, Homo sapiens; identical to SEQ ID NO: 24183

SEQ ID NO: 50368 - DNA, 17 bp, Homo sapiens
gggggccggcggcggcg

SEQ ID NO: 50369 - DNA, 18 bp, Homo sapiens
gggggccggcggcggcgg

SEQ ID NO: 50370 - DNA, 19 bp, Homo sapiens
gggggccggcggcggcggc

SEQ ID NO: 50371 - DNA, 20 bp, Homo sapiens
gggggccggcggcggcggcg

SEQ ID NO: 50372 - DNA, 21 bp, Homo sapiens
gggggccggcggcggcggcga

SEQ ID NO: 50373 - DNA, 22 bp, Homo sapiens
gggggccggcggcggcggcgac

SEQ ID NO: 50374 - DNA, 23 bp, Homo sapiens
gggggccggcggcggcggcgact

SEQ ID NO: 50375 - DNA, 24 bp, Homo sapiens
gggggccggcggcggcggcgactc

SEQ ID NO: 50376 - DNA, 27 bp, Homo sapiens
gggggccggcggcggcggcgactctgg

SEQ ID NO: 50377 - DNA, 29 bp, Homo sapiens
gggggccggcggcggcggcgactctggac

SEQ ID NO: 50378 - DNA, 30 bp, Homo sapiens
gggggccggcggcggcggcgactctggacg

SEQ ID NO: 50379 - DNA, 16 bp, Homo sapiens
ggggccggcggcggcg

SEQ ID NO: 50380 - DNA, 17 bp, Homo sapiens
ggggccggcggcggcgg

SEQ ID NO: 50381 - DNA, 18 bp, Homo sapiens
ggggccggcggcggcggc

SEQ ID NO: 50382 - DNA, 19 bp, Homo sapiens
ggggccggcggcggcggcg

SEQ ID NO: 50383 - DNA, 20 bp, Homo sapiens
ggggccggcggcggcggcga

SEQ ID NO: 50384 - DNA, 21 bp, Homo sapiens
ggggccggcggcggcggcgac

SEQ ID NO: 50385 - DNA, 22 bp, Homo sapiens
ggggccggcggcggcggcgact

SEQ ID NO: 50386 - DNA, 23 bp, Homo sapiens
ggggccggcggcggcggcgactc

SEQ ID NO: 50387 - DNA, 24 bp, Homo sapiens
ggggccggcggcggcggcgactct

SEQ ID NO: 50388 - DNA, 26 bp, Homo sapiens
ggggccggcggcggcggcgactctgg

SEQ ID NO: 50389 - DNA, 28 bp, Homo sapiens
ggggccggcggcggcggcgactctggac

SEQ ID NO: 50390 - DNA, 29 bp, Homo sapiens
ggggccggcggcggcggcgactctggacg

SEQ ID NO: 50391 - DNA, 30 bp, Homo sapiens
ggggccggcggcggcggcgactctggacgc

SEQ ID NO: 50392 - DNA, 17 bp, Homo sapiens
gggccggcggcggcggc

SEQ ID NO: 50393 - DNA, 18 bp, Homo sapiens
gggccggcggcggcggcg

SEQ ID NO: 50394 - DNA, 19 bp, Homo sapiens
gggccggcggcggcggcga

SEQ ID NO: 50395 - DNA, 20 bp, Homo sapiens
gggccggcggcggcggcgac

SEQ ID NO: 50396 - DNA, 21 bp, Homo sapiens
gggccggcggcggcggcgact

SEQ ID NO: 50397 - DNA, 22 bp, Homo sapiens
gggccggcggcggcggcgactc

SEQ ID NO: 50398 - DNA, 28 bp, Homo sapiens
gggccggcggcggcggcgactctggacg

SEQ ID NO: 50399 - DNA, 30 bp, Homo sapiens
gggccggcggcggcggcgactctggacgcg

SEQ ID NO: 50400 - DNA, 19 bp, Homo sapiens
ggccggcggcggcggcgac

SEQ ID NO: 50401 - DNA, 20 bp, Homo sapiens
ggccggcggcggcggcgact

SEQ ID NO: 50402 - DNA, 22 bp, Homo sapiens
gccggcggcggcggcgactctg

SEQ ID NO: 50403 - DNA, 23 bp, Homo sapiens
gccggcggcggcggcgactctgg

SEQ ID NO: 50404 - DNA, 21 bp, Homo sapiens
ccggcggcggcggcgactctg

SEQ ID NO: 50405 - DNA, 22 bp, Homo sapiens
ccggcggcggcggcgactctgg

SEQ ID NO: 50406 - DNA, 23 bp, Homo sapiens
ccggcggcggcggcgactctgga

SEQ ID NO: 50407 - DNA, 24 bp, Homo sapiens
ccggcggcggcggcgactctggac

SEQ ID NO: 50408 - DNA, 25 bp, Homo sapiens
ccggcggcggcggcgactctggacg

SEQ ID NO: 50409 - DNA, 26 bp, Homo sapiens
ccggcggcggcggcgactctggacgc

SEQ ID NO: 50410 - DNA, 27 bp, Homo sapiens
ccggcggcggcggcgactctggacgcg

SEQ ID NO: 50411 - DNA, 28 bp, Homo sapiens
ccggcggcggcggcgactctggacgcga

SEQ ID NO: 50412 - DNA, 29 bp, Homo sapiens
ccggcggcggcggcgactctggacgcgag

SEQ ID NO: 50413 - DNA, 30 bp, Homo sapiens; identical to SEQ ID NO: 30375

SEQ ID NO: 50414 - DNA, 18 bp, Homo sapiens
cggcggcggcggcgactc

SEQ ID NO: 50415 - DNA, 19 bp, Homo sapiens
cggcggcggcggcgactct

SEQ ID NO: 50416 - DNA, 20 bp, Homo sapiens
cggcggcggcggcgactctg

SEQ ID NO: 50417 - DNA, 21 bp, Homo sapiens
cggcggcggcggcgactctgg

SEQ ID NO: 50418 - DNA, 22 bp, Homo sapiens
cggcggcggcggcgactctgga

SEQ ID NO: 50419 - DNA, 23 bp, Homo sapiens
cggcggcggcggcgactctggac

SEQ ID NO: 50420 - DNA, 24 bp, Homo sapiens
cggcggcggcggcgactctggacg

SEQ ID NO: 50421 - DNA, 25 bp, Homo sapiens
cggcggcggcggcgactctggacgc

SEQ ID NO: 50422 - DNA, 26 bp, Homo sapiens
cggcggcggcggcgactctggacgcg

SEQ ID NO: 50423 - DNA, 27 bp, Homo sapiens
cggcggcggcggcgactctggacgcga

SEQ ID NO: 50424 - DNA, 28 bp, Homo sapiens
cggcggcggcggcgactctggacgcgag

SEQ ID NO: 50425 - DNA, 29 bp, Homo sapiens
cggcggcggcggcgactctggacgcgagc

SEQ ID NO: 50426 - DNA, 30 bp, Homo sapiens; identical to SEQ ID NO: 30385

SEQ ID NO: 50427 - DNA, 19 bp, Homo sapiens
ggcggcggcggcgactctg

SEQ ID NO: 50428 - DNA, 20 bp, Homo sapiens
ggcggcggcggcgactctgg

SEQ ID NO: 50429 - DNA, 21 bp, Homo sapiens
ggcggcggcggcgactctgga

SEQ ID NO: 50430 - DNA, 22 bp, Homo sapiens
ggcggcggcggcgactctggac

SEQ ID NO: 50431 - DNA, 23 bp, Homo sapiens
ggcggcggcggcgactctggacg

SEQ ID NO: 50432 - DNA, 24 bp, Homo sapiens
ggcggcggcggcgactctggacgc

SEQ ID NO: 50433 - DNA, 25 bp, Homo sapiens
ggcggcggcggcgactctggacgcg

SEQ ID NO: 50434 - DNA, 26 bp, Homo sapiens
ggcggcggcggcgactctggacgcga

SEQ ID NO: 50435 - DNA, 27 bp, Homo sapiens
ggcggcggcggcgactctggacgcgag

SEQ ID NO: 50436 - DNA, 28 bp, Homo sapiens
ggcggcggcggcgactctggacgcgagc

SEQ ID NO: 50437 - DNA, 29 bp, Homo sapiens
ggcggcggcggcgactctggacgcgagcc

SEQ ID NO: 50438 - DNA, 30 bp, Homo sapiens; identical to SEQ ID NO: 24205

SEQ ID NO: 50439 - DNA, 17 bp, Homo sapiens
gcggcggcggcgactct

SEQ ID NO: 50440 - DNA, 18 bp, Homo sapiens
gcggcggcggcgactctg

SEQ ID NO: 50441 - DNA, 19 bp, Homo sapiens
gcggcggcggcgactctgg

SEQ ID NO: 50442 - DNA, 20 bp, Homo sapiens
gcggcggcggcgactctgga

SEQ ID NO: 50443 - DNA, 21 bp, Homo sapiens
gcggcggcggcgactctggac

SEQ ID NO: 50444 - DNA, 22 bp, Homo sapiens
gcggcggcggcgactctggacg

SEQ ID NO: 50445 - DNA, 23 bp, Homo sapiens
gcggcggcggcgactctggacgc

SEQ ID NO: 50446 - DNA, 24 bp, Homo sapiens
gcggcggcggcgactctggacgcg

SEQ ID NO: 50447 - DNA, 25 bp, Homo sapiens
gcggcggcggcgactctggacgcga

SEQ ID NO: 50448 - DNA, 26 bp, Homo sapiens
gcggcggcggcgactctggacgcgag

SEQ ID NO: 50449 - DNA, 27 bp, Homo sapiens
gcggcggcggcgactctggacgcgagc

SEQ ID NO: 50450 - DNA, 28 bp, Homo sapiens
gcggcggcggcgactctggacgcgagcc

SEQ ID NO: 50451 - DNA, 29 bp, Homo sapiens
gcggcggcggcgactctggacgcgagccg

SEQ ID NO: 50452 - DNA, 30 bp, Homo sapiens; identical to SEQ ID NO: 30403

SEQ ID NO: 50453 - DNA, 17 bp, Homo sapiens
cggcggcggcgactctg

SEQ ID NO: 50454 - DNA, 18 bp, Homo sapiens
cggcggcggcgactctgg

SEQ ID NO: 50455 - DNA, 19 bp, Homo sapiens
cggcggcggcgactctgga

SEQ ID NO: 50456 - DNA, 20 bp, Homo sapiens
cggcggcggcgactctggac

SEQ ID NO: 50457 - DNA, 21 bp, Homo sapiens
cggcggcggcgactctggacg

SEQ ID NO: 50458 - DNA, 22 bp, Homo sapiens
cggcggcggcgactctggacgc

SEQ ID NO: 50459 - DNA, 23 bp, Homo sapiens
cggcggcggcgactctggacgcg

SEQ ID NO: 50460 - DNA, 24 bp, Homo sapiens
cggcggcggcgactctggacgcga

SEQ ID NO: 50461 - DNA, 25 bp, Homo sapiens
cggcggcggcgactctggacgcgag

SEQ ID NO: 50462 - DNA, 26 bp, Homo sapiens
cggcggcggcgactctggacgcgagc

SEQ ID NO: 50463 - DNA, 27 bp, Homo sapiens
cggcggcggcgactctggacgcgagcc

SEQ ID NO: 50464 - DNA, 28 bp, Homo sapiens
cggcggcggcgactctggacgcgagccg

SEQ ID NO: 50465 - DNA, 29 bp, Homo sapiens
cggcggcggcgactctggacgcgagccgg

SEQ ID NO: 50466 - DNA, 30 bp, Homo sapiens; identical to SEQ ID NO: 24223

SEQ ID NO: 50467 - DNA, 17 bp, Homo sapiens
ggcggcggcgactctgg

SEQ ID NO: 50468 - DNA, 18 bp, Homo sapiens
ggcggcggcgactctgga

SEQ ID NO: 50469 - DNA, 19 bp, Homo sapiens
ggcggcggcgactctggac

SEQ ID NO: 50470 - DNA, 20 bp, Homo sapiens
ggcggcggcgactctggacg

SEQ ID NO: 50471 - DNA, 21 bp, Homo sapiens
ggcggcggcgactctggacgc

SEQ ID NO: 50472 - DNA, 22 bp, Homo sapiens
ggcggcggcgactctggacgcg

SEQ ID NO: 50473 - DNA, 23 bp, Homo sapiens
ggcggcggcgactctggacgcga

SEQ ID NO: 50474 - DNA, 24 bp, Homo sapiens
ggcggcggcgactctggacgcgag

SEQ ID NO: 50475 - DNA, 25 bp, Homo sapiens
ggcggcggcgactctggacgcgagc

SEQ ID NO: 50476 - DNA, 26 bp, Homo sapiens
ggcggcggcgactctggacgcgagcc

SEQ ID NO: 50477 - DNA, 27 bp, Homo sapiens
ggcggcggcgactctggacgcgagccg

SEQ ID NO: 50478 - DNA, 29 bp, Homo sapiens
ggcggcggcgactctggacgcgagccggg

SEQ ID NO: 50479 - DNA, 30 bp, Homo sapiens
ggcggcggcgactctggacgcgagccgggc

SEQ ID NO: 50480 - DNA, 16 bp, Homo sapiens
gcggcggcgactctgg

SEQ ID NO: 50481 - DNA, 17 bp, Homo sapiens
gcggcggcgactctgga

SEQ ID NO: 50482 - DNA, 18 bp, Homo sapiens
gcggcggcgactctggac

SEQ ID NO: 50483 - DNA, 19 bp, Homo sapiens
gcggcggcgactctggacg

SEQ ID NO: 50484 - DNA, 20 bp, Homo sapiens
gcggcggcgactctggacgc

SEQ ID NO: 50485 - DNA, 21 bp, Homo sapiens
gcggcggcgactctggacgcg

SEQ ID NO: 50486 - DNA, 22 bp, Homo sapiens
gcggcggcgactctggacgcga

SEQ ID NO: 50487 - DNA, 23 bp, Homo sapiens
gcggcggcgactctggacgcgag

SEQ ID NO: 50488 - DNA, 24 bp, Homo sapiens
gcggcggcgactctggacgcgagc

SEQ ID NO: 50489 - DNA, 25 bp, Homo sapiens
gcggcggcgactctggacgcgagcc

SEQ ID NO: 50490 - DNA, 26 bp, Homo sapiens
gcggcggcgactctggacgcgagccg

SEQ ID NO: 50491 - DNA, 27 bp, Homo sapiens
gcggcggcgactctggacgcgagccgg

SEQ ID NO: 50492 - DNA, 28 bp, Homo sapiens
gcggcggcgactctggacgcgagccggg

SEQ ID NO: 50493 - DNA, 29 bp, Homo sapiens
gcggcggcgactctggacgcgagccgggc

SEQ ID NO: 50494 - DNA, 30 bp, Homo sapiens; identical to SEQ ID NO: 5257

SEQ ID NO: 50495 - DNA, 16 bp, Homo sapiens
cggcggcgactctgga

SEQ ID NO: 50496 - DNA, 17 bp, Homo sapiens
cggcggcgactctggac

SEQ ID NO: 50497 - DNA, 18 bp, Homo sapiens
cggcggcgactctggacg

SEQ ID NO: 50498 - DNA, 19 bp, Homo sapiens
cggcggcgactctggacgc

SEQ ID NO: 50499 - DNA, 20 bp, Homo sapiens
cggcggcgactctggacgcg

SEQ ID NO: 50500 - DNA, 21 bp, Homo sapiens
cggcggcgactctggacgcga

SEQ ID NO: 50501 - DNA, 22 bp, Homo sapiens
cggcggcgactctggacgcgag

SEQ ID NO: 50502 - DNA, 23 bp, Homo sapiens
cggcggcgactctggacgcgagc

SEQ ID NO: 50503 - DNA, 24 bp, Homo sapiens
cggcggcgactctggacgcgagcc

SEQ ID NO: 50504 - DNA, 25 bp, Homo sapiens
cggcggcgactctggacgcgagccg

SEQ ID NO: 50505 - DNA, 26 bp, Homo sapiens
cggcggcgactctggacgcgagccgg

SEQ ID NO: 50506 - DNA, 27 bp, Homo sapiens
cggcggcgactctggacgcgagccggg

SEQ ID NO: 50507 - DNA, 28 bp, Homo sapiens
cggcggcgactctggacgcgagccgggc

SEQ ID NO: 50508 - DNA, 29 bp, Homo sapiens
cggcggcgactctggacgcgagccgggcc

SEQ ID NO: 50509 - DNA, 30 bp, Homo sapiens; identical to SEQ ID NO: 5260

SEQ ID NO: 50510 - DNA, 16 bp, Homo sapiens
ggcggcgactctggac

SEQ ID NO: 50511 - DNA, 17 bp, Homo sapiens
ggcggcgactctggacg

SEQ ID NO: 50512 - DNA, 18 bp, Homo sapiens
ggcggcgactctggacgc

SEQ ID NO: 50513 - DNA, 19 bp, Homo sapiens
ggcggcgactctggacgcg

SEQ ID NO: 50514 - DNA, 20 bp, Homo sapiens
ggcggcgactctggacgcga

SEQ ID NO: 50515 - DNA, 21 bp, Homo sapiens
ggcggcgactctggacgcgag

SEQ ID NO: 50516 - DNA, 22 bp, Homo sapiens
ggcggcgactctggacgcgagc

SEQ ID NO: 50517 - DNA, 23 bp, Homo sapiens
ggcggcgactctggacgcgagcc

SEQ ID NO: 50518 - DNA, 24 bp, Homo sapiens
ggcggcgactctggacgcgagccg

SEQ ID NO: 50519 - DNA, 25 bp, Homo sapiens
ggcggcgactctggacgcgagccgg

SEQ ID NO: 50520 - DNA, 26 bp, Homo sapiens
ggcggcgactctggacgcgagccggg

SEQ ID NO: 50521 - DNA, 27 bp, Homo sapiens
ggcggcgactctggacgcgagccgggc

SEQ ID NO: 50522 - DNA, 28 bp, Homo sapiens
ggcggcgactctggacgcgagccgggcc

SEQ ID NO: 50523 - DNA, 29 bp, Homo sapiens
ggcggcgactctggacgcgagccgggccc

SEQ ID NO: 50524 - DNA, 30 bp, Homo sapiens; identical to SEQ ID NO: 24263

SEQ ID NO: 50525 - DNA, 16 bp, Homo sapiens
gcggcgactctggacg

SEQ ID NO: 50526 - DNA, 17 bp, Homo sapiens
gcggcgactctggacgc

SEQ ID NO: 50527 - DNA, 18 bp, Homo sapiens
gcggcgactctggacgcg

SEQ ID NO: 50528 - DNA, 19 bp, Homo sapiens
gcggcgactctggacgcga

SEQ ID NO: 50529 - DNA, 20 bp, Homo sapiens
gcggcgactctggacgcgag

SEQ ID NO: 50530 - DNA, 21 bp, Homo sapiens
gcggcgactctggacgcgagc

SEQ ID NO: 50531 - DNA, 22 bp, Homo sapiens
gcggcgactctggacgcgagcc

SEQ ID NO: 50532 - DNA, 23 bp, Homo sapiens
gcggcgactctggacgcgagccg

SEQ ID NO: 50533 - DNA, 24 bp, Homo sapiens
gcggcgactctggacgcgagccgg

SEQ ID NO: 50534 - DNA, 25 bp, Homo sapiens
gcggcgactctggacgcgagccggg

SEQ ID NO: 50535 - DNA, 26 bp, Homo sapiens
gcggcgactctggacgcgagccgggc

SEQ ID NO: 50536 - DNA, 27 bp, Homo sapiens
gcggcgactctggacgcgagccgggcc

SEQ ID NO: 50537 - DNA, 28 bp, Homo sapiens
gcggcgactctggacgcgagccgggccc

SEQ ID NO: 50538 - DNA, 29 bp, Homo sapiens
gcggcgactctggacgcgagccgggccct

SEQ ID NO: 50539 - DNA, 30 bp, Homo sapiens; identical to SEQ ID NO: 5266

SEQ ID NO: 50540 - DNA, 16 bp, Homo sapiens
cggcgactctggacgc

SEQ ID NO: 50541 - DNA, 17 bp, Homo sapiens
cggcgactctggacgcg

SEQ ID NO: 50542 - DNA, 18 bp, Homo sapiens
cggcgactctggacgcga

SEQ ID NO: 50543 - DNA, 19 bp, Homo sapiens
cggcgactctggacgcgag

SEQ ID NO: 50544 - DNA, 20 bp, Homo sapiens
cggcgactctggacgcgagc

SEQ ID NO: 50545 - DNA, 21 bp, Homo sapiens
cggcgactctggacgcgagcc

SEQ ID NO: 50546 - DNA, 22 bp, Homo sapiens
cggcgactctggacgcgagccg

SEQ ID NO: 50547 - DNA, 23 bp, Homo sapiens
cggcgactctggacgcgagccgg

SEQ ID NO: 50548 - DNA, 24 bp, Homo sapiens
cggcgactctggacgcgagccggg

SEQ ID NO: 50549 - DNA, 25 bp, Homo sapiens
cggcgactctggacgcgagccgggc

SEQ ID NO: 50550 - DNA, 26 bp, Homo sapiens
cggcgactctggacgcgagccgggcc

SEQ ID NO: 50551 - DNA, 27 bp, Homo sapiens
cggcgactctggacgcgagccgggccc

SEQ ID NO: 50552 - DNA, 28 bp, Homo sapiens
cggcgactctggacgcgagccgggccct

SEQ ID NO: 50553 - DNA, 29 bp, Homo sapiens
cggcgactctggacgcgagccgggccctt

SEQ ID NO: 50554 - DNA, 30 bp, Homo sapiens
cggcgactctggacgcgagccgggcccttc

SEQ ID NO: 50555 - DNA, 16 bp, Homo sapiens
ggcgactctggacgcg

SEQ ID NO: 50556 - DNA, 17 bp, Homo sapiens
ggcgactctggacgcga

SEQ ID NO: 50557 - DNA, 18 bp, Homo sapiens
ggcgactctggacgcgag

SEQ ID NO: 50558 - DNA, 19 bp, Homo sapiens
ggcgactctggacgcgagc

SEQ ID NO: 50559 - DNA, 20 bp, Homo sapiens
ggcgactctggacgcgagcc

SEQ ID NO: 50560 - DNA, 21 bp, Homo sapiens
ggcgactctggacgcgagccg

SEQ ID NO: 50561 - DNA, 22 bp, Homo sapiens
ggcgactctggacgcgagccgg

SEQ ID NO: 50562 - DNA, 23 bp, Homo sapiens
ggcgactctggacgcgagccggg

SEQ ID NO: 50563 - DNA, 24 bp, Homo sapiens
ggcgactctggacgcgagccgggc

SEQ ID NO: 50564 - DNA, 25 bp, Homo sapiens
ggcgactctggacgcgagccgggcc

SEQ ID NO: 50565 - DNA, 26 bp, Homo sapiens
ggcgactctggacgcgagccgggccc

SEQ ID NO: 50566 - DNA, 27 bp, Homo sapiens
ggcgactctggacgcgagccgggccct

SEQ ID NO: 50567 - DNA, 28 bp, Homo sapiens
ggcgactctggacgcgagccgggccctt

SEQ ID NO: 50568 - DNA, 29 bp, Homo sapiens
ggcgactctggacgcgagccgggcccttc

SEQ ID NO: 50569 - DNA, 30 bp, Homo sapiens
ggcgactctggacgcgagccgggcccttcc

SEQ ID NO: 50570 - DNA, 16 bp, Homo sapiens
gcgactctggacgcga

SEQ ID NO: 50571 - DNA, 17 bp, Homo sapiens
gcgactctggacgcgag

SEQ ID NO: 50572 - DNA, 18 bp, Homo sapiens
gcgactctggacgcgagc

SEQ ID NO: 50573 - DNA, 19 bp, Homo sapiens
gcgactctggacgcgagcc

SEQ ID NO: 50574 - DNA, 20 bp, Homo sapiens
gcgactctggacgcgagccg

SEQ ID NO: 50575 - DNA, 21 bp, Homo sapiens
gcgactctggacgcgagccgg

SEQ ID NO: 50576 - DNA, 22 bp, Homo sapiens
gcgactctggacgcgagccggg

SEQ ID NO: 50577 - DNA, 23 bp, Homo sapiens
gcgactctggacgcgagccgggc

SEQ ID NO: 50578 - DNA, 24 bp, Homo sapiens
gcgactctggacgcgagccgggcc

SEQ ID NO: 50579 - DNA, 25 bp, Homo sapiens
gcgactctggacgcgagccgggccc

SEQ ID NO: 50580 - DNA, 26 bp, Homo sapiens
gcgactctggacgcgagccgggccct

SEQ ID NO: 50581 - DNA, 27 bp, Homo sapiens
gcgactctggacgcgagccgggccctt

SEQ ID NO: 50582 - DNA, 28 bp, Homo sapiens
gcgactctggacgcgagccgggcccttc

SEQ ID NO: 50583 - DNA, 29 bp, Homo sapiens
gcgactctggacgcgagccgggcccttcc

SEQ ID NO: 50584 - DNA, 30 bp, Homo sapiens
gcgactctggacgcgagccgggcccttccc

SEQ ID NO: 50585 - DNA, 16 bp, Homo sapiens
cgactctggacgcgag

SEQ ID NO: 50586 - DNA, 17 bp, Homo sapiens
cgactctggacgcgagc

SEQ ID NO: 50587 - DNA, 18 bp, Homo sapiens
cgactctggacgcgagcc

SEQ ID NO: 50588 - DNA, 19 bp, Homo sapiens
cgactctggacgcgagccg

SEQ ID NO: 50589 - DNA, 20 bp, Homo sapiens
cgactctggacgcgagccgg

SEQ ID NO: 50590 - DNA, 21 bp, Homo sapiens
cgactctggacgcgagccggg

SEQ ID NO: 50591 - DNA, 22 bp, Homo sapiens
cgactctggacgcgagccgggc

SEQ ID NO: 50592 - DNA, 23 bp, Homo sapiens
cgactctggacgcgagccgggcc

SEQ ID NO: 50593 - DNA, 24 bp, Homo sapiens
cgactctggacgcgagccgggccc

SEQ ID NO: 50594 - DNA, 25 bp, Homo sapiens
cgactctggacgcgagccgggccct

SEQ ID NO: 50595 - DNA, 26 bp, Homo sapiens
cgactctggacgcgagccgggccctt

SEQ ID NO: 50596 - DNA, 30 bp, Homo sapiens; identical to SEQ ID NO: 24298

SEQ ID NO: 50597 - DNA, 16 bp, Homo sapiens
gactctggacgcgagc

SEQ ID NO: 50598 - DNA, 17 bp, Homo sapiens
gactctggacgcgagcc

SEQ ID NO: 50599 - DNA, 18 bp, Homo sapiens
gactctggacgcgagccg

SEQ ID NO: 50600 - DNA, 19 bp, Homo sapiens
gactctggacgcgagccgg

SEQ ID NO: 50601 - DNA, 20 bp, Homo sapiens
gactctggacgcgagccggg

SEQ ID NO: 50602 - DNA, 21 bp, Homo sapiens
gactctggacgcgagccgggc

SEQ ID NO: 50603 - DNA, 22 bp, Homo sapiens
gactctggacgcgagccgggcc

SEQ ID NO: 50604 - DNA, 23 bp, Homo sapiens
gactctggacgcgagccgggccc

SEQ ID NO: 50605 - DNA, 24 bp, Homo sapiens
gactctggacgcgagccgggccct

SEQ ID NO: 50606 - DNA, 16 bp, Homo sapiens
actctggacgcgagcc

SEQ ID NO: 50607 - DNA, 17 bp, Homo sapiens
actctggacgcgagccg

SEQ ID NO: 50608 - DNA, 18 bp, Homo sapiens
actctggacgcgagccgg

SEQ ID NO: 50609 - DNA, 19 bp, Homo sapiens
actctggacgcgagccggg

SEQ ID NO: 50610 - DNA, 20 bp, Homo sapiens
actctggacgcgagccgggc

SEQ ID NO: 50611 - DNA, 21 bp, Homo sapiens
actctggacgcgagccgggcc

SEQ ID NO: 50612 - DNA, 22 bp, Homo sapiens
actctggacgcgagccgggccc

SEQ ID NO: 50613 - DNA, 23 bp, Homo sapiens
actctggacgcgagccgggccct

SEQ ID NO: 50614 - DNA, 24 bp, Homo sapiens
actctggacgcgagccgggccctt

SEQ ID NO: 50615 - DNA, 25 bp, Homo sapiens
actctggacgcgagccgggcccttc

SEQ ID NO: 50616 - DNA, 26 bp, Homo sapiens
actctggacgcgagccgggcccttcc

SEQ ID NO: 50617 - DNA, 27 bp, Homo sapiens
actctggacgcgagccgggcccttccc

SEQ ID NO: 50618 - DNA, 28 bp, Homo sapiens
actctggacgcgagccgggcccttcccg

SEQ ID NO: 50619 - DNA, 29 bp, Homo sapiens
actctggacgcgagccgggcccttcccgt

SEQ ID NO: 50620 - DNA, 30 bp, Homo sapiens
actctggacgcgagccgggcccttcccgtg

SEQ ID NO: 50621 - DNA, 16 bp, Homo sapiens
ctctggacgcgagccg

SEQ ID NO: 50622 - DNA, 17 bp, Homo sapiens
ctctggacgcgagccgg

SEQ ID NO: 50623 - DNA, 18 bp, Homo sapiens
ctctggacgcgagccggg

SEQ ID NO: 50624 - DNA, 19 bp, Homo sapiens
ctctggacgcgagccgggc

SEQ ID NO: 50625 - DNA, 20 bp, Homo sapiens
ctctggacgcgagccgggcc

SEQ ID NO: 50626 - DNA, 21 bp, Homo sapiens
ctctggacgcgagccgggccc

SEQ ID NO: 50627 - DNA, 22 bp, Homo sapiens
ctctggacgcgagccgggccct

SEQ ID NO: 50628 - DNA, 23 bp, Homo sapiens
ctctggacgcgagccgggccctt

SEQ ID NO: 50629 - DNA, 24 bp, Homo sapiens
ctctggacgcgagccgggcccttc

SEQ ID NO: 50630 - DNA, 25 bp, Homo sapiens
ctctggacgcgagccgggcccttcc

SEQ ID NO: 50631 - DNA, 26 bp, Homo sapiens
ctctggacgcgagccgggcccttccc

SEQ ID NO: 50632 - DNA, 27 bp, Homo sapiens
ctctggacgcgagccgggcccttcccg

SEQ ID NO: 50633 - DNA, 28 bp, Homo sapiens
ctctggacgcgagccgggcccttcccgt

SEQ ID NO: 50634 - DNA, 29 bp, Homo sapiens
ctctggacgcgagccgggcccttcccgtg

SEQ ID NO: 50635 - DNA, 30 bp, Homo sapiens
ctctggacgcgagccgggcccttcccgtgg

SEQ ID NO: 50636 - DNA, 16 bp, Homo sapiens
tctggacgcgagccgg

SEQ ID NO: 50637 - DNA, 17 bp, Homo sapiens
tctggacgcgagccggg

SEQ ID NO: 50638 - DNA, 18 bp, Homo sapiens
tctggacgcgagccgggc

SEQ ID NO: 50639 - DNA, 19 bp, Homo sapiens
tctggacgcgagccgggcc

SEQ ID NO: 50640 - DNA, 20 bp, Homo sapiens
tctggacgcgagccgggccc

SEQ ID NO: 50641 - DNA, 21 bp, Homo sapiens
tctggacgcgagccgggccct

SEQ ID NO: 50642 - DNA, 22 bp, Homo sapiens
tctggacgcgagccgggccctt

SEQ ID NO: 50643 - DNA, 23 bp, Homo sapiens
tctggacgcgagccgggcccttc

SEQ ID NO: 50644 - DNA, 24 bp, Homo sapiens
tctggacgcgagccgggcccttcc

SEQ ID NO: 50645 - DNA, 16 bp, Homo sapiens
ctggacgcgagccggg

SEQ ID NO: 50646 - DNA, 17 bp, Homo sapiens
ctggacgcgagccgggc

SEQ ID NO: 50647 - DNA, 18 bp, Homo sapiens
ctggacgcgagccgggcc

SEQ ID NO: 50648 - DNA, 19 bp, Homo sapiens
ctggacgcgagccgggccc

SEQ ID NO: 50649 - DNA, 20 bp, Homo sapiens
ctggacgcgagccgggccct

SEQ ID NO: 50650 - DNA, 21 bp, Homo sapiens
ctggacgcgagccgggccctt

SEQ ID NO: 50651 - DNA, 22 bp, Homo sapiens
ctggacgcgagccgggcccttc

SEQ ID NO: 50652 - DNA, 23 bp, Homo sapiens
ctggacgcgagccgggcccttcc

SEQ ID NO: 50653 - DNA, 24 bp, Homo sapiens
ctggacgcgagccgggcccttccc

SEQ ID NO: 50654 - DNA, 25 bp, Homo sapiens
ctggacgcgagccgggcccttcccg

SEQ ID NO: 50655 - DNA, 26 bp, Homo sapiens
ctggacgcgagccgggcccttcccgt

SEQ ID NO: 50656 - DNA, 28 bp, Homo sapiens
ctggacgcgagccgggcccttcccgtgg

SEQ ID NO: 50657 - DNA, 29 bp, Homo sapiens
ctggacgcgagccgggcccttcccgtgga

SEQ ID NO: 50658 - DNA, 16 bp, Homo sapiens
tggacgcgagccgggc

SEQ ID NO: 50659 - DNA, 17 bp, Homo sapiens
tggacgcgagccgggcc

SEQ ID NO: 50660 - DNA, 18 bp, Homo sapiens
tggacgcgagccgggccc

SEQ ID NO: 50661 - DNA, 19 bp, Homo sapiens
tggacgcgagccgggccct

SEQ ID NO: 50662 - DNA, 20 bp, Homo sapiens
tggacgcgagccgggccctt

SEQ ID NO: 50663 - DNA, 21 bp, Homo sapiens
tggacgcgagccgggcccttc

SEQ ID NO: 50664 - DNA, 22 bp, Homo sapiens
tggacgcgagccgggcccttcc

SEQ ID NO: 50665 - DNA, 16 bp, Homo sapiens
ggacgcgagccgggcc

SEQ ID NO: 50666 - DNA, 17 bp, Homo sapiens
ggacgcgagccgggccc

SEQ ID NO: 50667 - DNA, 18 bp, Homo sapiens
ggacgcgagccgggccct

SEQ ID NO: 50668 - DNA, 19 bp, Homo sapiens
ggacgcgagccgggccctt

SEQ ID NO: 50669 - DNA, 20 bp, Homo sapiens
ggacgcgagccgggcccttc

SEQ ID NO: 50670 - DNA, 21 bp, Homo sapiens
ggacgcgagccgggcccttcc

SEQ ID NO: 50671 - DNA, 22 bp, Homo sapiens
ggacgcgagccgggcccttccc

SEQ ID NO: 50672 - DNA, 23 bp, Homo sapiens
ggacgcgagccgggcccttcccg

SEQ ID NO: 50673 - DNA, 24 bp, Homo sapiens
ggacgcgagccgggcccttcccgt

SEQ ID NO: 50674 - DNA, 25 bp, Homo sapiens
ggacgcgagccgggcccttcccgtg

SEQ ID NO: 50675 - DNA, 26 bp, Homo sapiens
ggacgcgagccgggcccttcccgtgg

SEQ ID NO: 50676 - DNA, 27 bp, Homo sapiens
ggacgcgagccgggcccttcccgtgga

SEQ ID NO: 50677 - DNA, 28 bp, Homo sapiens
ggacgcgagccgggcccttcccgtggat

SEQ ID NO: 50678 - DNA, 29 bp, Homo sapiens
ggacgcgagccgggcccttcccgtggatc

SEQ ID NO: 50679 - DNA, 30 bp, Homo sapiens
ggacgcgagccgggcccttcccgtggatcg

SEQ ID NO: 50680 - DNA, 17 bp, Homo sapiens
gacgcgagccgggccct

SEQ ID NO: 50681 - DNA, 18 bp, Homo sapiens
gacgcgagccgggccctt

SEQ ID NO: 50682 - DNA, 19 bp, Homo sapiens
gacgcgagccgggcccttc

SEQ ID NO: 50683 - DNA, 20 bp, Homo sapiens
gacgcgagccgggcccttcc

SEQ ID NO: 50684 - DNA, 22 bp, Homo sapiens
gacgcgagccgggcccttcccg

SEQ ID NO: 50685 - DNA, 23 bp, Homo sapiens
gacgcgagccgggcccttcccgt

SEQ ID NO: 50686 - DNA, 18 bp, Homo sapiens
acgcgagccgggcccttc

SEQ ID NO: 50687 - DNA, 19 bp, Homo sapiens
acgcgagccgggcccttcc

SEQ ID NO: 50688 - DNA, 17 bp, Homo sapiens
cgcgagccgggcccttc

SEQ ID NO: 50689 - DNA, 18 bp, Homo sapiens
cgcgagccgggcccttcc

SEQ ID NO: 50690 - DNA, 19 bp, Homo sapiens
cgcgagccgggcccttccc

SEQ ID NO: 50691 - DNA, 16 bp, Homo sapiens
gcgagccgggcccttc

SEQ ID NO: 50692 - DNA, 17 bp, Homo sapiens
gcgagccgggcccttcc

SEQ ID NO: 50693 - DNA, 18 bp, Homo sapiens
gcgagccgggcccttccc

SEQ ID NO: 50694 - DNA, 19 bp, Homo sapiens
gcgagccgggcccttcccg

SEQ ID NO: 50695 - DNA, 20 bp, Homo sapiens
gcgagccgggcccttcccgt

SEQ ID NO: 50696 - DNA, 21 bp, Homo sapiens
gcgagccgggcccttcccgtg

SEQ ID NO: 50697 - DNA, 22 bp, Homo sapiens
gcgagccgggcccttcccgtgg

SEQ ID NO: 50698 - DNA, 23 bp, Homo sapiens
gcgagccgggcccttcccgtgga

SEQ ID NO: 50699 - DNA, 24 bp, Homo sapiens
gcgagccgggcccttcccgtggat

SEQ ID NO: 50700 - DNA, 25 bp, Homo sapiens
gcgagccgggcccttcccgtggatc

SEQ ID NO: 50701 - DNA, 26 bp, Homo sapiens
gcgagccgggcccttcccgtggatcg

SEQ ID NO: 50702 - DNA, 16 bp, Homo sapiens
cgagccgggcccttcc

SEQ ID NO: 50703 - DNA, 17 bp, Homo sapiens
cgagccgggcccttccc

SEQ ID NO: 50704 - DNA, 21 bp, Homo sapiens
cgagccgggcccttcccgtgg

SEQ ID NO: 50705 - DNA, 22 bp, Homo sapiens
cgagccgggcccttcccgtgga

SEQ ID NO: 50706 - DNA, 16 bp, Homo sapiens
gagccgggcccttccc

SEQ ID NO: 50707 - DNA, 19 bp, Homo sapiens
cgggcccttcccgtggatc

SEQ ID NO: 50708 - DNA, 20 bp, Homo sapiens
cgggcccttcccgtggatcg

SEQ ID NO: 50709 - DNA, 21 bp, Homo sapiens
cgggcccttcccgtggatcgc

SEQ ID NO: 50710 - DNA, 22 bp, Homo sapiens
cgggcccttcccgtggatcgcc

SEQ ID NO: 50711 - DNA, 17 bp, Homo sapiens
gggcccttcccgtggat

SEQ ID NO: 50712 - DNA, 18 bp, Homo sapiens
gggcccttcccgtggatc

SEQ ID NO: 50713 - DNA, 20 bp, Homo sapiens
gggcccttcccgtggatcgc

SEQ ID NO: 50714 - DNA, 21 bp, Homo sapiens
gggcccttcccgtggatcgcc

SEQ ID NO: 50715 - DNA, 22 bp, Homo sapiens
gggcccttcccgtggatcgccc

SEQ ID NO: 50716 - DNA, 19 bp, Homo sapiens
ggcccttcccgtggatcgc

SEQ ID NO: 50717 - DNA, 20 bp, Homo sapiens
ggcccttcccgtggatcgcc

SEQ ID NO: 50718 - DNA, 21 bp, Homo sapiens
ggcccttcccgtggatcgccc

SEQ ID NO: 50719 - DNA, 18 bp, Homo sapiens
gcccttcccgtggatcgc

SEQ ID NO: 50720 - DNA, 19 bp, Homo sapiens
gcccttcccgtggatcgcc

SEQ ID NO: 50721 - DNA, 20 bp, Homo sapiens
gcccttcccgtggatcgccc

SEQ ID NO: 50722 - DNA, 21 bp, Homo sapiens
gcccttcccgtggatcgcccc

SEQ ID NO: 50723 - DNA, 16 bp, Homo sapiens
cttcccgtggatcgcc

SEQ ID NO: 50724 - DNA, 17 bp, Homo sapiens
cttcccgtggatcgccc

SEQ ID NO: 50725 - DNA, 18 bp, Homo sapiens
cttcccgtggatcgcccc

SEQ ID NO: 50726 - DNA, 24 bp, Homo sapiens
cttcccgtggatcgccccagctgc

SEQ ID NO: 50727 - DNA, 16 bp, Homo sapiens
ttcccgtggatcgccc

SEQ ID NO: 50728 - DNA, 17 bp, Homo sapiens
ttcccgtggatcgcccc

SEQ ID NO: 50729 - DNA, 19 bp, Homo sapiens
ttcccgtggatcgccccag

SEQ ID NO: 50730 - DNA, 20 bp, Homo sapiens
ttcccgtggatcgccccagc

SEQ ID NO: 50731 - DNA, 23 bp, Homo sapiens
ttcccgtggatcgccccagctgc

SEQ ID NO: 50732 - DNA, 25 bp, Homo sapiens
ttcccgtggatcgccccagctgcgg

SEQ ID NO: 50733 - DNA, 16 bp, Homo sapiens
tcccgtggatcgcccc

SEQ ID NO: 50734 - DNA, 18 bp, Homo sapiens
tcccgtggatcgccccag

SEQ ID NO: 50735 - DNA, 19 bp, Homo sapiens
tcccgtggatcgccccagc

SEQ ID NO: 50736 - DNA, 20 bp, Homo sapiens
tcccgtggatcgccccagct

SEQ ID NO: 50737 - DNA, 21 bp, Homo sapiens
tcccgtggatcgccccagctg

SEQ ID NO: 50738 - DNA, 22 bp, Homo sapiens
tcccgtggatcgccccagctgc

SEQ ID NO: 50739 - DNA, 18 bp, Homo sapiens
cccgtggatcgccccagc

SEQ ID NO: 50740 - DNA, 19 bp, Homo sapiens
cccgtggatcgccccagct

SEQ ID NO: 50741 - DNA, 21 bp, Homo sapiens
cccgtggatcgccccagctgc

SEQ ID NO: 50742 - DNA, 23 bp, Homo sapiens
cccgtggatcgccccagctgcgg

SEQ ID NO: 50743 - DNA, 24 bp, Homo sapiens
cccgtggatcgccccagctgcggc

SEQ ID NO: 50744 - DNA, 17 bp, Homo sapiens
ccgtggatcgccccagc

SEQ ID NO: 50745 - DNA, 20 bp, Homo sapiens
ccgtggatcgccccagctgc

SEQ ID NO: 50746 - DNA, 22 bp, Homo sapiens
ccgtggatcgccccagctgcgg

SEQ ID NO: 50747 - DNA, 23 bp, Homo sapiens
ccgtggatcgccccagctgcggc

SEQ ID NO: 50748 - DNA, 16 bp, Homo sapiens
cgtggatcgccccagc

SEQ ID NO: 50749 - DNA, 19 bp, Homo sapiens
cgtggatcgccccagctgc

SEQ ID NO: 50750 - DNA, 20 bp, Homo sapiens
cgtggatcgccccagctgcg

SEQ ID NO: 50751 - DNA, 21 bp, Homo sapiens
cgtggatcgccccagctgcgg

SEQ ID NO: 50752 - DNA, 22 bp, Homo sapiens
cgtggatcgccccagctgcggc

SEQ ID NO: 50753 - DNA, 26 bp, Homo sapiens
cgtggatcgccccagctgcggcgggc

SEQ ID NO: 50754 - DNA, 18 bp, Homo sapiens
gtggatcgccccagctgc

SEQ ID NO: 50755 - DNA, 20 bp, Homo sapiens
gtggatcgccccagctgcgg

SEQ ID NO: 50756 - DNA, 21 bp, Homo sapiens
gtggatcgccccagctgcggc

SEQ ID NO: 50757 - DNA, 25 bp, Homo sapiens
gtggatcgccccagctgcggcgggc

SEQ ID NO: 50758 - DNA, 19 bp, Homo sapiens
tggatcgccccagctgcgg

SEQ ID NO: 50759 - DNA, 23 bp, Homo sapiens
tggatcgccccagctgcggcggg

SEQ ID NO: 50760 - DNA, 16 bp, Homo sapiens
ggatcgccccagctgc

SEQ ID NO: 50761 - DNA, 18 bp, Homo sapiens
ggatcgccccagctgcgg

SEQ ID NO: 50762 - DNA, 19 bp, Homo sapiens
ggatcgccccagctgcggc

SEQ ID NO: 50763 - DNA, 21 bp, Homo sapiens
ggatcgccccagctgcggcgg

SEQ ID NO: 50764 - DNA, 22 bp, Homo sapiens
ggatcgccccagctgcggcggg

SEQ ID NO: 50765 - DNA, 26 bp, Homo sapiens
ggatcgccccagctgcggcgggcgtc

SEQ ID NO: 50766 - DNA, 17 bp, Homo sapiens
gatcgccccagctgcgg

SEQ ID NO: 50767 - DNA, 18 bp, Homo sapiens
gatcgccccagctgcggc

SEQ ID NO: 50768 - DNA, 20 bp, Homo sapiens
gatcgccccagctgcggcgg

SEQ ID NO: 50769 - DNA, 25 bp, Homo sapiens
gatcgccccagctgcggcgggcgtc

SEQ ID NO: 50770 - DNA, 19 bp, Homo sapiens
atcgccccagctgcggcgg

SEQ ID NO: 50771 - DNA, 20 bp, Homo sapiens
atcgccccagctgcggcggg

SEQ ID NO: 50772 - DNA, 21 bp, Homo sapiens
tcgccccagctgcggcgggcg

SEQ ID NO: 50773 - DNA, 17 bp, Homo sapiens
cgccccagctgcggcgg

SEQ ID NO: 50774 - DNA, 18 bp, Homo sapiens
cgccccagctgcggcggg

SEQ ID NO: 50775 - DNA, 19 bp, Homo sapiens
cgccccagctgcggcgggc

SEQ ID NO: 50776 - DNA, 20 bp, Homo sapiens
cgccccagctgcggcgggcg

SEQ ID NO: 50777 - DNA, 25 bp, Homo sapiens
cgccccagctgcggcgggcgtcgcg

SEQ ID NO: 50778 - DNA, 26 bp, Homo sapiens
cgccccagctgcggcgggcgtcgcgg

SEQ ID NO: 50779 - DNA, 16 bp, Homo sapiens
gccccagctgcggcgg

SEQ ID NO: 50780 - DNA, 25 bp, Homo sapiens
gccccagctgcggcgggcgtcgcgg

SEQ ID NO: 50781 - DNA, 18 bp, Homo sapiens
ccccagctgcggcgggcg

SEQ ID NO: 50782 - DNA, 20 bp, Homo sapiens
ccccagctgcggcgggcgtc

SEQ ID NO: 50783 - DNA, 21 bp, Homo sapiens
ccccagctgcggcgggcgtcg

SEQ ID NO: 50784 - DNA, 22 bp, Homo sapiens
ccccagctgcggcgggcgtcgc

SEQ ID NO: 50785 - DNA, 23 bp, Homo sapiens
ccccagctgcggcgggcgtcgcg

SEQ ID NO: 50786 - DNA, 24 bp, Homo sapiens
ccccagctgcggcgggcgtcgcgg

SEQ ID NO: 50787 - DNA, 19 bp, Homo sapiens
ccagctgcggcgggcgtcg

SEQ ID NO: 50788 - DNA, 21 bp, Homo sapiens
agctgcggcgggcgtcgcggc

SEQ ID NO: 50789 - DNA, 20 bp, Homo sapiens
gctgcggcgggcgtcgcggc

SEQ ID NO: 50790 - DNA, 19 bp, Homo sapiens
ctgcggcgggcgtcgcggc

SEQ ID NO: 50791 - DNA, 23 bp, Homo sapiens
gcgggcgtcgcggccgcccccgg

SEQ ID NO: 50792 - DNA, 28 bp, Homo sapiens
gcgggcgtcgcggccgcccccggggagc

SEQ ID NO: 50793 - DNA, 30 bp, Homo sapiens
gcgggcgtcgcggccgcccccggggagccc

SEQ ID NO: 50794 - DNA, 22 bp, Homo sapiens
cgggcgtcgcggccgcccccgg

SEQ ID NO: 50795 - DNA, 24 bp, Homo sapiens
cgggcgtcgcggccgcccccgggg

SEQ ID NO: 50796 - DNA, 22 bp, Homo sapiens
gggcgtcgcggccgcccccggg

SEQ ID NO: 50797 - DNA, 23 bp, Homo sapiens
gggcgtcgcggccgcccccgggg

SEQ ID NO: 50798 - DNA, 20 bp, Homo sapiens
ggcgtcgcggccgcccccgg

SEQ ID NO: 50799 - DNA, 21 bp, Homo sapiens
ggcgtcgcggccgcccccggg

SEQ ID NO: 50800 - DNA, 22 bp, Homo sapiens
ggcgtcgcggccgcccccgggg

SEQ ID NO: 50801 - DNA, 23 bp, Homo sapiens
ggcgtcgcggccgcccccgggga

SEQ ID NO: 50802 - DNA, 26 bp, Homo sapiens
ggcgtcgcggccgcccccggggagcc

SEQ ID NO: 50803 - DNA, 19 bp, Homo sapiens
gcgtcgcggccgcccccgg

SEQ ID NO: 50804 - DNA, 20 bp, Homo sapiens
gcgtcgcggccgcccccggg

SEQ ID NO: 50805 - DNA, 22 bp, Homo sapiens
gcgtcgcggccgcccccgggga

SEQ ID NO: 50806 - DNA, 24 bp, Homo sapiens
gcgtcgcggccgcccccggggagc

SEQ ID NO: 50807 - DNA, 19 bp, Homo sapiens
cgtcgcggccgcccccggg

SEQ ID NO: 50808 - DNA, 20 bp, Homo sapiens
cgtcgcggccgcccccgggg

SEQ ID NO: 50809 - DNA, 21 bp, Homo sapiens
cgtcgcggccgcccccgggga

SEQ ID NO: 50810 - DNA, 16 bp, Homo sapiens
gtcgcggccgcccccg

SEQ ID NO: 50811 - DNA, 17 bp, Homo sapiens
gtcgcggccgcccccgg

SEQ ID NO: 50812 - DNA, 18 bp, Homo sapiens
gtcgcggccgcccccggg

SEQ ID NO: 50813 - DNA, 19 bp, Homo sapiens
gtcgcggccgcccccgggg

SEQ ID NO: 50814 - DNA, 20 bp, Homo sapiens
gtcgcggccgcccccgggga

SEQ ID NO: 50815 - DNA, 21 bp, Homo sapiens
gtcgcggccgcccccggggag

SEQ ID NO: 50816 - DNA, 22 bp, Homo sapiens
gtcgcggccgcccccggggagc

SEQ ID NO: 50817 - DNA, 23 bp, Homo sapiens
gtcgcggccgcccccggggagcc

SEQ ID NO: 50818 - DNA, 24 bp, Homo sapiens
gtcgcggccgcccccggggagccc

SEQ ID NO: 50819 - DNA, 27 bp, Homo sapiens
gtcgcggccgcccccggggagcccggc

SEQ ID NO: 50820 - DNA, 30 bp, Homo sapiens
gtcgcggccgcccccggggagcccggcggg

SEQ ID NO: 50821 - DNA, 21 bp, Homo sapiens
tcgcggccgcccccggggagc

SEQ ID NO: 50822 - DNA, 16 bp, Homo sapiens
cgcggccgcccccggg

SEQ ID NO: 50823 - DNA, 17 bp, Homo sapiens
cgcggccgcccccgggg

SEQ ID NO: 50824 - DNA, 18 bp, Homo sapiens
cgcggccgcccccgggga

SEQ ID NO: 50825 - DNA, 16 bp, Homo sapiens
gcggccgcccccgggg

SEQ ID NO: 50826 - DNA, 18 bp, Homo sapiens
gcggccgcccccggggag

SEQ ID NO: 50827 - DNA, 19 bp, Homo sapiens
gcggccgcccccggggagc

SEQ ID NO: 50828 - DNA, 20 bp, Homo sapiens
gcggccgcccccggggagcc

SEQ ID NO: 50829 - DNA, 24 bp, Homo sapiens
gcggccgcccccggggagcccggc

SEQ ID NO: 50830 - DNA, 25 bp, Homo sapiens
gcggccgcccccggggagcccggcg

SEQ ID NO: 50831 - DNA, 26 bp, Homo sapiens
cggccgcccccggggagcccggcggg

SEQ ID NO: 50832 - DNA, 17 bp, Homo sapiens
ggccgcccccggggagc

SEQ ID NO: 50833 - DNA, 18 bp, Homo sapiens
ggccgcccccggggagcc

SEQ ID NO: 50834 - DNA, 21 bp, Homo sapiens
ggccgcccccggggagcccgg

SEQ ID NO: 50835 - DNA, 24 bp, Homo sapiens
ggccgcccccggggagcccggcgg

SEQ ID NO: 50836 - DNA, 25 bp, Homo sapiens
ggccgcccccggggagcccggcggg

SEQ ID NO: 50837 - DNA, 19 bp, Homo sapiens
cgcccccggggagcccggc

SEQ ID NO: 50838 - DNA, 20 bp, Homo sapiens
cgcccccggggagcccggcg

SEQ ID NO: 50839 - DNA, 21 bp, Homo sapiens
cgcccccggggagcccggcgg

SEQ ID NO: 50840 - DNA, 22 bp, Homo sapiens
cgcccccggggagcccggcggg

SEQ ID NO: 50841 - DNA, 18 bp, Homo sapiens
gcccccggggagcccggc

SEQ ID NO: 50842 - DNA, 19 bp, Homo sapiens
gcccccggggagcccggcg

SEQ ID NO: 50843 - DNA, 20 bp, Homo sapiens
gcccccggggagcccggcgg

SEQ ID NO: 50844 - DNA, 19 bp, Homo sapiens
ccccggggagcccggcggg

SEQ ID NO: 50845 - DNA, 20 bp, Homo sapiens
ccccggggagcccggcgggc

SEQ ID NO: 50846 - DNA, 17 bp, Homo sapiens
cccggggagcccggcgg

SEQ ID NO: 50847 - DNA, 18 bp, Homo sapiens
cccggggagcccggcggg

SEQ ID NO: 50848 - DNA, 19 bp, Homo sapiens
cccggggagcccggcgggc

SEQ ID NO: 50849 - DNA, 20 bp, Homo sapiens
cccggggagcccggcgggcg

SEQ ID NO: 50850 - DNA, 21 bp, Homo sapiens
cccggggagcccggcgggcgc

SEQ ID NO: 50851 - DNA, 22 bp, Homo sapiens
cccggggagcccggcgggcgcc

SEQ ID NO: 50852 - DNA, 23 bp, Homo sapiens
cccggggagcccggcgggcgccg

SEQ ID NO: 50853 - DNA, 24 bp, Homo sapiens
cccggggagcccggcgggcgccgg

SEQ ID NO: 50854 - DNA, 25 bp, Homo sapiens
cccggggagcccggcgggcgccggc

SEQ ID NO: 50855 - DNA, 27 bp, Homo sapiens
cccggggagcccggcgggcgccggcgc

SEQ ID NO: 50856 - DNA, 17 bp, Homo sapiens
ccggggagcccggcggg

SEQ ID NO: 50857 - DNA, 18 bp, Homo sapiens
ccggggagcccggcgggc

SEQ ID NO: 50858 - DNA, 19 bp, Homo sapiens
ccggggagcccggcgggcg

SEQ ID NO: 50859 - DNA, 20 bp, Homo sapiens
ccggggagcccggcgggcgc

SEQ ID NO: 50860 - DNA, 21 bp, Homo sapiens
ccggggagcccggcgggcgcc

SEQ ID NO: 50861 - DNA, 16 bp, Homo sapiens
cggggagcccggcggg

SEQ ID NO: 50862 - DNA, 17 bp, Homo sapiens
cggggagcccggcgggc

SEQ ID NO: 50863 - DNA, 18 bp, Homo sapiens
cggggagcccggcgggcg

SEQ ID NO: 50864 - DNA, 19 bp, Homo sapiens
cggggagcccggcgggcgc

SEQ ID NO: 50865 - DNA, 20 bp, Homo sapiens
cggggagcccggcgggcgcc

SEQ ID NO: 50866 - DNA, 22 bp, Homo sapiens
cggggagcccggcgggcgccgg

SEQ ID NO: 50867 - DNA, 23 bp, Homo sapiens
cggggagcccggcgggcgccggc

SEQ ID NO: 50868 - DNA, 24 bp, Homo sapiens
cggggagcccggcgggcgccggcg

SEQ ID NO: 50869 - DNA, 25 bp, Homo sapiens
cggggagcccggcgggcgccggcgc

SEQ ID NO: 50870 - DNA, 16 bp, Homo sapiens
ggggagcccggcgggc

SEQ ID NO: 50871 - DNA, 17 bp, Homo sapiens
ggggagcccggcgggcg

SEQ ID NO: 50872 - DNA, 18 bp, Homo sapiens
ggggagcccggcgggcgc

SEQ ID NO: 50873 - DNA, 19 bp, Homo sapiens
ggggagcccggcgggcgcc

SEQ ID NO: 50874 - DNA, 22 bp, Homo sapiens
ggggagcccggcgggcgccggc

SEQ ID NO: 50875 - DNA, 23 bp, Homo sapiens
ggggagcccggcgggcgccggcg

SEQ ID NO: 50876 - DNA, 17 bp, Homo sapiens
gggagcccggcgggcgc

SEQ ID NO: 50877 - DNA, 18 bp, Homo sapiens
gggagcccggcgggcgcc

SEQ ID NO: 50878 - DNA, 21 bp, Homo sapiens
gggagcccggcgggcgccggc

SEQ ID NO: 50879 - DNA, 18 bp, Homo sapiens
cccggcgggcgccggcgc

SEQ ID NO: 50880 - DNA, 20 bp, Homo sapiens
cccggcgggcgccggcgcgc

SEQ ID NO: 50881 - DNA, 21 bp, Homo sapiens
cccggcgggcgccggcgcgcc

SEQ ID NO: 50882 - DNA, 20 bp, Homo sapiens
ccggcgggcgccggcgcgcc

SEQ ID NO: 50883 - DNA, 16 bp, Homo sapiens
cggcgggcgccggcgc

SEQ ID NO: 50884 - DNA, 18 bp, Homo sapiens
cggcgggcgccggcgcgc

SEQ ID NO: 50885 - DNA, 19 bp, Homo sapiens
cggcgggcgccggcgcgcc

SEQ ID NO: 50886 - DNA, 20 bp, Homo sapiens
ggcgggcgccggcgcgcccc

SEQ ID NO: 50887 - DNA, 17 bp, Homo sapiens
gccggcgcgcccccccc

SEQ ID NO: 50888 - DNA, 18 bp, Homo sapiens
gccggcgcgccccccccc

SEQ ID NO: 50889 - DNA, 25 bp, Homo sapiens
cccccccaccccacgtctcgtcgcg

SEQ ID NO: 50890 - DNA, 21 bp, Homo sapiens
ccccccaccccacgtctcgtc

SEQ ID NO: 50891 - DNA, 24 bp, Homo sapiens
ccccccaccccacgtctcgtcgcg

SEQ ID NO: 50892 - DNA, 20 bp, Homo sapiens
cccccaccccacgtctcgtc

SEQ ID NO: 50893 - DNA, 21 bp, Homo sapiens
cccccaccccacgtctcgtcg

SEQ ID NO: 50894 - DNA, 22 bp, Homo sapiens
cccccaccccacgtctcgtcgc

SEQ ID NO: 50895 - DNA, 23 bp, Homo sapiens
cccccaccccacgtctcgtcgcg

SEQ ID NO: 50896 - DNA, 24 bp, Homo sapiens
cccccaccccacgtctcgtcgcgc

SEQ ID NO: 50897 - DNA, 25 bp, Homo sapiens
cccccaccccacgtctcgtcgcgcg

SEQ ID NO: 50898 - DNA, 19 bp, Homo sapiens
ccccaccccacgtctcgtc

SEQ ID NO: 50899 - DNA, 20 bp, Homo sapiens
ccccaccccacgtctcgtcg

SEQ ID NO: 50900 - DNA, 21 bp, Homo sapiens
ccccaccccacgtctcgtcgc

SEQ ID NO: 50901 - DNA, 22 bp, Homo sapiens
ccccaccccacgtctcgtcgcg

SEQ ID NO: 50902 - DNA, 23 bp, Homo sapiens
ccccaccccacgtctcgtcgcgc

SEQ ID NO: 50903 - DNA, 24 bp, Homo sapiens
ccccaccccacgtctcgtcgcgcg

SEQ ID NO: 50904 - DNA, 26 bp, Homo sapiens
ccccaccccacgtctcgtcgcgcgcg

SEQ ID NO: 50905 - DNA, 18 bp, Homo sapiens
cccaccccacgtctcgtc

SEQ ID NO: 50906 - DNA, 19 bp, Homo sapiens
cccaccccacgtctcgtcg

SEQ ID NO: 50907 - DNA, 20 bp, Homo sapiens
cccaccccacgtctcgtcgc

SEQ ID NO: 50908 - DNA, 21 bp, Homo sapiens
cccaccccacgtctcgtcgcg

SEQ ID NO: 50909 - DNA, 22 bp, Homo sapiens
cccaccccacgtctcgtcgcgc

SEQ ID NO: 50910 - DNA, 23 bp, Homo sapiens
cccaccccacgtctcgtcgcgcg

SEQ ID NO: 50911 - DNA, 24 bp, Homo sapiens
cccaccccacgtctcgtcgcgcgc

SEQ ID NO: 50912 - DNA, 25 bp, Homo sapiens
cccaccccacgtctcgtcgcgcgcg

SEQ ID NO: 50913 - DNA, 17 bp, Homo sapiens
ccaccccacgtctcgtc

SEQ ID NO: 50914 - DNA, 18 bp, Homo sapiens
ccaccccacgtctcgtcg

SEQ ID NO: 50915 - DNA, 19 bp, Homo sapiens
ccaccccacgtctcgtcgc

SEQ ID NO: 50916 - DNA, 20 bp, Homo sapiens
ccaccccacgtctcgtcgcg

SEQ ID NO: 50917 - DNA, 21 bp, Homo sapiens
ccaccccacgtctcgtcgcgc

SEQ ID NO: 50918 - DNA, 22 bp, Homo sapiens
ccaccccacgtctcgtcgcgcg

SEQ ID NO: 50919 - DNA, 23 bp, Homo sapiens
ccaccccacgtctcgtcgcgcgc

SEQ ID NO: 50920 - DNA, 24 bp, Homo sapiens
ccaccccacgtctcgtcgcgcgcg

SEQ ID NO: 50921 - DNA, 25 bp, Homo sapiens
ccaccccacgtctcgtcgcgcgcgc

SEQ ID NO: 50922 - DNA, 26 bp, Homo sapiens
ccaccccacgtctcgtcgcgcgcgcg

SEQ ID NO: 50923 - DNA, 28 bp, Homo sapiens
ccaccccacgtctcgtcgcgcgcgcgtc

SEQ ID NO: 50924 - DNA, 29 bp, Homo sapiens
ccaccccacgtctcgtcgcgcgcgcgtcc

SEQ ID NO: 50925 - DNA, 30 bp, Homo sapiens
ccaccccacgtctcgtcgcgcgcgcgtccg

SEQ ID NO: 50926 - DNA, 16 bp, Homo sapiens
caccccacgtctcgtc

SEQ ID NO: 50927 - DNA, 17 bp, Homo sapiens
caccccacgtctcgtcg

SEQ ID NO: 50928 - DNA, 18 bp, Homo sapiens
caccccacgtctcgtcgc

SEQ ID NO: 50929 - DNA, 19 bp, Homo sapiens
caccccacgtctcgtcgcg

SEQ ID NO: 50930 - DNA, 20 bp, Homo sapiens
caccccacgtctcgtcgcgc

SEQ ID NO: 50931 - DNA, 21 bp, Homo sapiens
caccccacgtctcgtcgcgcg

SEQ ID NO: 50932 - DNA, 22 bp, Homo sapiens
caccccacgtctcgtcgcgcgc

SEQ ID NO: 50933 - DNA, 23 bp, Homo sapiens
caccccacgtctcgtcgcgcgcg

SEQ ID NO: 50934 - DNA, 24 bp, Homo sapiens
caccccacgtctcgtcgcgcgcgc

SEQ ID NO: 50935 - DNA, 25 bp, Homo sapiens
caccccacgtctcgtcgcgcgcgcg

SEQ ID NO: 50936 - DNA, 27 bp, Homo sapiens
caccccacgtctcgtcgcgcgcgcgtc

SEQ ID NO: 50937 - DNA, 30 bp, Homo sapiens
caccccacgtctcgtcgcgcgcgcgtccgc

SEQ ID NO: 50938 - DNA, 16 bp, Homo sapiens
accccacgtctcgtcg

SEQ ID NO: 50939 - DNA, 17 bp, Homo sapiens
accccacgtctcgtcgc

SEQ ID NO: 50940 - DNA, 18 bp, Homo sapiens
accccacgtctcgtcgcg

SEQ ID NO: 50941 - DNA, 19 bp, Homo sapiens
accccacgtctcgtcgcgc

SEQ ID NO: 50942 - DNA, 20 bp, Homo sapiens
accccacgtctcgtcgcgcg

SEQ ID NO: 50943 - DNA, 21 bp, Homo sapiens
accccacgtctcgtcgcgcgc

SEQ ID NO: 50944 - DNA, 22 bp, Homo sapiens
accccacgtctcgtcgcgcgcg

SEQ ID NO: 50945 - DNA, 23 bp, Homo sapiens
accccacgtctcgtcgcgcgcgc

SEQ ID NO: 50946 - DNA, 24 bp, Homo sapiens
accccacgtctcgtcgcgcgcgcg

SEQ ID NO: 50947 - DNA, 25 bp, Homo sapiens
accccacgtctcgtcgcgcgcgcgt

SEQ ID NO: 50948 - DNA, 26 bp, Homo sapiens
accccacgtctcgtcgcgcgcgcgtc

SEQ ID NO: 50949 - DNA, 27 bp, Homo sapiens
accccacgtctcgtcgcgcgcgcgtcc

SEQ ID NO: 50950 - DNA, 29 bp, Homo sapiens
accccacgtctcgtcgcgcgcgcgtccgc

SEQ ID NO: 50951 - DNA, 16 bp, Homo sapiens
ccccacgtctcgtcgc

SEQ ID NO: 50952 - DNA, 17 bp, Homo sapiens
ccccacgtctcgtcgcg

SEQ ID NO: 50953 - DNA, 18 bp, Homo sapiens
ccccacgtctcgtcgcgc

SEQ ID NO: 50954 - DNA, 19 bp, Homo sapiens
ccccacgtctcgtcgcgcg

SEQ ID NO: 50955 - DNA, 20 bp, Homo sapiens
ccccacgtctcgtcgcgcgc

SEQ ID NO: 50956 - DNA, 21 bp, Homo sapiens
ccccacgtctcgtcgcgcgcg

SEQ ID NO: 50957 - DNA, 22 bp, Homo sapiens
ccccacgtctcgtcgcgcgcgc

SEQ ID NO: 50958 - DNA, 23 bp, Homo sapiens
ccccacgtctcgtcgcgcgcgcg

SEQ ID NO: 50959 - DNA, 25 bp, Homo sapiens
ccccacgtctcgtcgcgcgcgcgtc

SEQ ID NO: 50960 - DNA, 29 bp, Homo sapiens
ccccacgtctcgtcgcgcgcgcgtccgct

SEQ ID NO: 50961 - DNA, 16 bp, Homo sapiens
cccacgtctcgtcgcg

SEQ ID NO: 50962 - DNA, 17 bp, Homo sapiens
cccacgtctcgtcgcgc

SEQ ID NO: 50963 - DNA, 18 bp, Homo sapiens
cccacgtctcgtcgcgcg

SEQ ID NO: 50964 - DNA, 19 bp, Homo sapiens
cccacgtctcgtcgcgcgc

SEQ ID NO: 50965 - DNA, 20 bp, Homo sapiens
cccacgtctcgtcgcgcgcg

SEQ ID NO: 50966 - DNA, 21 bp, Homo sapiens
cccacgtctcgtcgcgcgcgc

SEQ ID NO: 50967 - DNA, 22 bp, Homo sapiens
cccacgtctcgtcgcgcgcgcg

SEQ ID NO: 50968 - DNA, 24 bp, Homo sapiens
cccacgtctcgtcgcgcgcgcgtc

SEQ ID NO: 50969 - DNA, 25 bp, Homo sapiens
cccacgtctcgtcgcgcgcgcgtcc

SEQ ID NO: 50970 - DNA, 26 bp, Homo sapiens
cccacgtctcgtcgcgcgcgcgtccg

SEQ ID NO: 50971 - DNA, 27 bp, Homo sapiens
cccacgtctcgtcgcgcgcgcgtccgc

SEQ ID NO: 50972 - DNA, 28 bp, Homo sapiens
cccacgtctcgtcgcgcgcgcgtccgct

SEQ ID NO: 50973 - DNA, 16 bp, Homo sapiens
ccacgtctcgtcgcgc

SEQ ID NO: 50974 - DNA, 17 bp, Homo sapiens
ccacgtctcgtcgcgcg

SEQ ID NO: 50975 - DNA, 18 bp, Homo sapiens
ccacgtctcgtcgcgcgc

SEQ ID NO: 50976 - DNA, 19 bp, Homo sapiens
ccacgtctcgtcgcgcgcg

SEQ ID NO: 50977 - DNA, 20 bp, Homo sapiens
ccacgtctcgtcgcgcgcgc

SEQ ID NO: 50978 - DNA, 21 bp, Homo sapiens
ccacgtctcgtcgcgcgcgcg

SEQ ID NO: 50979 - DNA, 23 bp, Homo sapiens
ccacgtctcgtcgcgcgcgcgtc

SEQ ID NO: 50980 - DNA, 24 bp, Homo sapiens
ccacgtctcgtcgcgcgcgcgtcc

SEQ ID NO: 50981 - DNA, 25 bp, Homo sapiens
ccacgtctcgtcgcgcgcgcgtccg

SEQ ID NO: 50982 - DNA, 26 bp, Homo sapiens
ccacgtctcgtcgcgcgcgcgtccgc

SEQ ID NO: 50983 - DNA, 27 bp, Homo sapiens
ccacgtctcgtcgcgcgcgcgtccgct

SEQ ID NO: 50984 - DNA, 16 bp, Homo sapiens
cacgtctcgtcgcgcg

SEQ ID NO: 50985 - DNA, 17 bp, Homo sapiens
cacgtctcgtcgcgcgc

SEQ ID NO: 50986 - DNA, 18 bp, Homo sapiens
cacgtctcgtcgcgcgcg

SEQ ID NO: 50987 - DNA, 19 bp, Homo sapiens
cacgtctcgtcgcgcgcgc

SEQ ID NO: 50988 - DNA, 20 bp, Homo sapiens
cacgtctcgtcgcgcgcgcg

SEQ ID NO: 50989 - DNA, 22 bp, Homo sapiens
cacgtctcgtcgcgcgcgcgtc

SEQ ID NO: 50990 - DNA, 23 bp, Homo sapiens
cacgtctcgtcgcgcgcgcgtcc

SEQ ID NO: 50991 - DNA, 24 bp, Homo sapiens
cacgtctcgtcgcgcgcgcgtccg

SEQ ID NO: 50992 - DNA, 25 bp, Homo sapiens
cacgtctcgtcgcgcgcgcgtccgc

SEQ ID NO: 50993 - DNA, 26 bp, Homo sapiens
cacgtctcgtcgcgcgcgcgtccgct

SEQ ID NO: 50994 - DNA, 27 bp, Homo sapiens
cacgtctcgtcgcgcgcgcgtccgctg

SEQ ID NO: 50995 - DNA, 16 bp, Homo sapiens
acgtctcgtcgcgcgc

SEQ ID NO: 50996 - DNA, 17 bp, Homo sapiens
acgtctcgtcgcgcgcg

SEQ ID NO: 50997 - DNA, 18 bp, Homo sapiens
acgtctcgtcgcgcgcgc

SEQ ID NO: 50998 - DNA, 19 bp, Homo sapiens
acgtctcgtcgcgcgcgcg

SEQ ID NO: 50999 - DNA, 20 bp, Homo sapiens
acgtctcgtcgcgcgcgcgt

SEQ ID NO: 51000 - DNA, 21 bp, Homo sapiens
acgtctcgtcgcgcgcgcgtc

SEQ ID NO: 51001 - DNA, 22 bp, Homo sapiens
acgtctcgtcgcgcgcgcgtcc

SEQ ID NO: 51002 - DNA, 23 bp, Homo sapiens
acgtctcgtcgcgcgcgcgtccg

SEQ ID NO: 51003 - DNA, 24 bp, Homo sapiens
acgtctcgtcgcgcgcgcgtccgc

SEQ ID NO: 51004 - DNA, 25 bp, Homo sapiens
acgtctcgtcgcgcgcgcgtccgct

SEQ ID NO: 51005 - DNA, 26 bp, Homo sapiens
acgtctcgtcgcgcgcgcgtccgctg

SEQ ID NO: 51006 - DNA, 16 bp, Homo sapiens
cgtctcgtcgcgcgcg

SEQ ID NO: 51007 - DNA, 17 bp, Homo sapiens
cgtctcgtcgcgcgcgc

SEQ ID NO: 51008 - DNA, 18 bp, Homo sapiens
cgtctcgtcgcgcgcgcg

SEQ ID NO: 51009 - DNA, 19 bp, Homo sapiens
cgtctcgtcgcgcgcgcgt

SEQ ID NO: 51010 - DNA, 20 bp, Homo sapiens
cgtctcgtcgcgcgcgcgtc

SEQ ID NO: 51011 - DNA, 21 bp, Homo sapiens
cgtctcgtcgcgcgcgcgtcc

SEQ ID NO: 51012 - DNA, 22 bp, Homo sapiens
cgtctcgtcgcgcgcgcgtccg

SEQ ID NO: 51013 - DNA, 23 bp, Homo sapiens
cgtctcgtcgcgcgcgcgtccgc

SEQ ID NO: 51014 - DNA, 24 bp, Homo sapiens
cgtctcgtcgcgcgcgcgtccgct

SEQ ID NO: 51015 - DNA, 25 bp, Homo sapiens
cgtctcgtcgcgcgcgcgtccgctg

SEQ ID NO: 51016 - DNA, 26 bp, Homo sapiens
cgtctcgtcgcgcgcgcgtccgctgg

SEQ ID NO: 51017 - DNA, 30 bp, Homo sapiens; identical to SEQ ID NO: 24525

SEQ ID NO: 51018 - DNA, 16 bp, Homo sapiens
gtctcgtcgcgcgcgc

SEQ ID NO: 51019 - DNA, 17 bp, Homo sapiens
gtctcgtcgcgcgcgcg

SEQ ID NO: 51020 - DNA, 18 bp, Homo sapiens
gtctcgtcgcgcgcgcgt

SEQ ID NO: 51021 - DNA, 19 bp, Homo sapiens
gtctcgtcgcgcgcgcgtc

SEQ ID NO: 51022 - DNA, 20 bp, Homo sapiens
gtctcgtcgcgcgcgcgtcc

SEQ ID NO: 51023 - DNA, 21 bp, Homo sapiens
gtctcgtcgcgcgcgcgtccg

SEQ ID NO: 51024 - DNA, 22 bp, Homo sapiens
gtctcgtcgcgcgcgcgtccgc

SEQ ID NO: 51025 - DNA, 23 bp, Homo sapiens
gtctcgtcgcgcgcgcgtccgct

SEQ ID NO: 51026 - DNA, 24 bp, Homo sapiens
gtctcgtcgcgcgcgcgtccgctg

SEQ ID NO: 51027 - DNA, 25 bp, Homo sapiens
gtctcgtcgcgcgcgcgtccgctgg

SEQ ID NO: 51028 - DNA, 30 bp, Homo sapiens
gtctcgtcgcgcgcgcgtccgctgggggcg

SEQ ID NO: 51029 - DNA, 16 bp, Homo sapiens
tctcgtcgcgcgcgcg

SEQ ID NO: 51030 - DNA, 18 bp, Homo sapiens
tctcgtcgcgcgcgcgtc

SEQ ID NO: 51031 - DNA, 19 bp, Homo sapiens
tctcgtcgcgcgcgcgtcc

SEQ ID NO: 51032 - DNA, 20 bp, Homo sapiens
tctcgtcgcgcgcgcgtccg

SEQ ID NO: 51033 - DNA, 21 bp, Homo sapiens
tctcgtcgcgcgcgcgtccgc

SEQ ID NO: 51034 - DNA, 22 bp, Homo sapiens
tctcgtcgcgcgcgcgtccgct

SEQ ID NO: 51035 - DNA, 23 bp, Homo sapiens
tctcgtcgcgcgcgcgtccgctg

SEQ ID NO: 51036 - DNA, 24 bp, Homo sapiens
tctcgtcgcgcgcgcgtccgctgg

SEQ ID NO: 51037 - DNA, 17 bp, Homo sapiens
ctcgtcgcgcgcgcgtc

SEQ ID NO: 51038 - DNA, 18 bp, Homo sapiens
ctcgtcgcgcgcgcgtcc

SEQ ID NO: 51039 - DNA, 19 bp, Homo sapiens
ctcgtcgcgcgcgcgtccg

SEQ ID NO: 51040 - DNA, 20 bp, Homo sapiens
ctcgtcgcgcgcgcgtccgc

SEQ ID NO: 51041 - DNA, 21 bp, Homo sapiens
ctcgtcgcgcgcgcgtccgct

SEQ ID NO: 51042 - DNA, 23 bp, Homo sapiens
ctcgtcgcgcgcgcgtccgctgg

SEQ ID NO: 51043 - DNA, 27 bp, Homo sapiens
ctcgtcgcgcgcgcgtccgctgggggc

SEQ ID NO: 51044 - DNA, 16 bp, Homo sapiens
tcgtcgcgcgcgcgtc

SEQ ID NO: 51045 - DNA, 17 bp, Homo sapiens
tcgtcgcgcgcgcgtcc

SEQ ID NO: 51046 - DNA, 18 bp, Homo sapiens
tcgtcgcgcgcgcgtccg

SEQ ID NO: 51047 - DNA, 19 bp, Homo sapiens
tcgtcgcgcgcgcgtccgc

SEQ ID NO: 51048 - DNA, 20 bp, Homo sapiens
tcgtcgcgcgcgcgtccgct

SEQ ID NO: 51049 - DNA, 21 bp, Homo sapiens
tcgtcgcgcgcgcgtccgctg

SEQ ID NO: 51050 - DNA, 22 bp, Homo sapiens
tcgtcgcgcgcgcgtccgctgg

SEQ ID NO: 51051 - DNA, 23 bp, Homo sapiens
tcgtcgcgcgcgcgtccgctggg

SEQ ID NO: 51052 - DNA, 24 bp, Homo sapiens
tcgtcgcgcgcgcgtccgctgggg

SEQ ID NO: 51053 - DNA, 25 bp, Homo sapiens
tcgtcgcgcgcgcgtccgctggggg

SEQ ID NO: 51054 - DNA, 16 bp, Homo sapiens
cgtcgcgcgcgcgtcc

SEQ ID NO: 51055 - DNA, 17 bp, Homo sapiens
cgtcgcgcgcgcgtccg

SEQ ID NO: 51056 - DNA, 18 bp, Homo sapiens
cgtcgcgcgcgcgtccgc

SEQ ID NO: 51057 - DNA, 19 bp, Homo sapiens
cgtcgcgcgcgcgtccgct

SEQ ID NO: 51058 - DNA, 20 bp, Homo sapiens
cgtcgcgcgcgcgtccgctg

SEQ ID NO: 51059 - DNA, 22 bp, Homo sapiens
cgtcgcgcgcgcgtccgctggg

SEQ ID NO: 51060 - DNA, 23 bp, Homo sapiens
cgtcgcgcgcgcgtccgctgggg

SEQ ID NO: 51061 - DNA, 24 bp, Homo sapiens
cgtcgcgcgcgcgtccgctggggg

SEQ ID NO: 51062 - DNA, 25 bp, Homo sapiens
cgtcgcgcgcgcgtccgctgggggc

SEQ ID NO: 51063 - DNA, 16 bp, Homo sapiens
gtcgcgcgcgcgtccg

SEQ ID NO: 51064 - DNA, 17 bp, Homo sapiens
gtcgcgcgcgcgtccgc

SEQ ID NO: 51065 - DNA, 18 bp, Homo sapiens
gtcgcgcgcgcgtccgct

SEQ ID NO: 51066 - DNA, 19 bp, Homo sapiens
gtcgcgcgcgcgtccgctg

SEQ ID NO: 51067 - DNA, 20 bp, Homo sapiens
gtcgcgcgcgcgtccgctgg

SEQ ID NO: 51068 - DNA, 21 bp, Homo sapiens
gtcgcgcgcgcgtccgctggg

SEQ ID NO: 51069 - DNA, 22 bp, Homo sapiens
gtcgcgcgcgcgtccgctgggg

SEQ ID NO: 51070 - DNA, 23 bp, Homo sapiens
gtcgcgcgcgcgtccgctggggg

SEQ ID NO: 51071 - DNA, 24 bp, Homo sapiens
gtcgcgcgcgcgtccgctgggggc

SEQ ID NO: 51072 - DNA, 26 bp, Homo sapiens
gtcgcgcgcgcgtccgctgggggcgg

SEQ ID NO: 51073 - DNA, 27 bp, Homo sapiens
gtcgcgcgcgcgtccgctgggggcggg

SEQ ID NO: 51074 - DNA, 30 bp, Homo sapiens
gtcgcgcgcgcgtccgctgggggcggggag

SEQ ID NO: 51075 - DNA, 21 bp, Homo sapiens
gcgcgcgcgtccgctgggggc

SEQ ID NO: 51076 - DNA, 22 bp, Homo sapiens
gcgcgcgcgtccgctgggggcg

SEQ ID NO: 51077 - DNA, 23 bp, Homo sapiens
gcgcgcgcgtccgctgggggcgg

SEQ ID NO: 51078 - DNA, 24 bp, Homo sapiens
gcgcgcgcgtccgctgggggcggg

SEQ ID NO: 51079 - DNA, 30 bp, Homo sapiens
gcgcgcgcgtccgctgggggcggggagcgg

SEQ ID NO: 51080 - DNA, 20 bp, Homo sapiens
gcgcgcgtccgctgggggcg

SEQ ID NO: 51081 - DNA, 21 bp, Homo sapiens
gcgcgcgtccgctgggggcgg

SEQ ID NO: 51082 - DNA, 16 bp, Homo sapiens
cgcgcgtccgctgggg

SEQ ID NO: 51083 - DNA, 17 bp, Homo sapiens
cgcgcgtccgctggggg

SEQ ID NO: 51084 - DNA, 18 bp, Homo sapiens
cgcgcgtccgctgggggc

SEQ ID NO: 51085 - DNA, 19 bp, Homo sapiens
cgcgcgtccgctgggggcg

SEQ ID NO: 51086 - DNA, 20 bp, Homo sapiens
cgcgcgtccgctgggggcgg

SEQ ID NO: 51087 - DNA, 21 bp, Homo sapiens
cgcgcgtccgctgggggcggg

SEQ ID NO: 51088 - DNA, 25 bp, Homo sapiens
cgcgcgtccgctgggggcggggagc

SEQ ID NO: 51089 - DNA, 26 bp, Homo sapiens
cgcgcgtccgctgggggcggggagcg

SEQ ID NO: 51090 - DNA, 30 bp, Homo sapiens
cgcgcgtccgctgggggcggggagcggtcg

SEQ ID NO: 51091 - DNA, 18 bp, Homo sapiens
gcgcgtccgctgggggcg

SEQ ID NO: 51092 - DNA, 19 bp, Homo sapiens
gcgcgtccgctgggggcgg

SEQ ID NO: 51093 - DNA, 20 bp, Homo sapiens
gcgcgtccgctgggggcggg

SEQ ID NO: 51094 - DNA, 24 bp, Homo sapiens
gcgcgtccgctgggggcggggagc

SEQ ID NO: 51095 - DNA, 29 bp, Homo sapiens
gcgcgtccgctgggggcggggagcggtcg

SEQ ID NO: 51096 - DNA, 17 bp, Homo sapiens
cgcgtccgctgggggcg

SEQ ID NO: 51097 - DNA, 18 bp, Homo sapiens
cgcgtccgctgggggcgg

SEQ ID NO: 51098 - DNA, 19 bp, Homo sapiens
cgcgtccgctgggggcggg

SEQ ID NO: 51099 - DNA, 23 bp, Homo sapiens
cgcgtccgctgggggcggggagc

SEQ ID NO: 51100 - DNA, 28 bp, Homo sapiens
cgcgtccgctgggggcggggagcggtcg

SEQ ID NO: 51101 - DNA, 18 bp, Homo sapiens
gcgtccgctgggggcggg

SEQ ID NO: 51102 - DNA, 22 bp, Homo sapiens
gcgtccgctgggggcggggagc

SEQ ID NO: 51103 - DNA, 17 bp, Homo sapiens
cgtccgctgggggcggg

SEQ ID NO: 51104 - DNA, 21 bp, Homo sapiens
cgtccgctgggggcggggagc

SEQ ID NO: 51105 - DNA, 22 bp, Homo sapiens
cgtccgctgggggcggggagcg

SEQ ID NO: 51106 - DNA, 26 bp, Homo sapiens
cgtccgctgggggcggggagcggtcg

SEQ ID NO: 51107 - DNA, 20 bp, Homo sapiens
gtccgctgggggcggggagc

SEQ ID NO: 51108 - DNA, 21 bp, Homo sapiens
gtccgctgggggcggggagcg

SEQ ID NO: 51109 - DNA, 25 bp, Homo sapiens
gtccgctgggggcggggagcggtcg

SEQ ID NO: 51110 - DNA, 24 bp, Homo sapiens
tccgctgggggcggggagcggtcg

SEQ ID NO: 51111 - DNA, 22 bp, Homo sapiens
cgctgggggcggggagcggtcg

SEQ ID NO: 51112 - DNA, 23 bp, Homo sapiens
cgctgggggcggggagcggtcgg

SEQ ID NO: 51113 - DNA, 16 bp, Homo sapiens
gctgggggcggggagc

SEQ ID NO: 51114 - DNA, 17 bp, Homo sapiens
gctgggggcggggagcg

SEQ ID NO: 51115 - DNA, 19 bp, Homo sapiens
gctgggggcggggagcggt

SEQ ID NO: 51116 - DNA, 20 bp, Homo sapiens
gctgggggcggggagcggtc

SEQ ID NO: 51117 - DNA, 21 bp, Homo sapiens
gctgggggcggggagcggtcg

SEQ ID NO: 51118 - DNA, 22 bp, Homo sapiens
gctgggggcggggagcggtcgg

SEQ ID NO: 51119 - DNA, 23 bp, Homo sapiens
gctgggggcggggagcggtcggg

SEQ ID NO: 51120 - DNA, 27 bp, Homo sapiens
gctgggggcggggagcggtcgggcggc

SEQ ID NO: 51121 - DNA, 30 bp, Homo sapiens
gctgggggcggggagcggtcgggcggcggc

SEQ ID NO: 51122 - DNA, 16 bp, Homo sapiens
ctgggggcggggagcg

SEQ ID NO: 51123 - DNA, 19 bp, Homo sapiens
ctgggggcggggagcggtc

SEQ ID NO: 51124 - DNA, 20 bp, Homo sapiens
ctgggggcggggagcggtcg

SEQ ID NO: 51125 - DNA, 21 bp, Homo sapiens
ctgggggcggggagcggtcgg

SEQ ID NO: 51126 - DNA, 22 bp, Homo sapiens
ctgggggcggggagcggtcggg

SEQ ID NO: 51127 - DNA, 23 bp, Homo sapiens
ctgggggcggggagcggtcgggc

SEQ ID NO: 51128 - DNA, 24 bp, Homo sapiens
ctgggggcggggagcggtcgggcg

SEQ ID NO: 51129 - DNA, 25 bp, Homo sapiens
ctgggggcggggagcggtcgggcgg

SEQ ID NO: 51130 - DNA, 16 bp, Homo sapiens
tgggggcggggagcgg

SEQ ID NO: 51131 - DNA, 17 bp, Homo sapiens
tgggggcggggagcggt

SEQ ID NO: 51132 - DNA, 18 bp, Homo sapiens
tgggggcggggagcggtc

SEQ ID NO: 51133 - DNA, 19 bp, Homo sapiens
tgggggcggggagcggtcg

SEQ ID NO: 51134 - DNA, 20 bp, Homo sapiens
tgggggcggggagcggtcgg

SEQ ID NO: 51135 - DNA, 21 bp, Homo sapiens
tgggggcggggagcggtcggg

SEQ ID NO: 51136 - DNA, 22 bp, Homo sapiens
tgggggcggggagcggtcgggc

SEQ ID NO: 51137 - DNA, 23 bp, Homo sapiens
tgggggcggggagcggtcgggcg

SEQ ID NO: 51138 - DNA, 24 bp, Homo sapiens
tgggggcggggagcggtcgggcgg

SEQ ID NO: 51139 - DNA, 25 bp, Homo sapiens
tgggggcggggagcggtcgggcggc

SEQ ID NO: 51140 - DNA, 16 bp, Homo sapiens
gggggcggggagcggt

SEQ ID NO: 51141 - DNA, 17 bp, Homo sapiens
gggggcggggagcggtc

SEQ ID NO: 51142 - DNA, 18 bp, Homo sapiens
gggggcggggagcggtcg

SEQ ID NO: 51143 - DNA, 19 bp, Homo sapiens
gggggcggggagcggtcgg

SEQ ID NO: 51144 - DNA, 20 bp, Homo sapiens
gggggcggggagcggtcggg

SEQ ID NO: 51145 - DNA, 21 bp, Homo sapiens
gggggcggggagcggtcgggc

SEQ ID NO: 51146 - DNA, 22 bp, Homo sapiens
gggggcggggagcggtcgggcg

SEQ ID NO: 51147 - DNA, 23 bp, Homo sapiens
gggggcggggagcggtcgggcgg

SEQ ID NO: 51148 - DNA, 24 bp, Homo sapiens
gggggcggggagcggtcgggcggc

SEQ ID NO: 51149 - DNA, 25 bp, Homo sapiens
gggggcggggagcggtcgggcggcg

SEQ ID NO: 51150 - DNA, 26 bp, Homo sapiens
gggggcggggagcggtcgggcggcgg

SEQ ID NO: 51151 - DNA, 27 bp, Homo sapiens
gggggcggggagcggtcgggcggcggc

SEQ ID NO: 51152 - DNA, 28 bp, Homo sapiens
gggggcggggagcggtcgggcggcggcg

SEQ ID NO: 51153 - DNA, 29 bp, Homo sapiens
gggggcggggagcggtcgggcggcggcgg

SEQ ID NO: 51154 - DNA, 30 bp, Homo sapiens
gggggcggggagcggtcgggcggcggcggt

SEQ ID NO: 51155 - DNA, 17 bp, Homo sapiens
ggggcggggagcggtcg

SEQ ID NO: 51156 - DNA, 18 bp, Homo sapiens
ggggcggggagcggtcgg

SEQ ID NO: 51157 - DNA, 19 bp, Homo sapiens
ggggcggggagcggtcggg

SEQ ID NO: 51158 - DNA, 20 bp, Homo sapiens
ggggcggggagcggtcgggc

SEQ ID NO: 51159 - DNA, 21 bp, Homo sapiens
ggggcggggagcggtcgggcg

SEQ ID NO: 51160 - DNA, 22 bp, Homo sapiens
ggggcggggagcggtcgggcgg

SEQ ID NO: 51161 - DNA, 23 bp, Homo sapiens
ggggcggggagcggtcgggcggc

SEQ ID NO: 51162 - DNA, 24 bp, Homo sapiens
ggggcggggagcggtcgggcggcg

SEQ ID NO: 51163 - DNA, 26 bp, Homo sapiens
ggggcggggagcggtcgggcggcggc

SEQ ID NO: 51164 - DNA, 27 bp, Homo sapiens
ggggcggggagcggtcgggcggcggcg

SEQ ID NO: 51165 - DNA, 28 bp, Homo sapiens
ggggcggggagcggtcgggcggcggcgg

SEQ ID NO: 51166 - DNA, 30 bp, Homo sapiens
ggggcggggagcggtcgggcggcggcggtc

SEQ ID NO: 51167 - DNA, 25 bp, Homo sapiens
gggcggggagcggtcgggcggcggc

SEQ ID NO: 51168 - DNA, 24 bp, Homo sapiens
ggcggggagcggtcgggcggcggc

SEQ ID NO: 51169 - DNA, 23 bp, Homo sapiens
gcggggagcggtcgggcggcggc

SEQ ID NO: 51170 - DNA, 19 bp, Homo sapiens
cggggagcggtcgggcggc

SEQ ID NO: 51171 - DNA, 20 bp, Homo sapiens
cggggagcggtcgggcggcg

SEQ ID NO: 51172 - DNA, 21 bp, Homo sapiens
cggggagcggtcgggcggcgg

SEQ ID NO: 51173 - DNA, 22 bp, Homo sapiens
cggggagcggtcgggcggcggc

SEQ ID NO: 51174 - DNA, 23 bp, Homo sapiens
cggggagcggtcgggcggcggcg

SEQ ID NO: 51175 - DNA, 29 bp, Homo sapiens
cggggagcggtcgggcggcggcggtcggc

SEQ ID NO: 51176 - DNA, 16 bp, Homo sapiens
ggggagcggtcgggcg

SEQ ID NO: 51177 - DNA, 17 bp, Homo sapiens
ggggagcggtcgggcgg

SEQ ID NO: 51178 - DNA, 18 bp, Homo sapiens
ggggagcggtcgggcggc

SEQ ID NO: 51179 - DNA, 19 bp, Homo sapiens
ggggagcggtcgggcggcg

SEQ ID NO: 51180 - DNA, 20 bp, Homo sapiens
ggggagcggtcgggcggcgg

SEQ ID NO: 51181 - DNA, 21 bp, Homo sapiens
ggggagcggtcgggcggcggc

SEQ ID NO: 51182 - DNA, 27 bp, Homo sapiens
ggggagcggtcgggcggcggcggtcgg

SEQ ID NO: 51183 - DNA, 28 bp, Homo sapiens
ggggagcggtcgggcggcggcggtcggc

SEQ ID NO: 51184 - DNA, 30 bp, Homo sapiens
ggggagcggtcgggcggcggcggtcggcgg

SEQ ID NO: 51185 - DNA, 16 bp, Homo sapiens
gggagcggtcgggcgg

SEQ ID NO: 51186 - DNA, 17 bp, Homo sapiens
gggagcggtcgggcggc

SEQ ID NO: 51187 - DNA, 18 bp, Homo sapiens
gggagcggtcgggcggcg

SEQ ID NO: 51188 - DNA, 19 bp, Homo sapiens
gggagcggtcgggcggcgg

SEQ ID NO: 51189 - DNA, 20 bp, Homo sapiens
gggagcggtcgggcggcggc

SEQ ID NO: 51190 - DNA, 21 bp, Homo sapiens
gggagcggtcgggcggcggcg

SEQ ID NO: 51191 - DNA, 22 bp, Homo sapiens
gggagcggtcgggcggcggcgg

SEQ ID NO: 51192 - DNA, 23 bp, Homo sapiens
gggagcggtcgggcggcggcggt

SEQ ID NO: 51193 - DNA, 24 bp, Homo sapiens
gggagcggtcgggcggcggcggtc

SEQ ID NO: 51194 - DNA, 26 bp, Homo sapiens
gggagcggtcgggcggcggcggtcgg

SEQ ID NO: 51195 - DNA, 27 bp, Homo sapiens
gggagcggtcgggcggcggcggtcggc

SEQ ID NO: 51196 - DNA, 28 bp, Homo sapiens
gggagcggtcgggcggcggcggtcggcg

SEQ ID NO: 51197 - DNA, 29 bp, Homo sapiens
gggagcggtcgggcggcggcggtcggcgg

SEQ ID NO: 51198 - DNA, 30 bp, Homo sapiens
gggagcggtcgggcggcggcggtcggcggg

SEQ ID NO: 51199 - DNA, 18 bp, Homo sapiens
ggagcggtcgggcggcgg

SEQ ID NO: 51200 - DNA, 19 bp, Homo sapiens
ggagcggtcgggcggcggc

SEQ ID NO: 51201 - DNA, 20 bp, Homo sapiens
ggagcggtcgggcggcggcg

SEQ ID NO: 51202 - DNA, 21 bp, Homo sapiens
ggagcggtcgggcggcggcgg

SEQ ID NO: 51203 - DNA, 23 bp, Homo sapiens
ggagcggtcgggcggcggcggtc

SEQ ID NO: 51204 - DNA, 25 bp, Homo sapiens
ggagcggtcgggcggcggcggtcgg

SEQ ID NO: 51205 - DNA, 26 bp, Homo sapiens
ggagcggtcgggcggcggcggtcggc

SEQ ID NO: 51206 - DNA, 27 bp, Homo sapiens
ggagcggtcgggcggcggcggtcggcg

SEQ ID NO: 51207 - DNA, 28 bp, Homo sapiens
ggagcggtcgggcggcggcggtcggcgg

SEQ ID NO: 51208 - DNA, 29 bp, Homo sapiens
ggagcggtcgggcggcggcggtcggcggg

SEQ ID NO: 51209 - DNA, 30 bp, Homo sapiens
ggagcggtcgggcggcggcggtcggcgggc

SEQ ID NO: 51210 - DNA, 17 bp, Homo sapiens
gagcggtcgggcggcgg

SEQ ID NO: 51211 - DNA, 18 bp, Homo sapiens
gagcggtcgggcggcggc

SEQ ID NO: 51212 - DNA, 19 bp, Homo sapiens
gagcggtcgggcggcggcg

SEQ ID NO: 51213 - DNA, 20 bp, Homo sapiens
gagcggtcgggcggcggcgg

SEQ ID NO: 51214 - DNA, 22 bp, Homo sapiens
gagcggtcgggcggcggcggtc

SEQ ID NO: 51215 - DNA, 25 bp, Homo sapiens
gagcggtcgggcggcggcggtcggc

SEQ ID NO: 51216 - DNA, 26 bp, Homo sapiens
gagcggtcgggcggcggcggtcggcg

SEQ ID NO: 51217 - DNA, 27 bp, Homo sapiens
gagcggtcgggcggcggcggtcggcgg

SEQ ID NO: 51218 - DNA, 28 bp, Homo sapiens
gagcggtcgggcggcggcggtcggcggg

SEQ ID NO: 51219 - DNA, 29 bp, Homo sapiens
gagcggtcgggcggcggcggtcggcgggc

SEQ ID NO: 51220 - DNA, 30 bp, Homo sapiens; identical to SEQ ID NO: 24545

SEQ ID NO: 51221 - DNA, 17 bp, Homo sapiens
agcggtcgggcggcggc

SEQ ID NO: 51222 - DNA, 21 bp, Homo sapiens
agcggtcgggcggcggcggtc

SEQ ID NO: 51223 - DNA, 24 bp, Homo sapiens
agcggtcgggcggcggcggtcggc

SEQ ID NO: 51224 - DNA, 25 bp, Homo sapiens
agcggtcgggcggcggcggtcggcg

SEQ ID NO: 51225 - DNA, 30 bp, Homo sapiens
agcggtcgggcggcggcggtcggcgggcgg

SEQ ID NO: 51226 - DNA, 16 bp, Homo sapiens
gcggtcgggcggcggc

SEQ ID NO: 51227 - DNA, 18 bp, Homo sapiens
gcggtcgggcggcggcgg

SEQ ID NO: 51228 - DNA, 20 bp, Homo sapiens
gcggtcgggcggcggcggtc

SEQ ID NO: 51229 - DNA, 22 bp, Homo sapiens
gcggtcgggcggcggcggtcgg

SEQ ID NO: 51230 - DNA, 23 bp, Homo sapiens
gcggtcgggcggcggcggtcggc

SEQ ID NO: 51231 - DNA, 21 bp, Homo sapiens
cggtcgggcggcggcggtcgg

SEQ ID NO: 51232 - DNA, 22 bp, Homo sapiens
cggtcgggcggcggcggtcggc

SEQ ID NO: 51233 - DNA, 23 bp, Homo sapiens
cggtcgggcggcggcggtcggcg

SEQ ID NO: 51234 - DNA, 16 bp, Homo sapiens
ggtcgggcggcggcgg

SEQ ID NO: 51235 - DNA, 17 bp, Homo sapiens
ggtcgggcggcggcggt

SEQ ID NO: 51236 - DNA, 18 bp, Homo sapiens
ggtcgggcggcggcggtc

SEQ ID NO: 51237 - DNA, 19 bp, Homo sapiens
ggtcgggcggcggcggtcg

SEQ ID NO: 51238 - DNA, 20 bp, Homo sapiens
ggtcgggcggcggcggtcgg

SEQ ID NO: 51239 - DNA, 21 bp, Homo sapiens
ggtcgggcggcggcggtcggc

SEQ ID NO: 51240 - DNA, 22 bp, Homo sapiens
ggtcgggcggcggcggtcggcg

SEQ ID NO: 51241 - DNA, 23 bp, Homo sapiens
ggtcgggcggcggcggtcggcgg

SEQ ID NO: 51242 - DNA, 24 bp, Homo sapiens
ggtcgggcggcggcggtcggcggg

SEQ ID NO: 51243 - DNA, 25 bp, Homo sapiens
ggtcgggcggcggcggtcggcgggc

SEQ ID NO: 51244 - DNA, 26 bp, Homo sapiens
ggtcgggcggcggcggtcggcgggcg

SEQ ID NO: 51245 - DNA, 27 bp, Homo sapiens
ggtcgggcggcggcggtcggcgggcgg

SEQ ID NO: 51246 - DNA, 28 bp, Homo sapiens
ggtcgggcggcggcggtcggcgggcggc

SEQ ID NO: 51247 - DNA, 29 bp, Homo sapiens
ggtcgggcggcggcggtcggcgggcggcg

SEQ ID NO: 51248 - DNA, 30 bp, Homo sapiens
ggtcgggcggcggcggtcggcgggcggcgg

SEQ ID NO: 51249 - DNA, 20 bp, Homo sapiens
gtcgggcggcggcggtcggc

SEQ ID NO: 51250 - DNA, 17 bp, Homo sapiens
cgggcggcggcggtcgg

SEQ ID NO: 51251 - DNA, 18 bp, Homo sapiens
cgggcggcggcggtcggc

SEQ ID NO: 51252 - DNA, 19 bp, Homo sapiens
cgggcggcggcggtcggcg

SEQ ID NO: 51253 - DNA, 20 bp, Homo sapiens
cgggcggcggcggtcggcgg

SEQ ID NO: 51254 - DNA, 21 bp, Homo sapiens
cgggcggcggcggtcggcggg

SEQ ID NO: 51255 - DNA, 22 bp, Homo sapiens
cgggcggcggcggtcggcgggc

SEQ ID NO: 51256 - DNA, 23 bp, Homo sapiens
cgggcggcggcggtcggcgggcg

SEQ ID NO: 51257 - DNA, 24 bp, Homo sapiens
cgggcggcggcggtcggcgggcgg

SEQ ID NO: 51258 - DNA, 25 bp, Homo sapiens
cgggcggcggcggtcggcgggcggc

SEQ ID NO: 51259 - DNA, 28 bp, Homo sapiens
cgggcggcggcggtcggcgggcggcggg

SEQ ID NO: 51260 - DNA, 17 bp, Homo sapiens
gggcggcggcggtcggc

SEQ ID NO: 51261 - DNA, 18 bp, Homo sapiens
gggcggcggcggtcggcg

SEQ ID NO: 51262 - DNA, 19 bp, Homo sapiens
gggcggcggcggtcggcgg

SEQ ID NO: 51263 - DNA, 20 bp, Homo sapiens
gggcggcggcggtcggcggg

SEQ ID NO: 51264 - DNA, 21 bp, Homo sapiens
gggcggcggcggtcggcgggc

SEQ ID NO: 51265 - DNA, 22 bp, Homo sapiens
gggcggcggcggtcggcgggcg

SEQ ID NO: 51266 - DNA, 23 bp, Homo sapiens
gggcggcggcggtcggcgggcgg

SEQ ID NO: 51267 - DNA, 24 bp, Homo sapiens
gggcggcggcggtcggcgggcggc

SEQ ID NO: 51268 - DNA, 27 bp, Homo sapiens
gggcggcggcggtcggcgggcggcggg

SEQ ID NO: 51269 - DNA, 28 bp, Homo sapiens
gggcggcggcggtcggcgggcggcgggg

SEQ ID NO: 51270 - DNA, 29 bp, Homo sapiens
gggcggcggcggtcggcgggcggcggggc

SEQ ID NO: 51271 - DNA, 30 bp, Homo sapiens
gggcggcggcggtcggcgggcggcggggcg

SEQ ID NO: 51272 - DNA, 17 bp, Homo sapiens
ggcggcggcggtcggcg

SEQ ID NO: 51273 - DNA, 18 bp, Homo sapiens
ggcggcggcggtcggcgg

SEQ ID NO: 51274 - DNA, 19 bp, Homo sapiens
ggcggcggcggtcggcggg

SEQ ID NO: 51275 - DNA, 20 bp, Homo sapiens
ggcggcggcggtcggcgggc

SEQ ID NO: 51276 - DNA, 21 bp, Homo sapiens
ggcggcggcggtcggcgggcg

SEQ ID NO: 51277 - DNA, 22 bp, Homo sapiens
ggcggcggcggtcggcgggcgg

SEQ ID NO: 51278 - DNA, 23 bp, Homo sapiens
ggcggcggcggtcggcgggcggc

SEQ ID NO: 51279 - DNA, 24 bp, Homo sapiens
ggcggcggcggtcggcgggcggcg

SEQ ID NO: 51280 - DNA, 25 bp, Homo sapiens
ggcggcggcggtcggcgggcggcgg

SEQ ID NO: 51281 - DNA, 26 bp, Homo sapiens
ggcggcggcggtcggcgggcggcggg

SEQ ID NO: 51282 - DNA, 28 bp, Homo sapiens
ggcggcggcggtcggcgggcggcggggc

SEQ ID NO: 51283 - DNA, 29 bp, Homo sapiens
ggcggcggcggtcggcgggcggcggggcg

SEQ ID NO: 51284 - DNA, 30 bp, Homo sapiens
ggcggcggcggtcggcgggcggcggggcgg

SEQ ID NO: 51285 - DNA, 17 bp, Homo sapiens
gcggcggcggtcggcgg

SEQ ID NO: 51286 - DNA, 19 bp, Homo sapiens
gcggcggcggtcggcgggc

SEQ ID NO: 51287 - DNA, 20 bp, Homo sapiens
gcggcggcggtcggcgggcg

SEQ ID NO: 51288 - DNA, 21 bp, Homo sapiens
gcggcggcggtcggcgggcgg

SEQ ID NO: 51289 - DNA, 22 bp, Homo sapiens
gcggcggcggtcggcgggcggc

SEQ ID NO: 51290 - DNA, 23 bp, Homo sapiens
gcggcggcggtcggcgggcggcg

SEQ ID NO: 51291 - DNA, 24 bp, Homo sapiens
gcggcggcggtcggcgggcggcgg

SEQ ID NO: 51292 - DNA, 25 bp, Homo sapiens
gcggcggcggtcggcgggcggcggg

SEQ ID NO: 51293 - DNA, 28 bp, Homo sapiens
gcggcggcggtcggcgggcggcggggcg

SEQ ID NO: 51294 - DNA, 19 bp, Homo sapiens
cggcggcggtcggcgggcg

SEQ ID NO: 51295 - DNA, 20 bp, Homo sapiens
cggcggcggtcggcgggcgg

SEQ ID NO: 51296 - DNA, 21 bp, Homo sapiens
cggcggcggtcggcgggcggc

SEQ ID NO: 51297 - DNA, 22 bp, Homo sapiens
cggcggcggtcggcgggcggcg

SEQ ID NO: 51298 - DNA, 23 bp, Homo sapiens
cggcggcggtcggcgggcggcgg

SEQ ID NO: 51299 - DNA, 24 bp, Homo sapiens
cggcggcggtcggcgggcggcggg

SEQ ID NO: 51300 - DNA, 25 bp, Homo sapiens
cggcggcggtcggcgggcggcgggg

SEQ ID NO: 51301 - DNA, 17 bp, Homo sapiens
ggcggcggtcggcgggc

SEQ ID NO: 51302 - DNA, 18 bp, Homo sapiens
ggcggcggtcggcgggcg

SEQ ID NO: 51303 - DNA, 19 bp, Homo sapiens
ggcggcggtcggcgggcgg

SEQ ID NO: 51304 - DNA, 20 bp, Homo sapiens
ggcggcggtcggcgggcggc

SEQ ID NO: 51305 - DNA, 21 bp, Homo sapiens
ggcggcggtcggcgggcggcg

SEQ ID NO: 51306 - DNA, 22 bp, Homo sapiens
ggcggcggtcggcgggcggcgg

SEQ ID NO: 51307 - DNA, 23 bp, Homo sapiens
ggcggcggtcggcgggcggcggg

SEQ ID NO: 51308 - DNA, 24 bp, Homo sapiens
ggcggcggtcggcgggcggcgggg

SEQ ID NO: 51309 - DNA, 25 bp, Homo sapiens
ggcggcggtcggcgggcggcggggc

SEQ ID NO: 51310 - DNA, 26 bp, Homo sapiens
ggcggcggtcggcgggcggcggggcg

SEQ ID NO: 51311 - DNA, 27 bp, Homo sapiens
ggcggcggtcggcgggcggcggggcgg

SEQ ID NO: 51312 - DNA, 28 bp, Homo sapiens
ggcggcggtcggcgggcggcggggcggg

SEQ ID NO: 51313 - DNA, 17 bp, Homo sapiens
gcggcggtcggcgggcg

SEQ ID NO: 51314 - DNA, 18 bp, Homo sapiens
gcggcggtcggcgggcgg

SEQ ID NO: 51315 - DNA, 19 bp, Homo sapiens
gcggcggtcggcgggcggc

SEQ ID NO: 51316 - DNA, 20 bp, Homo sapiens
gcggcggtcggcgggcggcg

SEQ ID NO: 51317 - DNA, 21 bp, Homo sapiens
gcggcggtcggcgggcggcgg

SEQ ID NO: 51318 - DNA, 22 bp, Homo sapiens
gcggcggtcggcgggcggcggg

SEQ ID NO: 51319 - DNA, 23 bp, Homo sapiens
gcggcggtcggcgggcggcgggg

SEQ ID NO: 51320 - DNA, 24 bp, Homo sapiens
gcggcggtcggcgggcggcggggc

SEQ ID NO: 51321 - DNA, 25 bp, Homo sapiens
gcggcggtcggcgggcggcggggcg

SEQ ID NO: 51322 - DNA, 26 bp, Homo sapiens
gcggcggtcggcgggcggcggggcgg

SEQ ID NO: 51323 - DNA, 27 bp, Homo sapiens
gcggcggtcggcgggcggcggggcggg

SEQ ID NO: 51324 - DNA, 29 bp, Homo sapiens
gcggcggtcggcgggcggcggggcggggc

SEQ ID NO: 51325 - DNA, 30 bp, Homo sapiens
gcggcggtcggcgggcggcggggcggggcg

SEQ ID NO: 51326 - DNA, 16 bp, Homo sapiens
cggcggtcggcgggcg

SEQ ID NO: 51327 - DNA, 17 bp, Homo sapiens
cggcggtcggcgggcgg

SEQ ID NO: 51328 - DNA, 18 bp, Homo sapiens
cggcggtcggcgggcggc

SEQ ID NO: 51329 - DNA, 19 bp, Homo sapiens
cggcggtcggcgggcggcg

SEQ ID NO: 51330 - DNA, 20 bp, Homo sapiens
cggcggtcggcgggcggcgg

SEQ ID NO: 51331 - DNA, 21 bp, Homo sapiens
cggcggtcggcgggcggcggg

SEQ ID NO: 51332 - DNA, 22 bp, Homo sapiens
cggcggtcggcgggcggcgggg

SEQ ID NO: 51333 - DNA, 23 bp, Homo sapiens
cggcggtcggcgggcggcggggc

SEQ ID NO: 51334 - DNA, 24 bp, Homo sapiens
cggcggtcggcgggcggcggggcg

SEQ ID NO: 51335 - DNA, 25 bp, Homo sapiens
cggcggtcggcgggcggcggggcgg

SEQ ID NO: 51336 - DNA, 26 bp, Homo sapiens
cggcggtcggcgggcggcggggcggg

SEQ ID NO: 51337 - DNA, 27 bp, Homo sapiens
cggcggtcggcgggcggcggggcgggg

SEQ ID NO: 51338 - DNA, 28 bp, Homo sapiens
cggcggtcggcgggcggcggggcggggc

SEQ ID NO: 51339 - DNA, 29 bp, Homo sapiens
cggcggtcggcgggcggcggggcggggcg

SEQ ID NO: 51340 - DNA, 30 bp, Homo sapiens
cggcggtcggcgggcggcggggcggggcgg

SEQ ID NO: 51341 - DNA, 16 bp, Homo sapiens
ggcggtcggcgggcgg

SEQ ID NO: 51342 - DNA, 17 bp, Homo sapiens
ggcggtcggcgggcggc

SEQ ID NO: 51343 - DNA, 18 bp, Homo sapiens
ggcggtcggcgggcggcg

SEQ ID NO: 51344 - DNA, 19 bp, Homo sapiens
ggcggtcggcgggcggcgg

SEQ ID NO: 51345 - DNA, 20 bp, Homo sapiens
ggcggtcggcgggcggcggg

SEQ ID NO: 51346 - DNA, 21 bp, Homo sapiens
ggcggtcggcgggcggcgggg

SEQ ID NO: 51347 - DNA, 22 bp, Homo sapiens
ggcggtcggcgggcggcggggc

SEQ ID NO: 51348 - DNA, 23 bp, Homo sapiens
ggcggtcggcgggcggcggggcg

SEQ ID NO: 51349 - DNA, 24 bp, Homo sapiens
ggcggtcggcgggcggcggggcgg

SEQ ID NO: 51350 - DNA, 25 bp, Homo sapiens
ggcggtcggcgggcggcggggcggg

SEQ ID NO: 51351 - DNA, 26 bp, Homo sapiens
ggcggtcggcgggcggcggggcgggg

SEQ ID NO: 51352 - DNA, 27 bp, Homo sapiens
ggcggtcggcgggcggcggggcggggc

SEQ ID NO: 51353 - DNA, 28 bp, Homo sapiens
ggcggtcggcgggcggcggggcggggcg

SEQ ID NO: 51354 - DNA, 29 bp, Homo sapiens
ggcggtcggcgggcggcggggcggggcgg

SEQ ID NO: 51355 - DNA, 30 bp, Homo sapiens
ggcggtcggcgggcggcggggcggggcggt

SEQ ID NO: 51356 - DNA, 16 bp, Homo sapiens
gcggtcggcgggcggc

SEQ ID NO: 51357 - DNA, 17 bp, Homo sapiens
gcggtcggcgggcggcg

SEQ ID NO: 51358 - DNA, 18 bp, Homo sapiens
gcggtcggcgggcggcgg

SEQ ID NO: 51359 - DNA, 19 bp, Homo sapiens
gcggtcggcgggcggcggg

SEQ ID NO: 51360 - DNA, 20 bp, Homo sapiens
gcggtcggcgggcggcgggg

SEQ ID NO: 51361 - DNA, 21 bp, Homo sapiens
gcggtcggcgggcggcggggc

SEQ ID NO: 51362 - DNA, 22 bp, Homo sapiens
gcggtcggcgggcggcggggcg

SEQ ID NO: 51363 - DNA, 23 bp, Homo sapiens
gcggtcggcgggcggcggggcgg

SEQ ID NO: 51364 - DNA, 24 bp, Homo sapiens
gcggtcggcgggcggcggggcggg

SEQ ID NO: 51365 - DNA, 25 bp, Homo sapiens
gcggtcggcgggcggcggggcgggg

SEQ ID NO: 51366 - DNA, 26 bp, Homo sapiens
gcggtcggcgggcggcggggcggggc

SEQ ID NO: 51367 - DNA, 27 bp, Homo sapiens
gcggtcggcgggcggcggggcggggcg

SEQ ID NO: 51368 - DNA, 28 bp, Homo sapiens
gcggtcggcgggcggcggggcggggcgg

SEQ ID NO: 51369 - DNA, 29 bp, Homo sapiens
gcggtcggcgggcggcggggcggggcggt

SEQ ID NO: 51370 - DNA, 30 bp, Homo sapiens
gcggtcggcgggcggcggggcggggcggtt

SEQ ID NO: 51371 - DNA, 16 bp, Homo sapiens
cggtcggcgggcggcg

SEQ ID NO: 51372 - DNA, 17 bp, Homo sapiens
cggtcggcgggcggcgg

SEQ ID NO: 51373 - DNA, 18 bp, Homo sapiens
cggtcggcgggcggcggg

SEQ ID NO: 51374 - DNA, 19 bp, Homo sapiens
cggtcggcgggcggcgggg

SEQ ID NO: 51375 - DNA, 20 bp, Homo sapiens
cggtcggcgggcggcggggc

SEQ ID NO: 51376 - DNA, 21 bp, Homo sapiens
cggtcggcgggcggcggggcg

SEQ ID NO: 51377 - DNA, 22 bp, Homo sapiens
cggtcggcgggcggcggggcgg

SEQ ID NO: 51378 - DNA, 23 bp, Homo sapiens
cggtcggcgggcggcggggcggg

SEQ ID NO: 51379 - DNA, 24 bp, Homo sapiens
cggtcggcgggcggcggggcgggg

SEQ ID NO: 51380 - DNA, 25 bp, Homo sapiens
cggtcggcgggcggcggggcggggc

SEQ ID NO: 51381 - DNA, 26 bp, Homo sapiens
cggtcggcgggcggcggggcggggcg

SEQ ID NO: 51382 - DNA, 27 bp, Homo sapiens
cggtcggcgggcggcggggcggggcgg

SEQ ID NO: 51383 - DNA, 28 bp, Homo sapiens
cggtcggcgggcggcggggcggggcggt

SEQ ID NO: 51384 - DNA, 29 bp, Homo sapiens
cggtcggcgggcggcggggcggggcggtt

SEQ ID NO: 51385 - DNA, 16 bp, Homo sapiens
ggtcggcgggcggcgg

SEQ ID NO: 51386 - DNA, 17 bp, Homo sapiens
ggtcggcgggcggcggg

SEQ ID NO: 51387 - DNA, 18 bp, Homo sapiens
ggtcggcgggcggcgggg

SEQ ID NO: 51388 - DNA, 19 bp, Homo sapiens
ggtcggcgggcggcggggc

SEQ ID NO: 51389 - DNA, 20 bp, Homo sapiens
ggtcggcgggcggcggggcg

SEQ ID NO: 51390 - DNA, 21 bp, Homo sapiens
ggtcggcgggcggcggggcgg

SEQ ID NO: 51391 - DNA, 22 bp, Homo sapiens
ggtcggcgggcggcggggcggg

SEQ ID NO: 51392 - DNA, 23 bp, Homo sapiens
ggtcggcgggcggcggggcgggg

SEQ ID NO: 51393 - DNA, 24 bp, Homo sapiens
ggtcggcgggcggcggggcggggc

SEQ ID NO: 51394 - DNA, 25 bp, Homo sapiens
ggtcggcgggcggcggggcggggcg

SEQ ID NO: 51395 - DNA, 26 bp, Homo sapiens
ggtcggcgggcggcggggcggggcgg

SEQ ID NO: 51396 - DNA, 27 bp, Homo sapiens
ggtcggcgggcggcggggcggggcggt

SEQ ID NO: 51397 - DNA, 28 bp, Homo sapiens
ggtcggcgggcggcggggcggggcggtt

SEQ ID NO: 51398 - DNA, 18 bp, Homo sapiens
gtcggcgggcggcggggc

SEQ ID NO: 51399 - DNA, 19 bp, Homo sapiens
gtcggcgggcggcggggcg

SEQ ID NO: 51400 - DNA, 20 bp, Homo sapiens
gtcggcgggcggcggggcgg

SEQ ID NO: 51401 - DNA, 21 bp, Homo sapiens
gtcggcgggcggcggggcggg

SEQ ID NO: 51402 - DNA, 22 bp, Homo sapiens
gtcggcgggcggcggggcgggg

SEQ ID NO: 51403 - DNA, 23 bp, Homo sapiens
gtcggcgggcggcggggcggggc

SEQ ID NO: 51404 - DNA, 24 bp, Homo sapiens
gtcggcgggcggcggggcggggcg

SEQ ID NO: 51405 - DNA, 25 bp, Homo sapiens
gtcggcgggcggcggggcggggcgg

SEQ ID NO: 51406 - DNA, 26 bp, Homo sapiens
gtcggcgggcggcggggcggggcggt

SEQ ID NO: 51407 - DNA, 19 bp, Homo sapiens
tcggcgggcggcggggcgg

SEQ ID NO: 51408 - DNA, 20 bp, Homo sapiens
tcggcgggcggcggggcggg

SEQ ID NO: 51409 - DNA, 21 bp, Homo sapiens
tcggcgggcggcggggcgggg

SEQ ID NO: 51410 - DNA, 23 bp, Homo sapiens
tcggcgggcggcggggcggggcg

SEQ ID NO: 51411 - DNA, 24 bp, Homo sapiens
tcggcgggcggcggggcggggcgg

SEQ ID NO: 51412 - DNA, 19 bp, Homo sapiens
cggcgggcggcggggcggg

SEQ ID NO: 51413 - DNA, 20 bp, Homo sapiens
cggcgggcggcggggcgggg

SEQ ID NO: 51414 - DNA, 21 bp, Homo sapiens
cggcgggcggcggggcggggc

SEQ ID NO: 51415 - DNA, 17 bp, Homo sapiens
ggcgggcggcggggcgg

SEQ ID NO: 51416 - DNA, 18 bp, Homo sapiens
ggcgggcggcggggcggg

SEQ ID NO: 51417 - DNA, 19 bp, Homo sapiens
ggcgggcggcggggcgggg

SEQ ID NO: 51418 - DNA, 20 bp, Homo sapiens
ggcgggcggcggggcggggc

SEQ ID NO: 51419 - DNA, 21 bp, Homo sapiens
ggcgggcggcggggcggggcg

SEQ ID NO: 51420 - DNA, 22 bp, Homo sapiens
ggcgggcggcggggcggggcgg

SEQ ID NO: 51421 - DNA, 18 bp, Homo sapiens
gcgggcggcggggcgggg

SEQ ID NO: 51422 - DNA, 19 bp, Homo sapiens
gcgggcggcggggcggggc

SEQ ID NO: 51423 - DNA, 20 bp, Homo sapiens
gcgggcggcggggcggggcg

SEQ ID NO: 51424 - DNA, 21 bp, Homo sapiens
gcgggcggcggggcggggcgg

SEQ ID NO: 51425 - DNA, 17 bp, Homo sapiens
cgggcggcggggcgggg

SEQ ID NO: 51426 - DNA, 18 bp, Homo sapiens
cgggcggcggggcggggc

SEQ ID NO: 51427 - DNA, 19 bp, Homo sapiens
cgggcggcggggcggggcg

SEQ ID NO: 51428 - DNA, 20 bp, Homo sapiens
cgggcggcggggcggggcgg

SEQ ID NO: 51429 - DNA, 21 bp, Homo sapiens
cgggcggcggggcggggcggt

SEQ ID NO: 51430 - DNA, 16 bp, Homo sapiens
gggcggcggggcgggg

SEQ ID NO: 51431 - DNA, 17 bp, Homo sapiens
gggcggcggggcggggc

SEQ ID NO: 51432 - DNA, 18 bp, Homo sapiens
gggcggcggggcggggcg

SEQ ID NO: 51433 - DNA, 19 bp, Homo sapiens
gggcggcggggcggggcgg

SEQ ID NO: 51434 - DNA, 20 bp, Homo sapiens
gggcggcggggcggggcggt

SEQ ID NO: 51435 - DNA, 21 bp, Homo sapiens
gggcggcggggcggggcggtt

SEQ ID NO: 51436 - DNA, 17 bp, Homo sapiens
ggcggcggggcggggcg

SEQ ID NO: 51437 - DNA, 18 bp, Homo sapiens
ggcggcggggcggggcgg

SEQ ID NO: 51438 - DNA, 19 bp, Homo sapiens
ggcggcggggcggggcggt

SEQ ID NO: 51439 - DNA, 20 bp, Homo sapiens
ggcggcggggcggggcggtt

SEQ ID NO: 51440 - DNA, 17 bp, Homo sapiens
gcggcggggcggggcgg

SEQ ID NO: 51441 - DNA, 20 bp, Homo sapiens
ggggcggggcggttcgtccc

SEQ ID NO: 51442 - DNA, 21 bp, Homo sapiens
ggggcggggcggttcgtcccc

SEQ ID NO: 51443 - DNA, 22 bp, Homo sapiens
ggggcggggcggttcgtccccc

SEQ ID NO: 51444 - DNA, 18 bp, Homo sapiens
gggcggttcgtccccccg

SEQ ID NO: 51445 - DNA, 16 bp, Homo sapiens
ggcggttcgtcccccc

SEQ ID NO: 51446 - DNA, 17 bp, Homo sapiens
ggcggttcgtccccccg

SEQ ID NO: 51447 - DNA, 18 bp, Homo sapiens
ggcggttcgtccccccgc

SEQ ID NO: 51448 - DNA, 19 bp, Homo sapiens
ggcggttcgtccccccgcc

SEQ ID NO: 51449 - DNA, 16 bp, Homo sapiens
gttcgtccccccgccc

SEQ ID NO: 51450 - DNA, 20 bp, Homo sapiens
gttcgtccccccgccctacc

SEQ ID NO: 51451 - DNA, 21 bp, Homo sapiens
gttcgtccccccgccctaccc

SEQ ID NO: 51452 - DNA, 18 bp, Homo sapiens
ccccccgccctacccccc

SEQ ID NO: 51453 - DNA, 22 bp, Homo sapiens
ccccccgccctacccccccggc

SEQ ID NO: 51454 - DNA, 24 bp, Homo sapiens
ccccccgccctacccccccggccc

SEQ ID NO: 51455 - DNA, 25 bp, Homo sapiens
ccccccgccctacccccccggcccc

SEQ ID NO: 51456 - DNA, 26 bp, Homo sapiens
ccccccgccctacccccccggccccg

SEQ ID NO: 51457 - DNA, 18 bp, Homo sapiens
cccccgccctaccccccc

SEQ ID NO: 51458 - DNA, 20 bp, Homo sapiens
cccccgccctacccccccgg

SEQ ID NO: 51459 - DNA, 21 bp, Homo sapiens
cccccgccctacccccccggc

SEQ ID NO: 51460 - DNA, 22 bp, Homo sapiens
cccccgccctacccccccggcc

SEQ ID NO: 51461 - DNA, 23 bp, Homo sapiens
cccccgccctacccccccggccc

SEQ ID NO: 51462 - DNA, 24 bp, Homo sapiens
cccccgccctacccccccggcccc

SEQ ID NO: 51463 - DNA, 25 bp, Homo sapiens
cccccgccctacccccccggccccg

SEQ ID NO: 51464 - DNA, 26 bp, Homo sapiens
cccccgccctacccccccggccccgt

SEQ ID NO: 51465 - DNA, 27 bp, Homo sapiens
cccccgccctacccccccggccccgtc

SEQ ID NO: 51466 - DNA, 30 bp, Homo sapiens
cccccgccctacccccccggccccgtccgc

SEQ ID NO: 51467 - DNA, 16 bp, Homo sapiens
ccccgccctacccccc

SEQ ID NO: 51468 - DNA, 17 bp, Homo sapiens
ccccgccctaccccccc

SEQ ID NO: 51469 - DNA, 18 bp, Homo sapiens
ccccgccctacccccccg

SEQ ID NO: 51470 - DNA, 19 bp, Homo sapiens
ccccgccctacccccccgg

SEQ ID NO: 51471 - DNA, 20 bp, Homo sapiens
ccccgccctacccccccggc

SEQ ID NO: 51472 - DNA, 21 bp, Homo sapiens
ccccgccctacccccccggcc

SEQ ID NO: 51473 - DNA, 22 bp, Homo sapiens
ccccgccctacccccccggccc

SEQ ID NO: 51474 - DNA, 23 bp, Homo sapiens
ccccgccctacccccccggcccc

SEQ ID NO: 51475 - DNA, 24 bp, Homo sapiens
ccccgccctacccccccggccccg

SEQ ID NO: 51476 - DNA, 25 bp, Homo sapiens
ccccgccctacccccccggccccgt

SEQ ID NO: 51477 - DNA, 26 bp, Homo sapiens
ccccgccctacccccccggccccgtc

SEQ ID NO: 51478 - DNA, 27 bp, Homo sapiens
ccccgccctacccccccggccccgtcc

SEQ ID NO: 51479 - DNA, 30 bp, Homo sapiens
ccccgccctacccccccggccccgtccgcc

SEQ ID NO: 51480 - DNA, 16 bp, Homo sapiens
cccgccctaccccccc

SEQ ID NO: 51481 - DNA, 17 bp, Homo sapiens
cccgccctacccccccg

SEQ ID NO: 51482 - DNA, 18 bp, Homo sapiens
cccgccctacccccccgg

SEQ ID NO: 51483 - DNA, 19 bp, Homo sapiens
cccgccctacccccccggc

SEQ ID NO: 51484 - DNA, 20 bp, Homo sapiens
cccgccctacccccccggcc

SEQ ID NO: 51485 - DNA, 21 bp, Homo sapiens
cccgccctacccccccggccc

SEQ ID NO: 51486 - DNA, 22 bp, Homo sapiens
cccgccctacccccccggcccc

SEQ ID NO: 51487 - DNA, 23 bp, Homo sapiens
cccgccctacccccccggccccg

SEQ ID NO: 51488 - DNA, 24 bp, Homo sapiens
cccgccctacccccccggccccgt

SEQ ID NO: 51489 - DNA, 25 bp, Homo sapiens
cccgccctacccccccggccccgtc

SEQ ID NO: 51490 - DNA, 26 bp, Homo sapiens
cccgccctacccccccggccccgtcc

SEQ ID NO: 51491 - DNA, 29 bp, Homo sapiens
cccgccctacccccccggccccgtccgcc

SEQ ID NO: 51492 - DNA, 16 bp, Homo sapiens
ccgccctacccccccg

SEQ ID NO: 51493 - DNA, 17 bp, Homo sapiens
ccgccctacccccccgg

SEQ ID NO: 51494 - DNA, 18 bp, Homo sapiens
ccgccctacccccccggc

SEQ ID NO: 51495 - DNA, 19 bp, Homo sapiens
ccgccctacccccccggcc

SEQ ID NO: 51496 - DNA, 20 bp, Homo sapiens
ccgccctacccccccggccc

SEQ ID NO: 51497 - DNA, 21 bp, Homo sapiens
ccgccctacccccccggcccc

SEQ ID NO: 51498 - DNA, 22 bp, Homo sapiens
ccgccctacccccccggccccg

SEQ ID NO: 51499 - DNA, 23 bp, Homo sapiens
ccgccctacccccccggccccgt

SEQ ID NO: 51500 - DNA, 24 bp, Homo sapiens
ccgccctacccccccggccccgtc

SEQ ID NO: 51501 - DNA, 25 bp, Homo sapiens
ccgccctacccccccggccccgtcc

SEQ ID NO: 51502 - DNA, 28 bp, Homo sapiens
ccgccctacccccccggccccgtccgcc

SEQ ID NO: 51503 - DNA, 16 bp, Homo sapiens
cgccctacccccccgg

SEQ ID NO: 51504 - DNA, 17 bp, Homo sapiens
cgccctacccccccggc

SEQ ID NO: 51505 - DNA, 18 bp, Homo sapiens
cgccctacccccccggcc

SEQ ID NO: 51506 - DNA, 19 bp, Homo sapiens
cgccctacccccccggccc

SEQ ID NO: 51507 - DNA, 20 bp, Homo sapiens
cgccctacccccccggcccc

SEQ ID NO: 51508 - DNA, 21 bp, Homo sapiens
cgccctacccccccggccccg

SEQ ID NO: 51509 - DNA, 22 bp, Homo sapiens
cgccctacccccccggccccgt

SEQ ID NO: 51510 - DNA, 23 bp, Homo sapiens
cgccctacccccccggccccgtc

SEQ ID NO: 51511 - DNA, 24 bp, Homo sapiens
cgccctacccccccggccccgtcc

SEQ ID NO: 51512 - DNA, 26 bp, Homo sapiens
cgccctacccccccggccccgtccgc

SEQ ID NO: 51513 - DNA, 27 bp, Homo sapiens
cgccctacccccccggccccgtccgcc

SEQ ID NO: 51514 - DNA, 28 bp, Homo sapiens
cgccctacccccccggccccgtccgccc

SEQ ID NO: 51515 - DNA, 16 bp, Homo sapiens
gccctacccccccggc

SEQ ID NO: 51516 - DNA, 17 bp, Homo sapiens
gccctacccccccggcc

SEQ ID NO: 51517 - DNA, 19 bp, Homo sapiens
gccctacccccccggcccc

SEQ ID NO: 51518 - DNA, 20 bp, Homo sapiens
gccctacccccccggccccg

SEQ ID NO: 51519 - DNA, 21 bp, Homo sapiens
gccctacccccccggccccgt

SEQ ID NO: 51520 - DNA, 22 bp, Homo sapiens
gccctacccccccggccccgtc

SEQ ID NO: 51521 - DNA, 23 bp, Homo sapiens
gccctacccccccggccccgtcc

SEQ ID NO: 51522 - DNA, 18 bp, Homo sapiens
ccctacccccccggcccc

SEQ ID NO: 51523 - DNA, 19 bp, Homo sapiens
ccctacccccccggccccg

SEQ ID NO: 51524 - DNA, 20 bp, Homo sapiens
ccctacccccccggccccgt

SEQ ID NO: 51525 - DNA, 21 bp, Homo sapiens
ccctacccccccggccccgtc

SEQ ID NO: 51526 - DNA, 22 bp, Homo sapiens
ccctacccccccggccccgtcc

SEQ ID NO: 51527 - DNA, 23 bp, Homo sapiens
ccctacccccccggccccgtccg

SEQ ID NO: 51528 - DNA, 24 bp, Homo sapiens
ccctacccccccggccccgtccgc

SEQ ID NO: 51529 - DNA, 25 bp, Homo sapiens
ccctacccccccggccccgtccgcc

SEQ ID NO: 51530 - DNA, 16 bp, Homo sapiens
cctacccccccggccc

SEQ ID NO: 51531 - DNA, 17 bp, Homo sapiens
cctacccccccggcccc

SEQ ID NO: 51532 - DNA, 18 bp, Homo sapiens
cctacccccccggccccg

SEQ ID NO: 51533 - DNA, 19 bp, Homo sapiens
cctacccccccggccccgt

SEQ ID NO: 51534 - DNA, 20 bp, Homo sapiens
cctacccccccggccccgtc

SEQ ID NO: 51535 - DNA, 21 bp, Homo sapiens
cctacccccccggccccgtcc

SEQ ID NO: 51536 - DNA, 23 bp, Homo sapiens
cctacccccccggccccgtccgc

SEQ ID NO: 51537 - DNA, 17 bp, Homo sapiens
ctacccccccggccccg

SEQ ID NO: 51538 - DNA, 19 bp, Homo sapiens
ctacccccccggccccgtc

SEQ ID NO: 51539 - DNA, 20 bp, Homo sapiens
ctacccccccggccccgtcc

SEQ ID NO: 51540 - DNA, 22 bp, Homo sapiens
ctacccccccggccccgtccgc

SEQ ID NO: 51541 - DNA, 18 bp, Homo sapiens
tacccccccggccccgtc

SEQ ID NO: 51542 - DNA, 19 bp, Homo sapiens
tacccccccggccccgtcc

SEQ ID NO: 51543 - DNA, 17 bp, Homo sapiens
acccccccggccccgtc

SEQ ID NO: 51544 - DNA, 18 bp, Homo sapiens
acccccccggccccgtcc

SEQ ID NO: 51545 - DNA, 19 bp, Homo sapiens
acccccccggccccgtccg

SEQ ID NO: 51546 - DNA, 16 bp, Homo sapiens
cccccccggccccgtc

SEQ ID NO: 51547 - DNA, 19 bp, Homo sapiens
cccccccggccccgtccgc

SEQ ID NO: 51548 - DNA, 20 bp, Homo sapiens
cccccccggccccgtccgcc

SEQ ID NO: 51549 - DNA, 21 bp, Homo sapiens
cccccccggccccgtccgccc

SEQ ID NO: 51550 - DNA, 18 bp, Homo sapiens
ccccccggccccgtccgc

SEQ ID NO: 51551 - DNA, 19 bp, Homo sapiens
ccccccggccccgtccgcc

SEQ ID NO: 51552 - DNA, 20 bp, Homo sapiens
ccccccggccccgtccgccc

SEQ ID NO: 51553 - DNA, 21 bp, Homo sapiens
ccccccggccccgtccgcccc

SEQ ID NO: 51554 - DNA, 22 bp, Homo sapiens
ccccccggccccgtccgccccc

SEQ ID NO: 51555 - DNA, 18 bp, Homo sapiens
cccccggccccgtccgcc

SEQ ID NO: 51556 - DNA, 19 bp, Homo sapiens
cccccggccccgtccgccc

SEQ ID NO: 51557 - DNA, 20 bp, Homo sapiens
cccccggccccgtccgcccc

SEQ ID NO: 51558 - DNA, 23 bp, Homo sapiens
cccccggccccgtccgccccccg

SEQ ID NO: 51559 - DNA, 19 bp, Homo sapiens
cccggccccgtccgccccc

SEQ ID NO: 51560 - DNA, 21 bp, Homo sapiens
cccggccccgtccgccccccg

SEQ ID NO: 51561 - DNA, 26 bp, Homo sapiens
cccggccccgtccgccccccgttccc

SEQ ID NO: 51562 - DNA, 27 bp, Homo sapiens
cccggccccgtccgccccccgttcccc

SEQ ID NO: 51563 - DNA, 25 bp, Homo sapiens
ccggccccgtccgccccccgttccc

SEQ ID NO: 51564 - DNA, 26 bp, Homo sapiens
ccggccccgtccgccccccgttcccc

SEQ ID NO: 51565 - DNA, 17 bp, Homo sapiens
cggccccgtccgccccc

SEQ ID NO: 51566 - DNA, 18 bp, Homo sapiens
cggccccgtccgcccccc

SEQ ID NO: 51567 - DNA, 24 bp, Homo sapiens
cggccccgtccgccccccgttccc

SEQ ID NO: 51568 - DNA, 25 bp, Homo sapiens
cggccccgtccgccccccgttcccc

SEQ ID NO: 51569 - DNA, 16 bp, Homo sapiens
ggccccgtccgccccc

SEQ ID NO: 51570 - DNA, 17 bp, Homo sapiens
ggccccgtccgcccccc

SEQ ID NO: 51571 - DNA, 23 bp, Homo sapiens
ggccccgtccgccccccgttccc

SEQ ID NO: 51572 - DNA, 24 bp, Homo sapiens
ggccccgtccgccccccgttcccc

SEQ ID NO: 51573 - DNA, 21 bp, Homo sapiens
gccccgtccgccccccgttcc

SEQ ID NO: 51574 - DNA, 22 bp, Homo sapiens
gccccgtccgccccccgttccc

SEQ ID NO: 51575 - DNA, 23 bp, Homo sapiens
gccccgtccgccccccgttcccc

SEQ ID NO: 51576 - DNA, 21 bp, Homo sapiens
ccccgtccgccccccgttccc

SEQ ID NO: 51577 - DNA, 22 bp, Homo sapiens
ccccgtccgccccccgttcccc

SEQ ID NO: 51578 - DNA, 20 bp, Homo sapiens
cccgtccgccccccgttccc

SEQ ID NO: 51579 - DNA, 21 bp, Homo sapiens
cccgtccgccccccgttcccc

SEQ ID NO: 51580 - DNA, 22 bp, Homo sapiens
cccgtccgccccccgttccccc

SEQ ID NO: 51581 - DNA, 19 bp, Homo sapiens
ccgtccgccccccgttccc

SEQ ID NO: 51582 - DNA, 20 bp, Homo sapiens
ccgtccgccccccgttcccc

SEQ ID NO: 51583 - DNA, 21 bp, Homo sapiens
ccgtccgccccccgttccccc

SEQ ID NO: 51584 - DNA, 22 bp, Homo sapiens
ccgtccgccccccgttcccccc

SEQ ID NO: 51585 - DNA, 17 bp, Homo sapiens
cgtccgccccccgttcc

SEQ ID NO: 51586 - DNA, 18 bp, Homo sapiens
cgtccgccccccgttccc

SEQ ID NO: 51587 - DNA, 19 bp, Homo sapiens
cgtccgccccccgttcccc

SEQ ID NO: 51588 - DNA, 20 bp, Homo sapiens
cgtccgccccccgttccccc

SEQ ID NO: 51589 - DNA, 21 bp, Homo sapiens
cgtccgccccccgttcccccc

SEQ ID NO: 51590 - DNA, 17 bp, Homo sapiens
gtccgccccccgttccc

SEQ ID NO: 51591 - DNA, 18 bp, Homo sapiens
gtccgccccccgttcccc

SEQ ID NO: 51592 - DNA, 19 bp, Homo sapiens
gtccgccccccgttccccc

SEQ ID NO: 51593 - DNA, 20 bp, Homo sapiens
gtccgccccccgttcccccc

SEQ ID NO: 51594 - DNA, 17 bp, Homo sapiens
tccgccccccgttcccc

SEQ ID NO: 51595 - DNA, 18 bp, Homo sapiens
tccgccccccgttccccc

SEQ ID NO: 51596 - DNA, 19 bp, Homo sapiens
tccgccccccgttcccccc

SEQ ID NO: 51597 - DNA, 25 bp, Homo sapiens
tccgccccccgttcccccctcctcc

SEQ ID NO: 51598 - DNA, 16 bp, Homo sapiens
ccgccccccgttcccc

SEQ ID NO: 51599 - DNA, 17 bp, Homo sapiens
ccgccccccgttccccc

SEQ ID NO: 51600 - DNA, 18 bp, Homo sapiens
ccgccccccgttcccccc

SEQ ID NO: 51601 - DNA, 21 bp, Homo sapiens
ccgccccccgttcccccctcc

SEQ ID NO: 51602 - DNA, 22 bp, Homo sapiens
ccgccccccgttcccccctcct

SEQ ID NO: 51603 - DNA, 24 bp, Homo sapiens
ccgccccccgttcccccctcctcc

SEQ ID NO: 51604 - DNA, 16 bp, Homo sapiens
cgccccccgttccccc

SEQ ID NO: 51605 - DNA, 17 bp, Homo sapiens
cgccccccgttcccccc

SEQ ID NO: 51606 - DNA, 20 bp, Homo sapiens
cgccccccgttcccccctcc

SEQ ID NO: 51607 - DNA, 23 bp, Homo sapiens
cgccccccgttcccccctcctcc

SEQ ID NO: 51608 - DNA, 16 bp, Homo sapiens
gccccccgttcccccc

SEQ ID NO: 51609 - DNA, 18 bp, Homo sapiens
gccccccgttcccccctc

SEQ ID NO: 51610 - DNA, 19 bp, Homo sapiens
gccccccgttcccccctcc

SEQ ID NO: 51611 - DNA, 20 bp, Homo sapiens
gccccccgttcccccctcct

SEQ ID NO: 51612 - DNA, 21 bp, Homo sapiens
gccccccgttcccccctcctc

SEQ ID NO: 51613 - DNA, 22 bp, Homo sapiens
gccccccgttcccccctcctcc

SEQ ID NO: 51614 - DNA, 19 bp, Homo sapiens
ccccccgttcccccctcct

SEQ ID NO: 51615 - DNA, 20 bp, Homo sapiens
ccccccgttcccccctcctc

SEQ ID NO: 51616 - DNA, 21 bp, Homo sapiens
ccccccgttcccccctcctcc

SEQ ID NO: 51617 - DNA, 19 bp, Homo sapiens
cccccgttcccccctcctc

SEQ ID NO: 51618 - DNA, 20 bp, Homo sapiens
cccccgttcccccctcctcc

SEQ ID NO: 51619 - DNA, 18 bp, Homo sapiens
ccccgttcccccctcctc

SEQ ID NO: 51620 - DNA, 19 bp, Homo sapiens
ccccgttcccccctcctcc

SEQ ID NO: 51621 - DNA, 16 bp, Homo sapiens
cccgttcccccctcct

SEQ ID NO: 51622 - DNA, 17 bp, Homo sapiens
cccgttcccccctcctc

SEQ ID NO: 51623 - DNA, 18 bp, Homo sapiens
cccgttcccccctcctcc

SEQ ID NO: 51624 - DNA, 19 bp, Homo sapiens
cccgttcccccctcctcct

SEQ ID NO: 51625 - DNA, 23 bp, Homo sapiens
cccgttcccccctcctcctcggc

SEQ ID NO: 51626 - DNA, 16 bp, Homo sapiens
ccgttcccccctcctc

SEQ ID NO: 51627 - DNA, 17 bp, Homo sapiens
ccgttcccccctcctcc

SEQ ID NO: 51628 - DNA, 18 bp, Homo sapiens
ccgttcccccctcctcct

SEQ ID NO: 51629 - DNA, 21 bp, Homo sapiens
ccgttcccccctcctcctcgg

SEQ ID NO: 51630 - DNA, 22 bp, Homo sapiens
ccgttcccccctcctcctcggc

SEQ ID NO: 51631 - DNA, 23 bp, Homo sapiens
ccgttcccccctcctcctcggcg

SEQ ID NO: 51632 - DNA, 24 bp, Homo sapiens
ccgttcccccctcctcctcggcgc

SEQ ID NO: 51633 - DNA, 25 bp, Homo sapiens
ccgttcccccctcctcctcggcgcg

SEQ ID NO: 51634 - DNA, 26 bp, Homo sapiens
ccgttcccccctcctcctcggcgcgc

SEQ ID NO: 51635 - DNA, 30 bp, Homo sapiens
ccgttcccccctcctcctcggcgcgcggcg

SEQ ID NO: 51636 - DNA, 16 bp, Homo sapiens
cgttcccccctcctcc

SEQ ID NO: 51637 - DNA, 17 bp, Homo sapiens
cgttcccccctcctcct

SEQ ID NO: 51638 - DNA, 21 bp, Homo sapiens
cgttcccccctcctcctcggc

SEQ ID NO: 51639 - DNA, 22 bp, Homo sapiens
cgttcccccctcctcctcggcg

SEQ ID NO: 51640 - DNA, 23 bp, Homo sapiens
cgttcccccctcctcctcggcgc

SEQ ID NO: 51641 - DNA, 24 bp, Homo sapiens
cgttcccccctcctcctcggcgcg

SEQ ID NO: 51642 - DNA, 25 bp, Homo sapiens
cgttcccccctcctcctcggcgcgc

SEQ ID NO: 51643 - DNA, 26 bp, Homo sapiens
cgttcccccctcctcctcggcgcgcg

SEQ ID NO: 51644 - DNA, 28 bp, Homo sapiens
cgttcccccctcctcctcggcgcgcggc

SEQ ID NO: 51645 - DNA, 30 bp, Homo sapiens
cgttcccccctcctcctcggcgcgcggcgg

SEQ ID NO: 51646 - DNA, 16 bp, Homo sapiens
gttcccccctcctcct

SEQ ID NO: 51647 - DNA, 18 bp, Homo sapiens
gttcccccctcctcctcg

SEQ ID NO: 51648 - DNA, 19 bp, Homo sapiens
gttcccccctcctcctcgg

SEQ ID NO: 51649 - DNA, 20 bp, Homo sapiens
gttcccccctcctcctcggc

SEQ ID NO: 51650 - DNA, 21 bp, Homo sapiens
gttcccccctcctcctcggcg

SEQ ID NO: 51651 - DNA, 22 bp, Homo sapiens
gttcccccctcctcctcggcgc

SEQ ID NO: 51652 - DNA, 23 bp, Homo sapiens
gttcccccctcctcctcggcgcg

SEQ ID NO: 51653 - DNA, 24 bp, Homo sapiens
gttcccccctcctcctcggcgcgc

SEQ ID NO: 51654 - DNA, 25 bp, Homo sapiens
gttcccccctcctcctcggcgcgcg

SEQ ID NO: 51655 - DNA, 26 bp, Homo sapiens
gttcccccctcctcctcggcgcgcgg

SEQ ID NO: 51656 - DNA, 27 bp, Homo sapiens
gttcccccctcctcctcggcgcgcggc

SEQ ID NO: 51657 - DNA, 28 bp, Homo sapiens
gttcccccctcctcctcggcgcgcggcg

SEQ ID NO: 51658 - DNA, 29 bp, Homo sapiens
gttcccccctcctcctcggcgcgcggcgg

SEQ ID NO: 51659 - DNA, 30 bp, Homo sapiens
gttcccccctcctcctcggcgcgcggcggc

SEQ ID NO: 51660 - DNA, 18 bp, Homo sapiens
ttcccccctcctcctcgg

SEQ ID NO: 51661 - DNA, 19 bp, Homo sapiens
ttcccccctcctcctcggc

SEQ ID NO: 51662 - DNA, 20 bp, Homo sapiens
ttcccccctcctcctcggcg

SEQ ID NO: 51663 - DNA, 21 bp, Homo sapiens
ttcccccctcctcctcggcgc

SEQ ID NO: 51664 - DNA, 22 bp, Homo sapiens
ttcccccctcctcctcggcgcg

SEQ ID NO: 51665 - DNA, 23 bp, Homo sapiens
ttcccccctcctcctcggcgcgc

SEQ ID NO: 51666 - DNA, 24 bp, Homo sapiens
ttcccccctcctcctcggcgcgcg

SEQ ID NO: 51667 - DNA, 25 bp, Homo sapiens
ttcccccctcctcctcggcgcgcgg

SEQ ID NO: 51668 - DNA, 26 bp, Homo sapiens
ttcccccctcctcctcggcgcgcggc

SEQ ID NO: 51669 - DNA, 27 bp, Homo sapiens
ttcccccctcctcctcggcgcgcggcg

SEQ ID NO: 51670 - DNA, 28 bp, Homo sapiens
ttcccccctcctcctcggcgcgcggcgg

SEQ ID NO: 51671 - DNA, 29 bp, Homo sapiens
ttcccccctcctcctcggcgcgcggcggc

SEQ ID NO: 51672 - DNA, 30 bp, Homo sapiens
ttcccccctcctcctcggcgcgcggcggcg

SEQ ID NO: 51673 - DNA, 21 bp, Homo sapiens
tcccccctcctcctcggcgcg

SEQ ID NO: 51674 - DNA, 22 bp, Homo sapiens
tcccccctcctcctcggcgcgc

SEQ ID NO: 51675 - DNA, 23 bp, Homo sapiens
tcccccctcctcctcggcgcgcg

SEQ ID NO: 51676 - DNA, 18 bp, Homo sapiens
cccccctcctcctcggcg

SEQ ID NO: 51677 - DNA, 19 bp, Homo sapiens
cccccctcctcctcggcgc

SEQ ID NO: 51678 - DNA, 20 bp, Homo sapiens
cccccctcctcctcggcgcg

SEQ ID NO: 51679 - DNA, 21 bp, Homo sapiens
cccccctcctcctcggcgcgc

SEQ ID NO: 51680 - DNA, 22 bp, Homo sapiens
cccccctcctcctcggcgcgcg

SEQ ID NO: 51681 - DNA, 23 bp, Homo sapiens
cccccctcctcctcggcgcgcgg

SEQ ID NO: 51682 - DNA, 24 bp, Homo sapiens
cccccctcctcctcggcgcgcggc

SEQ ID NO: 51683 - DNA, 25 bp, Homo sapiens
cccccctcctcctcggcgcgcggcg

SEQ ID NO: 51684 - DNA, 26 bp, Homo sapiens
cccccctcctcctcggcgcgcggcgg

SEQ ID NO: 51685 - DNA, 27 bp, Homo sapiens
cccccctcctcctcggcgcgcggcggc

SEQ ID NO: 51686 - DNA, 30 bp, Homo sapiens
cccccctcctcctcggcgcgcggcggcggc

SEQ ID NO: 51687 - DNA, 18 bp, Homo sapiens
ccccctcctcctcggcgc

SEQ ID NO: 51688 - DNA, 19 bp, Homo sapiens
ccccctcctcctcggcgcg

SEQ ID NO: 51689 - DNA, 20 bp, Homo sapiens
ccccctcctcctcggcgcgc

SEQ ID NO: 51690 - DNA, 21 bp, Homo sapiens
ccccctcctcctcggcgcgcg

SEQ ID NO: 51691 - DNA, 22 bp, Homo sapiens
ccccctcctcctcggcgcgcgg

SEQ ID NO: 51692 - DNA, 23 bp, Homo sapiens
ccccctcctcctcggcgcgcggc

SEQ ID NO: 51693 - DNA, 24 bp, Homo sapiens
ccccctcctcctcggcgcgcggcg

SEQ ID NO: 51694 - DNA, 25 bp, Homo sapiens
ccccctcctcctcggcgcgcggcgg

SEQ ID NO: 51695 - DNA, 26 bp, Homo sapiens
ccccctcctcctcggcgcgcggcggc

SEQ ID NO: 51696 - DNA, 30 bp, Homo sapiens
ccccctcctcctcggcgcgcggcggcggcg

SEQ ID NO: 51697 - DNA, 17 bp, Homo sapiens
cccctcctcctcggcgc

SEQ ID NO: 51698 - DNA, 18 bp, Homo sapiens
cccctcctcctcggcgcg

SEQ ID NO: 51699 - DNA, 19 bp, Homo sapiens
cccctcctcctcggcgcgc

SEQ ID NO: 51700 - DNA, 20 bp, Homo sapiens
cccctcctcctcggcgcgcg

SEQ ID NO: 51701 - DNA, 21 bp, Homo sapiens
cccctcctcctcggcgcgcgg

SEQ ID NO: 51702 - DNA, 22 bp, Homo sapiens
cccctcctcctcggcgcgcggc

SEQ ID NO: 51703 - DNA, 23 bp, Homo sapiens
cccctcctcctcggcgcgcggcg

SEQ ID NO: 51704 - DNA, 24 bp, Homo sapiens
cccctcctcctcggcgcgcggcgg

SEQ ID NO: 51705 - DNA, 25 bp, Homo sapiens
cccctcctcctcggcgcgcggcggc

SEQ ID NO: 51706 - DNA, 26 bp, Homo sapiens
cccctcctcctcggcgcgcggcggcg

SEQ ID NO: 51707 - DNA, 27 bp, Homo sapiens
cccctcctcctcggcgcgcggcggcgg

SEQ ID NO: 51708 - DNA, 28 bp, Homo sapiens
cccctcctcctcggcgcgcggcggcggc

SEQ ID NO: 51709 - DNA, 30 bp, Homo sapiens
cccctcctcctcggcgcgcggcggcggcgg

SEQ ID NO: 51710 - DNA, 17 bp, Homo sapiens
ccctcctcctcggcgcg

SEQ ID NO: 51711 - DNA, 18 bp, Homo sapiens
ccctcctcctcggcgcgc

SEQ ID NO: 51712 - DNA, 19 bp, Homo sapiens
ccctcctcctcggcgcgcg

SEQ ID NO: 51713 - DNA, 20 bp, Homo sapiens
ccctcctcctcggcgcgcgg

SEQ ID NO: 51714 - DNA, 21 bp, Homo sapiens
ccctcctcctcggcgcgcggc

SEQ ID NO: 51715 - DNA, 22 bp, Homo sapiens
ccctcctcctcggcgcgcggcg

SEQ ID NO: 51716 - DNA, 23 bp, Homo sapiens
ccctcctcctcggcgcgcggcgg

SEQ ID NO: 51717 - DNA, 24 bp, Homo sapiens
ccctcctcctcggcgcgcggcggc

SEQ ID NO: 51718 - DNA, 26 bp, Homo sapiens
ccctcctcctcggcgcgcggcggcgg

SEQ ID NO: 51719 - DNA, 27 bp, Homo sapiens
ccctcctcctcggcgcgcggcggcggc

SEQ ID NO: 51720 - DNA, 19 bp, Homo sapiens
cctcctcctcggcgcgcgg

SEQ ID NO: 51721 - DNA, 20 bp, Homo sapiens
cctcctcctcggcgcgcggc

SEQ ID NO: 51722 - DNA, 22 bp, Homo sapiens
cctcctcctcggcgcgcggcgg

SEQ ID NO: 51723 - DNA, 23 bp, Homo sapiens
cctcctcctcggcgcgcggcggc

SEQ ID NO: 51724 - DNA, 24 bp, Homo sapiens
cctcctcctcggcgcgcggcggcg

SEQ ID NO: 51725 - DNA, 25 bp, Homo sapiens
cctcctcctcggcgcgcggcggcgg

SEQ ID NO: 51726 - DNA, 26 bp, Homo sapiens
cctcctcctcggcgcgcggcggcggc

SEQ ID NO: 51727 - DNA, 18 bp, Homo sapiens
ctcctcctcggcgcgcgg

SEQ ID NO: 51728 - DNA, 19 bp, Homo sapiens
ctcctcctcggcgcgcggc

SEQ ID NO: 51729 - DNA, 20 bp, Homo sapiens
ctcctcctcggcgcgcggcg

SEQ ID NO: 51730 - DNA, 21 bp, Homo sapiens
ctcctcctcggcgcgcggcgg

SEQ ID NO: 51731 - DNA, 22 bp, Homo sapiens
ctcctcctcggcgcgcggcggc

SEQ ID NO: 51732 - DNA, 23 bp, Homo sapiens
ctcctcctcggcgcgcggcggcg

SEQ ID NO: 51733 - DNA, 24 bp, Homo sapiens
ctcctcctcggcgcgcggcggcgg

SEQ ID NO: 51734 - DNA, 25 bp, Homo sapiens
ctcctcctcggcgcgcggcggcggc

SEQ ID NO: 51735 - DNA, 19 bp, Homo sapiens
tcctcctcggcgcgcggcg

SEQ ID NO: 51736 - DNA, 20 bp, Homo sapiens
tcctcctcggcgcgcggcgg

SEQ ID NO: 51737 - DNA, 21 bp, Homo sapiens
tcctcctcggcgcgcggcggc

SEQ ID NO: 51738 - DNA, 22 bp, Homo sapiens
tcctcctcggcgcgcggcggcg

SEQ ID NO: 51739 - DNA, 23 bp, Homo sapiens
tcctcctcggcgcgcggcggcgg

SEQ ID NO: 51740 - DNA, 24 bp, Homo sapiens
tcctcctcggcgcgcggcggcggc

SEQ ID NO: 51741 - DNA, 19 bp, Homo sapiens
cctcctcggcgcgcggcgg

SEQ ID NO: 51742 - DNA, 20 bp, Homo sapiens
cctcctcggcgcgcggcggc

SEQ ID NO: 51743 - DNA, 21 bp, Homo sapiens
cctcctcggcgcgcggcggcg

SEQ ID NO: 51744 - DNA, 22 bp, Homo sapiens
cctcctcggcgcgcggcggcgg

SEQ ID NO: 51745 - DNA, 23 bp, Homo sapiens
cctcctcggcgcgcggcggcggc

SEQ ID NO: 51746 - DNA, 26 bp, Homo sapiens
cctcctcggcgcgcggcggcggcggc

SEQ ID NO: 51747 - DNA, 16 bp, Homo sapiens
ctcctcggcgcgcggc

SEQ ID NO: 51748 - DNA, 18 bp, Homo sapiens
ctcctcggcgcgcggcgg

SEQ ID NO: 51749 - DNA, 19 bp, Homo sapiens
ctcctcggcgcgcggcggc

SEQ ID NO: 51750 - DNA, 20 bp, Homo sapiens
ctcctcggcgcgcggcggcg

SEQ ID NO: 51751 - DNA, 21 bp, Homo sapiens
ctcctcggcgcgcggcggcgg

SEQ ID NO: 51752 - DNA, 22 bp, Homo sapiens
ctcctcggcgcgcggcggcggc

SEQ ID NO: 51753 - DNA, 23 bp, Homo sapiens
ctcctcggcgcgcggcggcggcg

SEQ ID NO: 51754 - DNA, 24 bp, Homo sapiens
ctcctcggcgcgcggcggcggcgg

SEQ ID NO: 51755 - DNA, 25 bp, Homo sapiens
ctcctcggcgcgcggcggcggcggc

SEQ ID NO: 51756 - DNA, 26 bp, Homo sapiens
ctcctcggcgcgcggcggcggcggcg

SEQ ID NO: 51757 - DNA, 20 bp, Homo sapiens
cctcggcgcgcggcggcggc

SEQ ID NO: 51758 - DNA, 22 bp, Homo sapiens
cctcggcgcgcggcggcggcgg

SEQ ID NO: 51759 - DNA, 23 bp, Homo sapiens
cctcggcgcgcggcggcggcggc

SEQ ID NO: 51760 - DNA, 16 bp, Homo sapiens
ctcggcgcgcggcggc

SEQ ID NO: 51761 - DNA, 17 bp, Homo sapiens
ctcggcgcgcggcggcg

SEQ ID NO: 51762 - DNA, 18 bp, Homo sapiens
ctcggcgcgcggcggcgg

SEQ ID NO: 51763 - DNA, 19 bp, Homo sapiens
ctcggcgcgcggcggcggc

SEQ ID NO: 51764 - DNA, 20 bp, Homo sapiens
ctcggcgcgcggcggcggcg

SEQ ID NO: 51765 - DNA, 21 bp, Homo sapiens
ctcggcgcgcggcggcggcgg

SEQ ID NO: 51766 - DNA, 22 bp, Homo sapiens
ctcggcgcgcggcggcggcggc

SEQ ID NO: 51767 - DNA, 23 bp, Homo sapiens
ctcggcgcgcggcggcggcggcg

SEQ ID NO: 51768 - DNA, 24 bp, Homo sapiens
ctcggcgcgcggcggcggcggcgg

SEQ ID NO: 51769 - DNA, 25 bp, Homo sapiens
ctcggcgcgcggcggcggcggcggg

SEQ ID NO: 51770 - DNA, 26 bp, Homo sapiens
ctcggcgcgcggcggcggcggcgggc

SEQ ID NO: 51771 - DNA, 27 bp, Homo sapiens
ctcggcgcgcggcggcggcggcgggcg

SEQ ID NO: 51772 - DNA, 17 bp, Homo sapiens
tcggcgcgcggcggcgg

SEQ ID NO: 51773 - DNA, 18 bp, Homo sapiens
tcggcgcgcggcggcggc

SEQ ID NO: 51774 - DNA, 19 bp, Homo sapiens
tcggcgcgcggcggcggcg

SEQ ID NO: 51775 - DNA, 20 bp, Homo sapiens
tcggcgcgcggcggcggcgg

SEQ ID NO: 51776 - DNA, 21 bp, Homo sapiens
tcggcgcgcggcggcggcggc

SEQ ID NO: 51777 - DNA, 22 bp, Homo sapiens
tcggcgcgcggcggcggcggcg

SEQ ID NO: 51778 - DNA, 23 bp, Homo sapiens
tcggcgcgcggcggcggcggcgg

SEQ ID NO: 51779 - DNA, 25 bp, Homo sapiens
tcggcgcgcggcggcggcggcgggc

SEQ ID NO: 51780 - DNA, 26 bp, Homo sapiens
tcggcgcgcggcggcggcggcgggcg

SEQ ID NO: 51781 - DNA, 16 bp, Homo sapiens
cggcgcgcggcggcgg

SEQ ID NO: 51782 - DNA, 17 bp, Homo sapiens
cggcgcgcggcggcggc

SEQ ID NO: 51783 - DNA, 18 bp, Homo sapiens
cggcgcgcggcggcggcg

SEQ ID NO: 51784 - DNA, 19 bp, Homo sapiens
cggcgcgcggcggcggcgg

SEQ ID NO: 51785 - DNA, 20 bp, Homo sapiens
cggcgcgcggcggcggcggc

SEQ ID NO: 51786 - DNA, 21 bp, Homo sapiens
cggcgcgcggcggcggcggcg

SEQ ID NO: 51787 - DNA, 22 bp, Homo sapiens
cggcgcgcggcggcggcggcgg

SEQ ID NO: 51788 - DNA, 23 bp, Homo sapiens
cggcgcgcggcggcggcggcggg

SEQ ID NO: 51789 - DNA, 16 bp, Homo sapiens
ggcgcgcggcggcggc

SEQ ID NO: 51790 - DNA, 17 bp, Homo sapiens
ggcgcgcggcggcggcg

SEQ ID NO: 51791 - DNA, 18 bp, Homo sapiens
ggcgcgcggcggcggcgg

SEQ ID NO: 51792 - DNA, 19 bp, Homo sapiens
ggcgcgcggcggcggcggc

SEQ ID NO: 51793 - DNA, 20 bp, Homo sapiens
ggcgcgcggcggcggcggcg

SEQ ID NO: 51794 - DNA, 21 bp, Homo sapiens
ggcgcgcggcggcggcggcgg

SEQ ID NO: 51795 - DNA, 22 bp, Homo sapiens
ggcgcgcggcggcggcggcggg

SEQ ID NO: 51796 - DNA, 23 bp, Homo sapiens
ggcgcgcggcggcggcggcgggc

SEQ ID NO: 51797 - DNA, 24 bp, Homo sapiens
ggcgcgcggcggcggcggcgggcg

SEQ ID NO: 51798 - DNA, 25 bp, Homo sapiens
ggcgcgcggcggcggcggcgggcgg

SEQ ID NO: 51799 - DNA, 26 bp, Homo sapiens
ggcgcgcggcggcggcggcgggcggc

SEQ ID NO: 51800 - DNA, 27 bp, Homo sapiens
ggcgcgcggcggcggcggcgggcggcg

SEQ ID NO: 51801 - DNA, 28 bp, Homo sapiens
ggcgcgcggcggcggcggcgggcggcgg

SEQ ID NO: 51802 - DNA, 30 bp, Homo sapiens
ggcgcgcggcggcggcggcgggcggcggag

SEQ ID NO: 51803 - DNA, 18 bp, Homo sapiens
gcgcgcggcggcggcggc

SEQ ID NO: 51804 - DNA, 19 bp, Homo sapiens
gcgcgcggcggcggcggcg

SEQ ID NO: 51805 - DNA, 20 bp, Homo sapiens
gcgcgcggcggcggcggcgg

SEQ ID NO: 51806 - DNA, 22 bp, Homo sapiens
gcgcgcggcggcggcggcgggc

SEQ ID NO: 51807 - DNA, 20 bp, Homo sapiens
gcgcggcggcggcggcgggc

SEQ ID NO: 51808 - DNA, 21 bp, Homo sapiens
gcgcggcggcggcggcgggcg

SEQ ID NO: 51809 - DNA, 24 bp, Homo sapiens
gcgcggcggcggcggcgggcggcg

SEQ ID NO: 51810 - DNA, 16 bp, Homo sapiens
gcggcggcggcggcgg

SEQ ID NO: 51811 - DNA, 21 bp, Homo sapiens
ggcggcgggcggcggaggggc

SEQ ID NO: 51812 - DNA, 22 bp, Homo sapiens
ggcggcgggcggcggaggggcc

SEQ ID NO: 51813 - DNA, 23 bp, Homo sapiens
ggcggcgggcggcggaggggccg

SEQ ID NO: 51814 - DNA, 22 bp, Homo sapiens
gcggcgggcggcggaggggccg

SEQ ID NO: 51815 - DNA, 18 bp, Homo sapiens
ggcgggcggcggaggggc

SEQ ID NO: 51816 - DNA, 19 bp, Homo sapiens
ggcgggcggcggaggggcc

SEQ ID NO: 51817 - DNA, 20 bp, Homo sapiens
ggcgggcggcggaggggccg

SEQ ID NO: 51818 - DNA, 18 bp, Homo sapiens
gcgggcggcggaggggcc

SEQ ID NO: 51819 - DNA, 19 bp, Homo sapiens
gcgggcggcggaggggccg

SEQ ID NO: 51820 - DNA, 24 bp, Homo sapiens
gcgggcggcggaggggccgcgggc

SEQ ID NO: 51821 - DNA, 16 bp, Homo sapiens
gggcggcggaggggcc

SEQ ID NO: 51822 - DNA, 17 bp, Homo sapiens
gggcggcggaggggccg

SEQ ID NO: 51823 - DNA, 16 bp, Homo sapiens
ggcggcggaggggccg

SEQ ID NO: 51824 - DNA, 17 bp, Homo sapiens
ggcggcggaggggccgc

SEQ ID NO: 51825 - DNA, 18 bp, Homo sapiens
ggcggcggaggggccgcg

SEQ ID NO: 51826 - DNA, 19 bp, Homo sapiens
ggcggcggaggggccgcgg

SEQ ID NO: 51827 - DNA, 26 bp, Homo sapiens
ggcggcggaggggccgcgggccggtc

SEQ ID NO: 51828 - DNA, 27 bp, Homo sapiens
ggcggcggaggggccgcgggccggtcc

SEQ ID NO: 51829 - DNA, 30 bp, Homo sapiens
ggcggcggaggggccgcgggccggtccccc

SEQ ID NO: 51830 - DNA, 23 bp, Homo sapiens
gcggcggaggggccgcgggccgg

SEQ ID NO: 51831 - DNA, 22 bp, Homo sapiens
cggcggaggggccgcgggccgg

SEQ ID NO: 51832 - DNA, 18 bp, Homo sapiens
ggcggaggggccgcgggc

SEQ ID NO: 51833 - DNA, 21 bp, Homo sapiens
ggcggaggggccgcgggccgg

SEQ ID NO: 51834 - DNA, 22 bp, Homo sapiens
ggcggaggggccgcgggccggt

SEQ ID NO: 51835 - DNA, 20 bp, Homo sapiens
gcggaggggccgcgggccgg

SEQ ID NO: 51836 - DNA, 21 bp, Homo sapiens
gcggaggggccgcgggccggt

SEQ ID NO: 51837 - DNA, 22 bp, Homo sapiens
gcggaggggccgcgggccggtc

SEQ ID NO: 51838 - DNA, 23 bp, Homo sapiens
gcggaggggccgcgggccggtcc

SEQ ID NO: 51839 - DNA, 25 bp, Homo sapiens
gcggaggggccgcgggccggtcccc

SEQ ID NO: 51840 - DNA, 26 bp, Homo sapiens
gcggaggggccgcgggccggtccccc

SEQ ID NO: 51841 - DNA, 16 bp, Homo sapiens
cggaggggccgcgggc

SEQ ID NO: 51842 - DNA, 19 bp, Homo sapiens
cggaggggccgcgggccgg

SEQ ID NO: 51843 - DNA, 20 bp, Homo sapiens
cggaggggccgcgggccggt

SEQ ID NO: 51844 - DNA, 18 bp, Homo sapiens
ggaggggccgcgggccgg

SEQ ID NO: 51845 - DNA, 19 bp, Homo sapiens
ggaggggccgcgggccggt

SEQ ID NO: 51846 - DNA, 20 bp, Homo sapiens
ggaggggccgcgggccggtc

SEQ ID NO: 51847 - DNA, 21 bp, Homo sapiens
ggaggggccgcgggccggtcc

SEQ ID NO: 51848 - DNA, 17 bp, Homo sapiens
gaggggccgcgggccgg

SEQ ID NO: 51849 - DNA, 18 bp, Homo sapiens
gaggggccgcgggccggt

SEQ ID NO: 51850 - DNA, 19 bp, Homo sapiens
gaggggccgcgggccggtc

SEQ ID NO: 51851 - DNA, 20 bp, Homo sapiens
gaggggccgcgggccggtcc

SEQ ID NO: 51852 - DNA, 17 bp, Homo sapiens
aggggccgcgggccggt

SEQ ID NO: 51853 - DNA, 16 bp, Homo sapiens
ggggccgcgggccggt

SEQ ID NO: 51854 - DNA, 17 bp, Homo sapiens
ggggccgcgggccggtc

SEQ ID NO: 51855 - DNA, 24 bp, Homo sapiens
cgcgggccggtcccccccgccggg

SEQ ID NO: 51856 - DNA, 18 bp, Homo sapiens
gcgggccggtcccccccg

SEQ ID NO: 51857 - DNA, 26 bp, Homo sapiens
gcgggccggtcccccccgccgggtcc

SEQ ID NO: 51858 - DNA, 17 bp, Homo sapiens
cgggccggtcccccccg

SEQ ID NO: 51859 - DNA, 18 bp, Homo sapiens
cgggccggtcccccccgc

SEQ ID NO: 51860 - DNA, 19 bp, Homo sapiens
cgggccggtcccccccgcc

SEQ ID NO: 51861 - DNA, 20 bp, Homo sapiens
cgggccggtcccccccgccg

SEQ ID NO: 51862 - DNA, 21 bp, Homo sapiens
cgggccggtcccccccgccgg

SEQ ID NO: 51863 - DNA, 22 bp, Homo sapiens
cgggccggtcccccccgccggg

SEQ ID NO: 51864 - DNA, 23 bp, Homo sapiens
cgggccggtcccccccgccgggt

SEQ ID NO: 51865 - DNA, 24 bp, Homo sapiens
cgggccggtcccccccgccgggtc

SEQ ID NO: 51866 - DNA, 25 bp, Homo sapiens
cgggccggtcccccccgccgggtcc

SEQ ID NO: 51867 - DNA, 26 bp, Homo sapiens
cgggccggtcccccccgccgggtccg

SEQ ID NO: 51868 - DNA, 27 bp, Homo sapiens
cgggccggtcccccccgccgggtccgc

SEQ ID NO: 51869 - DNA, 28 bp, Homo sapiens
cgggccggtcccccccgccgggtccgcc

SEQ ID NO: 51870 - DNA, 30 bp, Homo sapiens
cgggccggtcccccccgccgggtccgcccc

SEQ ID NO: 51871 - DNA, 16 bp, Homo sapiens
gggccggtcccccccg

SEQ ID NO: 51872 - DNA, 17 bp, Homo sapiens
gggccggtcccccccgc

SEQ ID NO: 51873 - DNA, 18 bp, Homo sapiens
gggccggtcccccccgcc

SEQ ID NO: 51874 - DNA, 19 bp, Homo sapiens
gggccggtcccccccgccg

SEQ ID NO: 51875 - DNA, 20 bp, Homo sapiens
gggccggtcccccccgccgg

SEQ ID NO: 51876 - DNA, 22 bp, Homo sapiens
gggccggtcccccccgccgggt

SEQ ID NO: 51877 - DNA, 23 bp, Homo sapiens
gggccggtcccccccgccgggtc

SEQ ID NO: 51878 - DNA, 27 bp, Homo sapiens
gggccggtcccccccgccgggtccgcc

SEQ ID NO: 51879 - DNA, 16 bp, Homo sapiens
ggccggtcccccccgc

SEQ ID NO: 51880 - DNA, 17 bp, Homo sapiens
ggccggtcccccccgcc

SEQ ID NO: 51881 - DNA, 18 bp, Homo sapiens
ggccggtcccccccgccg

SEQ ID NO: 51882 - DNA, 20 bp, Homo sapiens
ggccggtcccccccgccggg

SEQ ID NO: 51883 - DNA, 21 bp, Homo sapiens
ggccggtcccccccgccgggt

SEQ ID NO: 51884 - DNA, 22 bp, Homo sapiens
ggccggtcccccccgccgggtc

SEQ ID NO: 51885 - DNA, 23 bp, Homo sapiens
ggccggtcccccccgccgggtcc

SEQ ID NO: 51886 - DNA, 24 bp, Homo sapiens
ggccggtcccccccgccgggtccg

SEQ ID NO: 51887 - DNA, 26 bp, Homo sapiens
ggccggtcccccccgccgggtccgcc

SEQ ID NO: 51888 - DNA, 19 bp, Homo sapiens
gccggtcccccccgccggg

SEQ ID NO: 51889 - DNA, 20 bp, Homo sapiens
gccggtcccccccgccgggt

SEQ ID NO: 51890 - DNA, 17 bp, Homo sapiens
cggtcccccccgccggg

SEQ ID NO: 51891 - DNA, 18 bp, Homo sapiens
cggtcccccccgccgggt

SEQ ID NO: 51892 - DNA, 19 bp, Homo sapiens
cggtcccccccgccgggtc

SEQ ID NO: 51893 - DNA, 16 bp, Homo sapiens
ggtcccccccgccggg

SEQ ID NO: 51894 - DNA, 17 bp, Homo sapiens
ggtcccccccgccgggt

SEQ ID NO: 51895 - DNA, 18 bp, Homo sapiens
ggtcccccccgccgggtc

SEQ ID NO: 51896 - DNA, 19 bp, Homo sapiens
ggtcccccccgccgggtcc

SEQ ID NO: 51897 - DNA, 17 bp, Homo sapiens
gtcccccccgccgggtc

SEQ ID NO: 51898 - DNA, 18 bp, Homo sapiens
gtcccccccgccgggtcc

SEQ ID NO: 51899 - DNA, 19 bp, Homo sapiens
gtcccccccgccgggtccg

SEQ ID NO: 51900 - DNA, 20 bp, Homo sapiens
gtcccccccgccgggtccgc

SEQ ID NO: 51901 - DNA, 21 bp, Homo sapiens
gtcccccccgccgggtccgcc

SEQ ID NO: 51902 - DNA, 20 bp, Homo sapiens
cccccccgccgggtccgccc

SEQ ID NO: 51903 - DNA, 17 bp, Homo sapiens
ccccccgccgggtccgc

SEQ ID NO: 51904 - DNA, 18 bp, Homo sapiens
ccccccgccgggtccgcc

SEQ ID NO: 51905 - DNA, 19 bp, Homo sapiens
ccccccgccgggtccgccc

SEQ ID NO: 51906 - DNA, 20 bp, Homo sapiens
ccccccgccgggtccgcccc

SEQ ID NO: 51907 - DNA, 21 bp, Homo sapiens
ccccccgccgggtccgccccc

SEQ ID NO: 51908 - DNA, 17 bp, Homo sapiens
cccccgccgggtccgcc

SEQ ID NO: 51909 - DNA, 18 bp, Homo sapiens
cccccgccgggtccgccc

SEQ ID NO: 51910 - DNA, 19 bp, Homo sapiens
cccccgccgggtccgcccc

SEQ ID NO: 51911 - DNA, 20 bp, Homo sapiens
cccccgccgggtccgccccc

SEQ ID NO: 51912 - DNA, 21 bp, Homo sapiens
cccccgccgggtccgcccccg

SEQ ID NO: 51913 - DNA, 17 bp, Homo sapiens
ccccgccgggtccgccc

SEQ ID NO: 51914 - DNA, 18 bp, Homo sapiens
ccccgccgggtccgcccc

SEQ ID NO: 51915 - DNA, 22 bp, Homo sapiens
cccgccgggtccgcccccgggg

SEQ ID NO: 51916 - DNA, 23 bp, Homo sapiens
cccgccgggtccgcccccggggc

SEQ ID NO: 51917 - DNA, 25 bp, Homo sapiens
cccgccgggtccgcccccggggccg

SEQ ID NO: 51918 - DNA, 26 bp, Homo sapiens
cccgccgggtccgcccccggggccgc

SEQ ID NO: 51919 - DNA, 28 bp, Homo sapiens
cccgccgggtccgcccccggggccgcgg

SEQ ID NO: 51920 - DNA, 30 bp, Homo sapiens; identical to SEQ ID NO: 24667

SEQ ID NO: 51921 - DNA, 19 bp, Homo sapiens
ccgccgggtccgcccccgg

SEQ ID NO: 51922 - DNA, 21 bp, Homo sapiens
ccgccgggtccgcccccgggg

SEQ ID NO: 51923 - DNA, 22 bp, Homo sapiens
ccgccgggtccgcccccggggc

SEQ ID NO: 51924 - DNA, 23 bp, Homo sapiens
ccgccgggtccgcccccggggcc

SEQ ID NO: 51925 - DNA, 24 bp, Homo sapiens
ccgccgggtccgcccccggggccg

SEQ ID NO: 51926 - DNA, 25 bp, Homo sapiens
ccgccgggtccgcccccggggccgc

SEQ ID NO: 51927 - DNA, 26 bp, Homo sapiens
ccgccgggtccgcccccggggccgcg

SEQ ID NO: 51928 - DNA, 27 bp, Homo sapiens
ccgccgggtccgcccccggggccgcgg

SEQ ID NO: 51929 - DNA, 29 bp, Homo sapiens
ccgccgggtccgcccccggggccgcggtt

SEQ ID NO: 51930 - DNA, 20 bp, Homo sapiens
cgccgggtccgcccccgggg

SEQ ID NO: 51931 - DNA, 23 bp, Homo sapiens
cgccgggtccgcccccggggccg

SEQ ID NO: 51932 - DNA, 24 bp, Homo sapiens
cgccgggtccgcccccggggccgc

SEQ ID NO: 51933 - DNA, 25 bp, Homo sapiens
cgccgggtccgcccccggggccgcg

SEQ ID NO: 51934 - DNA, 26 bp, Homo sapiens
cgccgggtccgcccccggggccgcgg

SEQ ID NO: 51935 - DNA, 19 bp, Homo sapiens
gccgggtccgcccccgggg

SEQ ID NO: 51936 - DNA, 22 bp, Homo sapiens
gccgggtccgcccccggggccg

SEQ ID NO: 51937 - DNA, 23 bp, Homo sapiens
gccgggtccgcccccggggccgc

SEQ ID NO: 51938 - DNA, 24 bp, Homo sapiens
gccgggtccgcccccggggccgcg

SEQ ID NO: 51939 - DNA, 18 bp, Homo sapiens
gggtccgcccccggggcc

SEQ ID NO: 51940 - DNA, 19 bp, Homo sapiens
gggtccgcccccggggccg

SEQ ID NO: 51941 - DNA, 20 bp, Homo sapiens
gggtccgcccccggggccgc

SEQ ID NO: 51942 - DNA, 16 bp, Homo sapiens
ggtccgcccccggggc

SEQ ID NO: 51943 - DNA, 17 bp, Homo sapiens
ggtccgcccccggggcc

SEQ ID NO: 51944 - DNA, 18 bp, Homo sapiens
ggtccgcccccggggccg

SEQ ID NO: 51945 - DNA, 19 bp, Homo sapiens
ggtccgcccccggggccgc

SEQ ID NO: 51946 - DNA, 20 bp, Homo sapiens
ggtccgcccccggggccgcg

SEQ ID NO: 51947 - DNA, 21 bp, Homo sapiens
ggtccgcccccggggccgcgg

SEQ ID NO: 51948 - DNA, 22 bp, Homo sapiens
ggtccgcccccggggccgcggt

SEQ ID NO: 51949 - DNA, 23 bp, Homo sapiens
ggtccgcccccggggccgcggtt

SEQ ID NO: 51950 - DNA, 24 bp, Homo sapiens
ggtccgcccccggggccgcggttc

SEQ ID NO: 51951 - DNA, 25 bp, Homo sapiens
ggtccgcccccggggccgcggttcc

SEQ ID NO: 51952 - DNA, 18 bp, Homo sapiens
gtccgcccccggggccgc

SEQ ID NO: 51953 - DNA, 19 bp, Homo sapiens
cgcccccggggccgcggtt

SEQ ID NO: 51954 - DNA, 20 bp, Homo sapiens
cgcccccggggccgcggttc

SEQ ID NO: 51955 - DNA, 16 bp, Homo sapiens
cccccggggccgcggt

SEQ ID NO: 51956 - DNA, 17 bp, Homo sapiens
cccccggggccgcggtt

SEQ ID NO: 51957 - DNA, 16 bp, Homo sapiens
cccggggccgcggttc

SEQ ID NO: 51958 - DNA, 17 bp, Homo sapiens
cccggggccgcggttcc

SEQ ID NO: 51959 - DNA, 18 bp, Homo sapiens
cccggggccgcggttccg

SEQ ID NO: 51960 - DNA, 16 bp, Homo sapiens
ccggggccgcggttcc

SEQ ID NO: 51961 - DNA, 19 bp, Homo sapiens
ggccgcggttccgcgcggc

SEQ ID NO: 51962 - DNA, 30 bp, Homo sapiens
gcggttccgcgcggcgcctcgcctcggccg

SEQ ID NO: 51963 - DNA, 16 bp, Homo sapiens
ggttccgcgcggcgcc

SEQ ID NO: 51964 - DNA, 18 bp, Homo sapiens
ggttccgcgcggcgcctc

SEQ ID NO: 51965 - DNA, 19 bp, Homo sapiens
ggttccgcgcggcgcctcg

SEQ ID NO: 51966 - DNA, 20 bp, Homo sapiens
ggttccgcgcggcgcctcgc

SEQ ID NO: 51967 - DNA, 21 bp, Homo sapiens
ggttccgcgcggcgcctcgcc

SEQ ID NO: 51968 - DNA, 22 bp, Homo sapiens
ggttccgcgcggcgcctcgcct

SEQ ID NO: 51969 - DNA, 23 bp, Homo sapiens
ggttccgcgcggcgcctcgcctc

SEQ ID NO: 51970 - DNA, 24 bp, Homo sapiens
ggttccgcgcggcgcctcgcctcg

SEQ ID NO: 51971 - DNA, 26 bp, Homo sapiens
ggttccgcgcggcgcctcgcctcggc

SEQ ID NO: 51972 - DNA, 27 bp, Homo sapiens
ggttccgcgcggcgcctcgcctcggcc

SEQ ID NO: 51973 - DNA, 30 bp, Homo sapiens
ggttccgcgcggcgcctcgcctcggccggc

SEQ ID NO: 51974 - DNA, 18 bp, Homo sapiens
gttccgcgcggcgcctcg

SEQ ID NO: 51975 - DNA, 19 bp, Homo sapiens
gttccgcgcggcgcctcgc

SEQ ID NO: 51976 - DNA, 20 bp, Homo sapiens
gttccgcgcggcgcctcgcc

SEQ ID NO: 51977 - DNA, 21 bp, Homo sapiens
gttccgcgcggcgcctcgcct

SEQ ID NO: 51978 - DNA, 22 bp, Homo sapiens
gttccgcgcggcgcctcgcctc

SEQ ID NO: 51979 - DNA, 23 bp, Homo sapiens
gttccgcgcggcgcctcgcctcg

SEQ ID NO: 51980 - DNA, 24 bp, Homo sapiens
gttccgcgcggcgcctcgcctcgg

SEQ ID NO: 51981 - DNA, 25 bp, Homo sapiens
gttccgcgcggcgcctcgcctcggc

SEQ ID NO: 51982 - DNA, 26 bp, Homo sapiens
gttccgcgcggcgcctcgcctcggcc

SEQ ID NO: 51983 - DNA, 17 bp, Homo sapiens
ccgcgcggcgcctcgcc

SEQ ID NO: 51984 - DNA, 21 bp, Homo sapiens
cgcgcggcgcctcgcctcggc

SEQ ID NO: 51985 - DNA, 24 bp, Homo sapiens
cgcgcggcgcctcgcctcggccgg

SEQ ID NO: 51986 - DNA, 20 bp, Homo sapiens
gcgcggcgcctcgcctcggc

SEQ ID NO: 51987 - DNA, 21 bp, Homo sapiens
gcgcggcgcctcgcctcggcc

SEQ ID NO: 51988 - DNA, 22 bp, Homo sapiens
gcgcggcgcctcgcctcggccg

SEQ ID NO: 51989 - DNA, 23 bp, Homo sapiens
gcgcggcgcctcgcctcggccgg

SEQ ID NO: 51990 - DNA, 19 bp, Homo sapiens
cgcggcgcctcgcctcggc

SEQ ID NO: 51991 - DNA, 21 bp, Homo sapiens
cgcggcgcctcgcctcggccg

SEQ ID NO: 51992 - DNA, 22 bp, Homo sapiens
cgcggcgcctcgcctcggccgg

SEQ ID NO: 51993 - DNA, 20 bp, Homo sapiens
gcggcgcctcgcctcggccg

SEQ ID NO: 51994 - DNA, 21 bp, Homo sapiens
gcggcgcctcgcctcggccgg

SEQ ID NO: 51995 - DNA, 22 bp, Homo sapiens
gcggcgcctcgcctcggccggc

SEQ ID NO: 51996 - DNA, 20 bp, Homo sapiens
cggcgcctcgcctcggccgg

SEQ ID NO: 51997 - DNA, 21 bp, Homo sapiens
cggcgcctcgcctcggccggc

SEQ ID NO: 51998 - DNA, 17 bp, Homo sapiens
ggcgcctcgcctcggcc

SEQ ID NO: 51999 - DNA, 18 bp, Homo sapiens
ggcgcctcgcctcggccg

SEQ ID NO: 52000 - DNA, 19 bp, Homo sapiens
ggcgcctcgcctcggccgg

SEQ ID NO: 52001 - DNA, 20 bp, Homo sapiens
ggcgcctcgcctcggccggc

SEQ ID NO: 52002 - DNA, 21 bp, Homo sapiens
ggcgcctcgcctcggccggcg

SEQ ID NO: 52003 - DNA, 18 bp, Homo sapiens
gcgcctcgcctcggccgg

SEQ ID NO: 52004 - DNA, 20 bp, Homo sapiens
gcgcctcgcctcggccggcg

SEQ ID NO: 52005 - DNA, 19 bp, Homo sapiens
cgcctcgcctcggccggcg

SEQ ID NO: 52006 - DNA, 16 bp, Homo sapiens
gcctcgcctcggccgg

SEQ ID NO: 52007 - DNA, 30 bp, Homo sapiens
gcctcggccggcgcctagcagccgacttag

SEQ ID NO: 52008 - DNA, 17 bp, Homo sapiens
cctcggccggcgcctag

SEQ ID NO: 52009 - DNA, 21 bp, Homo sapiens
cctcggccggcgcctagcagc

SEQ ID NO: 52010 - DNA, 30 bp, Homo sapiens
ggccggcgcctagcagccgacttagaactg

SEQ ID NO: 52011 - DNA, 29 bp, Homo sapiens
gccggcgcctagcagccgacttagaactg

SEQ ID NO: 52012 - DNA, 30 bp, Homo sapiens
gccggcgcctagcagccgacttagaactgg

SEQ ID NO: 52013 - DNA, 30 bp, Homo sapiens
cggcgcctagcagccgacttagaactggtg

SEQ ID NO: 52014 - DNA, 21 bp, Homo sapiens
ggcgcctagcagccgacttag

SEQ ID NO: 52015 - DNA, 22 bp, Homo sapiens
ggcgcctagcagccgacttaga

SEQ ID NO: 52016 - DNA, 24 bp, Homo sapiens
ggcgcctagcagccgacttagaac

SEQ ID NO: 52017 - DNA, 25 bp, Homo sapiens
ggcgcctagcagccgacttagaact

SEQ ID NO: 52018 - DNA, 26 bp, Homo sapiens
ggcgcctagcagccgacttagaactg

SEQ ID NO: 52019 - DNA, 27 bp, Homo sapiens
ggcgcctagcagccgacttagaactgg

SEQ ID NO: 52020 - DNA, 29 bp, Homo sapiens
ggcgcctagcagccgacttagaactggtg

SEQ ID NO: 52021 - DNA, 30 bp, Homo sapiens
ggcgcctagcagccgacttagaactggtgc

SEQ ID NO: 52022 - DNA, 20 bp, Homo sapiens
gcgcctagcagccgacttag

SEQ ID NO: 52023 - DNA, 21 bp, Homo sapiens
gcgcctagcagccgacttaga

SEQ ID NO: 52024 - DNA, 23 bp, Homo sapiens
gcgcctagcagccgacttagaac

SEQ ID NO: 52025 - DNA, 24 bp, Homo sapiens
gcgcctagcagccgacttagaact

SEQ ID NO: 52026 - DNA, 25 bp, Homo sapiens
gcgcctagcagccgacttagaactg

SEQ ID NO: 52027 - DNA, 26 bp, Homo sapiens
gcgcctagcagccgacttagaactgg

SEQ ID NO: 52028 - DNA, 27 bp, Homo sapiens
gcgcctagcagccgacttagaactggt

SEQ ID NO: 52029 - DNA, 28 bp, Homo sapiens
gcgcctagcagccgacttagaactggtg

SEQ ID NO: 52030 - DNA, 30 bp, Homo sapiens
gcgcctagcagccgacttagaactggtgcg

SEQ ID NO: 52031 - DNA, 19 bp, Homo sapiens
cgcctagcagccgacttag

SEQ ID NO: 52032 - DNA, 20 bp, Homo sapiens
cgcctagcagccgacttaga

SEQ ID NO: 52033 - DNA, 21 bp, Homo sapiens
cgcctagcagccgacttagaa

SEQ ID NO: 52034 - DNA, 22 bp, Homo sapiens
cgcctagcagccgacttagaac

SEQ ID NO: 52035 - DNA, 23 bp, Homo sapiens
cgcctagcagccgacttagaact

SEQ ID NO: 52036 - DNA, 24 bp, Homo sapiens
cgcctagcagccgacttagaactg

SEQ ID NO: 52037 - DNA, 25 bp, Homo sapiens
cgcctagcagccgacttagaactgg

SEQ ID NO: 52038 - DNA, 26 bp, Homo sapiens
cgcctagcagccgacttagaactggt

SEQ ID NO: 52039 - DNA, 27 bp, Homo sapiens
cgcctagcagccgacttagaactggtg

SEQ ID NO: 52040 - DNA, 28 bp, Homo sapiens
cgcctagcagccgacttagaactggtgc

SEQ ID NO: 52041 - DNA, 29 bp, Homo sapiens
cgcctagcagccgacttagaactggtgcg

SEQ ID NO: 52042 - DNA, 30 bp, Homo sapiens
cgcctagcagccgacttagaactggtgcgg

SEQ ID NO: 52043 - DNA, 19 bp, Homo sapiens
gcctagcagccgacttaga

SEQ ID NO: 52044 - DNA, 21 bp, Homo sapiens
gcctagcagccgacttagaac

SEQ ID NO: 52045 - DNA, 22 bp, Homo sapiens
gcctagcagccgacttagaact

SEQ ID NO: 52046 - DNA, 24 bp, Homo sapiens
gcctagcagccgacttagaactgg

SEQ ID NO: 52047 - DNA, 25 bp, Homo sapiens
gcctagcagccgacttagaactggt

SEQ ID NO: 52048 - DNA, 29 bp, Homo sapiens
gcctagcagccgacttagaactggtgcgg

SEQ ID NO: 52049 - DNA, 17 bp, Homo sapiens
cctagcagccgacttag

SEQ ID NO: 52050 - DNA, 18 bp, Homo sapiens
cctagcagccgacttaga

SEQ ID NO: 52051 - DNA, 20 bp, Homo sapiens
cctagcagccgacttagaac

SEQ ID NO: 52052 - DNA, 21 bp, Homo sapiens
cctagcagccgacttagaact

SEQ ID NO: 52053 - DNA, 22 bp, Homo sapiens
cctagcagccgacttagaactg

SEQ ID NO: 52054 - DNA, 23 bp, Homo sapiens
cctagcagccgacttagaactgg

SEQ ID NO: 52055 - DNA, 24 bp, Homo sapiens
cctagcagccgacttagaactggt

SEQ ID NO: 52056 - DNA, 25 bp, Homo sapiens
cctagcagccgacttagaactggtg

SEQ ID NO: 52057 - DNA, 26 bp, Homo sapiens
cctagcagccgacttagaactggtgc

SEQ ID NO: 52058 - DNA, 27 bp, Homo sapiens
cctagcagccgacttagaactggtgcg

SEQ ID NO: 52059 - DNA, 28 bp, Homo sapiens
cctagcagccgacttagaactggtgcgg

SEQ ID NO: 52060 - DNA, 29 bp, Homo sapiens
cctagcagccgacttagaactggtgcgga

SEQ ID NO: 52061 - DNA, 30 bp, Homo sapiens
cctagcagccgacttagaactggtgcggac

SEQ ID NO: 52062 - DNA, 19 bp, Homo sapiens
ctagcagccgacttagaac

SEQ ID NO: 52063 - DNA, 20 bp, Homo sapiens
ctagcagccgacttagaact

SEQ ID NO: 52064 - DNA, 21 bp, Homo sapiens
ctagcagccgacttagaactg

SEQ ID NO: 52065 - DNA, 22 bp, Homo sapiens
ctagcagccgacttagaactgg

SEQ ID NO: 52066 - DNA, 23 bp, Homo sapiens
ctagcagccgacttagaactggt

SEQ ID NO: 52067 - DNA, 24 bp, Homo sapiens
ctagcagccgacttagaactggtg

SEQ ID NO: 52068 - DNA, 25 bp, Homo sapiens
ctagcagccgacttagaactggtgc

SEQ ID NO: 52069 - DNA, 30 bp, Homo sapiens
ctagcagccgacttagaactggtgcggacc

SEQ ID NO: 52070 - DNA, 17 bp, Homo sapiens
tagcagccgacttagaa

SEQ ID NO: 52071 - DNA, 18 bp, Homo sapiens
tagcagccgacttagaac

SEQ ID NO: 52072 - DNA, 19 bp, Homo sapiens
tagcagccgacttagaact

SEQ ID NO: 52073 - DNA, 20 bp, Homo sapiens
tagcagccgacttagaactg

SEQ ID NO: 52074 - DNA, 21 bp, Homo sapiens
tagcagccgacttagaactgg

SEQ ID NO: 52075 - DNA, 22 bp, Homo sapiens
tagcagccgacttagaactggt

SEQ ID NO: 52076 - DNA, 23 bp, Homo sapiens
tagcagccgacttagaactggtg

SEQ ID NO: 52077 - DNA, 24 bp, Homo sapiens
tagcagccgacttagaactggtgc

SEQ ID NO: 52078 - DNA, 26 bp, Homo sapiens
tagcagccgacttagaactggtgcgg

SEQ ID NO: 52079 - DNA, 29 bp, Homo sapiens
tagcagccgacttagaactggtgcggacc

SEQ ID NO: 52080 - DNA, 17 bp, Homo sapiens
agcagccgacttagaac

SEQ ID NO: 52081 - DNA, 18 bp, Homo sapiens
agcagccgacttagaact

SEQ ID NO: 52082 - DNA, 19 bp, Homo sapiens
agcagccgacttagaactg

SEQ ID NO: 52083 - DNA, 20 bp, Homo sapiens
agcagccgacttagaactgg

SEQ ID NO: 52084 - DNA, 21 bp, Homo sapiens
agcagccgacttagaactggt

SEQ ID NO: 52085 - DNA, 22 bp, Homo sapiens
agcagccgacttagaactggtg

SEQ ID NO: 52086 - DNA, 23 bp, Homo sapiens
agcagccgacttagaactggtgc

SEQ ID NO: 52087 - DNA, 24 bp, Homo sapiens
agcagccgacttagaactggtgcg

SEQ ID NO: 52088 - DNA, 25 bp, Homo sapiens
agcagccgacttagaactggtgcgg

SEQ ID NO: 52089 - DNA, 26 bp, Homo sapiens
agcagccgacttagaactggtgcgga

SEQ ID NO: 52090 - DNA, 27 bp, Homo sapiens
agcagccgacttagaactggtgcggac

SEQ ID NO: 52091 - DNA, 28 bp, Homo sapiens
agcagccgacttagaactggtgcggacc

SEQ ID NO: 52092 - DNA, 30 bp, Homo sapiens; identical to SEQ ID NO: 5383

SEQ ID NO: 52093 - DNA, 16 bp, Homo sapiens
gcagccgacttagaac

SEQ ID NO: 52094 - DNA, 17 bp, Homo sapiens
gcagccgacttagaact

SEQ ID NO: 52095 - DNA, 18 bp, Homo sapiens
gcagccgacttagaactg

SEQ ID NO: 52096 - DNA, 19 bp, Homo sapiens
gcagccgacttagaactgg

SEQ ID NO: 52097 - DNA, 20 bp, Homo sapiens
gcagccgacttagaactggt

SEQ ID NO: 52098 - DNA, 21 bp, Homo sapiens
gcagccgacttagaactggtg

SEQ ID NO: 52099 - DNA, 22 bp, Homo sapiens
gcagccgacttagaactggtgc

SEQ ID NO: 52100 - DNA, 23 bp, Homo sapiens
gcagccgacttagaactggtgcg

SEQ ID NO: 52101 - DNA, 24 bp, Homo sapiens
gcagccgacttagaactggtgcgg

SEQ ID NO: 52102 - DNA, 25 bp, Homo sapiens
gcagccgacttagaactggtgcgga

SEQ ID NO: 52103 - DNA, 26 bp, Homo sapiens
gcagccgacttagaactggtgcggac

SEQ ID NO: 52104 - DNA, 27 bp, Homo sapiens
gcagccgacttagaactggtgcggacc

SEQ ID NO: 52105 - DNA, 30 bp, Homo sapiens; identical to SEQ ID NO: 24801

SEQ ID NO: 52106 - DNA, 16 bp, Homo sapiens
cagccgacttagaact

SEQ ID NO: 52107 - DNA, 17 bp, Homo sapiens
cagccgacttagaactg

SEQ ID NO: 52108 - DNA, 18 bp, Homo sapiens
cagccgacttagaactgg

SEQ ID NO: 52109 - DNA, 19 bp, Homo sapiens
cagccgacttagaactggt

SEQ ID NO: 52110 - DNA, 20 bp, Homo sapiens
cagccgacttagaactggtg

SEQ ID NO: 52111 - DNA, 21 bp, Homo sapiens
cagccgacttagaactggtgc

SEQ ID NO: 52112 - DNA, 22 bp, Homo sapiens
cagccgacttagaactggtgcg

SEQ ID NO: 52113 - DNA, 23 bp, Homo sapiens
cagccgacttagaactggtgcgg

SEQ ID NO: 52114 - DNA, 24 bp, Homo sapiens
cagccgacttagaactggtgcgga

SEQ ID NO: 52115 - DNA, 25 bp, Homo sapiens
cagccgacttagaactggtgcggac

SEQ ID NO: 52116 - DNA, 26 bp, Homo sapiens
cagccgacttagaactggtgcggacc

SEQ ID NO: 52117 - DNA, 27 bp, Homo sapiens
cagccgacttagaactggtgcggacca

SEQ ID NO: 52118 - DNA, 28 bp, Homo sapiens
cagccgacttagaactggtgcggaccag

SEQ ID NO: 52119 - DNA, 29 bp, Homo sapiens
cagccgacttagaactggtgcggaccagg

SEQ ID NO: 52120 - DNA, 30 bp, Homo sapiens
cagccgacttagaactggtgcggaccaggg

SEQ ID NO: 52121 - DNA, 16 bp, Homo sapiens
agccgacttagaactg

SEQ ID NO: 52122 - DNA, 17 bp, Homo sapiens
agccgacttagaactgg

SEQ ID NO: 52123 - DNA, 18 bp, Homo sapiens
agccgacttagaactggt

SEQ ID NO: 52124 - DNA, 19 bp, Homo sapiens
agccgacttagaactggtg

SEQ ID NO: 52125 - DNA, 20 bp, Homo sapiens
agccgacttagaactggtgc

SEQ ID NO: 52126 - DNA, 21 bp, Homo sapiens
agccgacttagaactggtgcg

SEQ ID NO: 52127 - DNA, 22 bp, Homo sapiens
agccgacttagaactggtgcgg

SEQ ID NO: 52128 - DNA, 23 bp, Homo sapiens
agccgacttagaactggtgcgga

SEQ ID NO: 52129 - DNA, 24 bp, Homo sapiens
agccgacttagaactggtgcggac

SEQ ID NO: 52130 - DNA, 25 bp, Homo sapiens
agccgacttagaactggtgcggacc

SEQ ID NO: 52131 - DNA, 30 bp, Homo sapiens
agccgacttagaactggtgcggaccagggg

SEQ ID NO: 52132 - DNA, 16 bp, Homo sapiens
gccgacttagaactgg

SEQ ID NO: 52133 - DNA, 17 bp, Homo sapiens
gccgacttagaactggt

SEQ ID NO: 52134 - DNA, 18 bp, Homo sapiens
gccgacttagaactggtg

SEQ ID NO: 52135 - DNA, 19 bp, Homo sapiens
gccgacttagaactggtgc

SEQ ID NO: 52136 - DNA, 20 bp, Homo sapiens
gccgacttagaactggtgcg

SEQ ID NO: 52137 - DNA, 21 bp, Homo sapiens
gccgacttagaactggtgcgg

SEQ ID NO: 52138 - DNA, 22 bp, Homo sapiens
gccgacttagaactggtgcgga

SEQ ID NO: 52139 - DNA, 23 bp, Homo sapiens
gccgacttagaactggtgcggac

SEQ ID NO: 52140 - DNA, 24 bp, Homo sapiens
gccgacttagaactggtgcggacc

SEQ ID NO: 52141 - DNA, 25 bp, Homo sapiens
gccgacttagaactggtgcggacca

SEQ ID NO: 52142 - DNA, 26 bp, Homo sapiens
gccgacttagaactggtgcggaccag

SEQ ID NO: 52143 - DNA, 29 bp, Homo sapiens
gccgacttagaactggtgcggaccagggg

SEQ ID NO: 52144 - DNA, 16 bp, Homo sapiens
ccgacttagaactggt

SEQ ID NO: 52145 - DNA, 17 bp, Homo sapiens
ccgacttagaactggtg

SEQ ID NO: 52146 - DNA, 18 bp, Homo sapiens
ccgacttagaactggtgc

SEQ ID NO: 52147 - DNA, 19 bp, Homo sapiens
ccgacttagaactggtgcg

SEQ ID NO: 52148 - DNA, 20 bp, Homo sapiens
ccgacttagaactggtgcgg

SEQ ID NO: 52149 - DNA, 21 bp, Homo sapiens
ccgacttagaactggtgcgga

SEQ ID NO: 52150 - DNA, 22 bp, Homo sapiens
ccgacttagaactggtgcggac

SEQ ID NO: 52151 - DNA, 23 bp, Homo sapiens
ccgacttagaactggtgcggacc

SEQ ID NO: 52152 - DNA, 24 bp, Homo sapiens
ccgacttagaactggtgcggacca

SEQ ID NO: 52153 - DNA, 25 bp, Homo sapiens
ccgacttagaactggtgcggaccag

SEQ ID NO: 52154 - DNA, 26 bp, Homo sapiens
ccgacttagaactggtgcggaccagg

SEQ ID NO: 52155 - DNA, 28 bp, Homo sapiens
ccgacttagaactggtgcggaccagggg

SEQ ID NO: 52156 - DNA, 29 bp, Homo sapiens
ccgacttagaactggtgcggaccagggga

SEQ ID NO: 52157 - DNA, 16 bp, Homo sapiens
cgacttagaactggtg

SEQ ID NO: 52158 - DNA, 17 bp, Homo sapiens
cgacttagaactggtgc

SEQ ID NO: 52159 - DNA, 18 bp, Homo sapiens
cgacttagaactggtgcg

SEQ ID NO: 52160 - DNA, 19 bp, Homo sapiens
cgacttagaactggtgcgg

SEQ ID NO: 52161 - DNA, 20 bp, Homo sapiens
cgacttagaactggtgcgga

SEQ ID NO: 52162 - DNA, 21 bp, Homo sapiens
cgacttagaactggtgcggac

SEQ ID NO: 52163 - DNA, 22 bp, Homo sapiens
cgacttagaactggtgcggacc

SEQ ID NO: 52164 - DNA, 23 bp, Homo sapiens
cgacttagaactggtgcggacca

SEQ ID NO: 52165 - DNA, 24 bp, Homo sapiens
cgacttagaactggtgcggaccag

SEQ ID NO: 52166 - DNA, 25 bp, Homo sapiens
cgacttagaactggtgcggaccagg

SEQ ID NO: 52167 - DNA, 26 bp, Homo sapiens
cgacttagaactggtgcggaccaggg

SEQ ID NO: 52168 - DNA, 27 bp, Homo sapiens
cgacttagaactggtgcggaccagggg

SEQ ID NO: 52169 - DNA, 28 bp, Homo sapiens
cgacttagaactggtgcggaccagggga

SEQ ID NO: 52170 - DNA, 16 bp, Homo sapiens
gacttagaactggtgc

SEQ ID NO: 52171 - DNA, 17 bp, Homo sapiens
gacttagaactggtgcg

SEQ ID NO: 52172 - DNA, 18 bp, Homo sapiens
gacttagaactggtgcgg

SEQ ID NO: 52173 - DNA, 19 bp, Homo sapiens
gacttagaactggtgcgga

SEQ ID NO: 52174 - DNA, 20 bp, Homo sapiens
gacttagaactggtgcggac

SEQ ID NO: 52175 - DNA, 21 bp, Homo sapiens
gacttagaactggtgcggacc

SEQ ID NO: 52176 - DNA, 24 bp, Homo sapiens
gacttagaactggtgcggaccagg

SEQ ID NO: 52177 - DNA, 25 bp, Homo sapiens
gacttagaactggtgcggaccaggg

SEQ ID NO: 52178 - DNA, 27 bp, Homo sapiens
gacttagaactggtgcggaccagggga

SEQ ID NO: 52179 - DNA, 16 bp, Homo sapiens
acttagaactggtgcg

SEQ ID NO: 52180 - DNA, 17 bp, Homo sapiens
acttagaactggtgcgg

SEQ ID NO: 52181 - DNA, 18 bp, Homo sapiens
acttagaactggtgcgga

SEQ ID NO: 52182 - DNA, 19 bp, Homo sapiens
acttagaactggtgcggac

SEQ ID NO: 52183 - DNA, 20 bp, Homo sapiens
acttagaactggtgcggacc

SEQ ID NO: 52184 - DNA, 21 bp, Homo sapiens
acttagaactggtgcggacca

SEQ ID NO: 52185 - DNA, 22 bp, Homo sapiens
acttagaactggtgcggaccag

SEQ ID NO: 52186 - DNA, 25 bp, Homo sapiens
acttagaactggtgcggaccagggg

SEQ ID NO: 52187 - DNA, 26 bp, Homo sapiens
acttagaactggtgcggaccagggga

SEQ ID NO: 52188 - DNA, 27 bp, Homo sapiens
acttagaactggtgcggaccaggggaa

SEQ ID NO: 52189 - DNA, 28 bp, Homo sapiens
acttagaactggtgcggaccaggggaat

SEQ ID NO: 52190 - DNA, 29 bp, Homo sapiens
acttagaactggtgcggaccaggggaatc

SEQ ID NO: 52191 - DNA, 30 bp, Homo sapiens; identical to SEQ ID NO: 24864

SEQ ID NO: 52192 - DNA, 17 bp, Homo sapiens
cttagaactggtgcgga

SEQ ID NO: 52193 - DNA, 18 bp, Homo sapiens
cttagaactggtgcggac

SEQ ID NO: 52194 - DNA, 19 bp, Homo sapiens
cttagaactggtgcggacc

SEQ ID NO: 52195 - DNA, 20 bp, Homo sapiens
cttagaactggtgcggacca

SEQ ID NO: 52196 - DNA, 21 bp, Homo sapiens
cttagaactggtgcggaccag

SEQ ID NO: 52197 - DNA, 22 bp, Homo sapiens
cttagaactggtgcggaccagg

SEQ ID NO: 52198 - DNA, 23 bp, Homo sapiens
cttagaactggtgcggaccaggg

SEQ ID NO: 52199 - DNA, 24 bp, Homo sapiens
cttagaactggtgcggaccagggg

SEQ ID NO: 52200 - DNA, 25 bp, Homo sapiens
cttagaactggtgcggaccagggga

SEQ ID NO: 52201 - DNA, 26 bp, Homo sapiens
cttagaactggtgcggaccaggggaa

SEQ ID NO: 52202 - DNA, 27 bp, Homo sapiens
cttagaactggtgcggaccaggggaat

SEQ ID NO: 52203 - DNA, 28 bp, Homo sapiens
cttagaactggtgcggaccaggggaatc

SEQ ID NO: 52204 - DNA, 30 bp, Homo sapiens
cttagaactggtgcggaccaggggaatccg

SEQ ID NO: 52205 - DNA, 18 bp, Homo sapiens
ttagaactggtgcggacc

SEQ ID NO: 52206 - DNA, 22 bp, Homo sapiens
ttagaactggtgcggaccaggg

SEQ ID NO: 52207 - DNA, 23 bp, Homo sapiens
ttagaactggtgcggaccagggg

SEQ ID NO: 52208 - DNA, 24 bp, Homo sapiens
ttagaactggtgcggaccagggga

SEQ ID NO: 52209 - DNA, 25 bp, Homo sapiens
ttagaactggtgcggaccaggggaa

SEQ ID NO: 52210 - DNA, 26 bp, Homo sapiens
ttagaactggtgcggaccaggggaat

SEQ ID NO: 52211 - DNA, 27 bp, Homo sapiens
ttagaactggtgcggaccaggggaatc

SEQ ID NO: 52212 - DNA, 28 bp, Homo sapiens
ttagaactggtgcggaccaggggaatcc

SEQ ID NO: 52213 - DNA, 29 bp, Homo sapiens
ttagaactggtgcggaccaggggaatccg

SEQ ID NO: 52214 - DNA, 30 bp, Homo sapiens
ttagaactggtgcggaccaggggaatccga

SEQ ID NO: 52215 - DNA, 17 bp, Homo sapiens
tagaactggtgcggacc

SEQ ID NO: 52216 - DNA, 19 bp, Homo sapiens
tagaactggtgcggaccag

SEQ ID NO: 52217 - DNA, 21 bp, Homo sapiens
tagaactggtgcggaccaggg

SEQ ID NO: 52218 - DNA, 22 bp, Homo sapiens
tagaactggtgcggaccagggg

SEQ ID NO: 52219 - DNA, 23 bp, Homo sapiens
tagaactggtgcggaccagggga

SEQ ID NO: 52220 - DNA, 24 bp, Homo sapiens
tagaactggtgcggaccaggggaa

SEQ ID NO: 52221 - DNA, 25 bp, Homo sapiens
tagaactggtgcggaccaggggaat

SEQ ID NO: 52222 - DNA, 26 bp, Homo sapiens
tagaactggtgcggaccaggggaatc

SEQ ID NO: 52223 - DNA, 27 bp, Homo sapiens
tagaactggtgcggaccaggggaatcc

SEQ ID NO: 52224 - DNA, 28 bp, Homo sapiens
tagaactggtgcggaccaggggaatccg

SEQ ID NO: 52225 - DNA, 29 bp, Homo sapiens
tagaactggtgcggaccaggggaatccga

SEQ ID NO: 52226 - DNA, 30 bp, Homo sapiens; identical to SEQ ID NO: 5414

SEQ ID NO: 52227 - DNA, 16 bp, Homo sapiens
agaactggtgcggacc

SEQ ID NO: 52228 - DNA, 18 bp, Homo sapiens
agaactggtgcggaccag

SEQ ID NO: 52229 - DNA, 20 bp, Homo sapiens
agaactggtgcggaccaggg

SEQ ID NO: 52230 - DNA, 21 bp, Homo sapiens
agaactggtgcggaccagggg

SEQ ID NO: 52231 - DNA, 22 bp, Homo sapiens
agaactggtgcggaccagggga

SEQ ID NO: 52232 - DNA, 23 bp, Homo sapiens
agaactggtgcggaccaggggaa

SEQ ID NO: 52233 - DNA, 24 bp, Homo sapiens
agaactggtgcggaccaggggaat

SEQ ID NO: 52234 - DNA, 25 bp, Homo sapiens
agaactggtgcggaccaggggaatc

SEQ ID NO: 52235 - DNA, 26 bp, Homo sapiens
agaactggtgcggaccaggggaatcc

SEQ ID NO: 52236 - DNA, 27 bp, Homo sapiens
agaactggtgcggaccaggggaatccg

SEQ ID NO: 52237 - DNA, 28 bp, Homo sapiens
agaactggtgcggaccaggggaatccga

SEQ ID NO: 52238 - DNA, 29 bp, Homo sapiens
agaactggtgcggaccaggggaatccgac

SEQ ID NO: 52239 - DNA, 30 bp, Homo sapiens; identical to SEQ ID NO: 5418

SEQ ID NO: 52240 - DNA, 20 bp, Homo sapiens
gaactggtgcggaccagggg

SEQ ID NO: 52241 - DNA, 21 bp, Homo sapiens
gaactggtgcggaccagggga

SEQ ID NO: 52242 - DNA, 22 bp, Homo sapiens
gaactggtgcggaccaggggaa

SEQ ID NO: 52243 - DNA, 23 bp, Homo sapiens
gaactggtgcggaccaggggaat

SEQ ID NO: 52244 - DNA, 24 bp, Homo sapiens
gaactggtgcggaccaggggaatc

SEQ ID NO: 52245 - DNA, 25 bp, Homo sapiens
gaactggtgcggaccaggggaatcc

SEQ ID NO: 52246 - DNA, 26 bp, Homo sapiens
gaactggtgcggaccaggggaatccg

SEQ ID NO: 52247 - DNA, 27 bp, Homo sapiens
gaactggtgcggaccaggggaatccga

SEQ ID NO: 52248 - DNA, 28 bp, Homo sapiens
gaactggtgcggaccaggggaatccgac

SEQ ID NO: 52249 - DNA, 30 bp, Homo sapiens; identical to SEQ ID NO: 24903

SEQ ID NO: 52250 - DNA, 19 bp, Homo sapiens
aactggtgcggaccagggg

SEQ ID NO: 52251 - DNA, 20 bp, Homo sapiens
aactggtgcggaccagggga

SEQ ID NO: 52252 - DNA, 21 bp, Homo sapiens
aactggtgcggaccaggggaa

SEQ ID NO: 52253 - DNA, 22 bp, Homo sapiens
aactggtgcggaccaggggaat

SEQ ID NO: 52254 - DNA, 23 bp, Homo sapiens
aactggtgcggaccaggggaatc

SEQ ID NO: 52255 - DNA, 24 bp, Homo sapiens
aactggtgcggaccaggggaatcc

SEQ ID NO: 52256 - DNA, 25 bp, Homo sapiens
aactggtgcggaccaggggaatccg

SEQ ID NO: 52257 - DNA, 26 bp, Homo sapiens
aactggtgcggaccaggggaatccga

SEQ ID NO: 52258 - DNA, 27 bp, Homo sapiens
aactggtgcggaccaggggaatccgac

SEQ ID NO: 52259 - DNA, 28 bp, Homo sapiens
aactggtgcggaccaggggaatccgact

SEQ ID NO: 52260 - DNA, 29 bp, Homo sapiens
aactggtgcggaccaggggaatccgactg

SEQ ID NO: 52261 - DNA, 30 bp, Homo sapiens; identical to SEQ ID NO: 5429

SEQ ID NO: 52262 - DNA, 16 bp, Homo sapiens
actggtgcggaccagg

SEQ ID NO: 52263 - DNA, 17 bp, Homo sapiens
actggtgcggaccaggg

SEQ ID NO: 52264 - DNA, 18 bp, Homo sapiens
actggtgcggaccagggg

SEQ ID NO: 52265 - DNA, 19 bp, Homo sapiens
actggtgcggaccagggga

SEQ ID NO: 52266 - DNA, 20 bp, Homo sapiens
actggtgcggaccaggggaa

SEQ ID NO: 52267 - DNA, 21 bp, Homo sapiens
actggtgcggaccaggggaat

SEQ ID NO: 52268 - DNA, 22 bp, Homo sapiens
actggtgcggaccaggggaatc

SEQ ID NO: 52269 - DNA, 23 bp, Homo sapiens
actggtgcggaccaggggaatcc

SEQ ID NO: 52270 - DNA, 24 bp, Homo sapiens
actggtgcggaccaggggaatccg

SEQ ID NO: 52271 - DNA, 25 bp, Homo sapiens
actggtgcggaccaggggaatccga

SEQ ID NO: 52272 - DNA, 26 bp, Homo sapiens
actggtgcggaccaggggaatccgac

SEQ ID NO: 52273 - DNA, 27 bp, Homo sapiens
actggtgcggaccaggggaatccgact

SEQ ID NO: 52274 - DNA, 28 bp, Homo sapiens
actggtgcggaccaggggaatccgactg

SEQ ID NO: 52275 - DNA, 29 bp, Homo sapiens
actggtgcggaccaggggaatccgactgt

SEQ ID NO: 52276 - DNA, 30 bp, Homo sapiens; identical to SEQ ID NO: 5436

SEQ ID NO: 52277 - DNA, 16 bp, Homo sapiens
ctggtgcggaccaggg

SEQ ID NO: 52278 - DNA, 17 bp, Homo sapiens
ctggtgcggaccagggg

SEQ ID NO: 52279 - DNA, 18 bp, Homo sapiens
ctggtgcggaccagggga

SEQ ID NO: 52280 - DNA, 19 bp, Homo sapiens
ctggtgcggaccaggggaa

SEQ ID NO: 52281 - DNA, 20 bp, Homo sapiens
ctggtgcggaccaggggaat

SEQ ID NO: 52282 - DNA, 21 bp, Homo sapiens
ctggtgcggaccaggggaatc

SEQ ID NO: 52283 - DNA, 22 bp, Homo sapiens
ctggtgcggaccaggggaatcc

SEQ ID NO: 52284 - DNA, 23 bp, Homo sapiens
ctggtgcggaccaggggaatccg

SEQ ID NO: 52285 - DNA, 24 bp, Homo sapiens
ctggtgcggaccaggggaatccga

SEQ ID NO: 52286 - DNA, 25 bp, Homo sapiens
ctggtgcggaccaggggaatccgac

SEQ ID NO: 52287 - DNA, 27 bp, Homo sapiens
ctggtgcggaccaggggaatccgactg

SEQ ID NO: 52288 - DNA, 28 bp, Homo sapiens
ctggtgcggaccaggggaatccgactgt

SEQ ID NO: 52289 - DNA, 29 bp, Homo sapiens
ctggtgcggaccaggggaatccgactgtt

SEQ ID NO: 52290 - DNA, 30 bp, Homo sapiens; identical to SEQ ID NO: 5445

SEQ ID NO: 52291 - DNA, 16 bp, Homo sapiens
tggtgcggaccagggg

SEQ ID NO: 52292 - DNA, 17 bp, Homo sapiens
tggtgcggaccagggga

SEQ ID NO: 52293 - DNA, 18 bp, Homo sapiens
tggtgcggaccaggggaa

SEQ ID NO: 52294 - DNA, 19 bp, Homo sapiens
tggtgcggaccaggggaat

SEQ ID NO: 52295 - DNA, 20 bp, Homo sapiens
tggtgcggaccaggggaatc

SEQ ID NO: 52296 - DNA, 21 bp, Homo sapiens
tggtgcggaccaggggaatcc

SEQ ID NO: 52297 - DNA, 22 bp, Homo sapiens
tggtgcggaccaggggaatccg

SEQ ID NO: 52298 - DNA, 23 bp, Homo sapiens
tggtgcggaccaggggaatccga

SEQ ID NO: 52299 - DNA, 24 bp, Homo sapiens
tggtgcggaccaggggaatccgac

SEQ ID NO: 52300 - DNA, 25 bp, Homo sapiens
tggtgcggaccaggggaatccgact

SEQ ID NO: 52301 - DNA, 26 bp, Homo sapiens
tggtgcggaccaggggaatccgactg

SEQ ID NO: 52302 - DNA, 27 bp, Homo sapiens
tggtgcggaccaggggaatccgactgt

SEQ ID NO: 52303 - DNA, 28 bp, Homo sapiens
tggtgcggaccaggggaatccgactgtt

SEQ ID NO: 52304 - DNA, 29 bp, Homo sapiens
tggtgcggaccaggggaatccgactgttt

SEQ ID NO: 52305 - DNA, 16 bp, Homo sapiens
ggtgcggaccagggga

SEQ ID NO: 52306 - DNA, 17 bp, Homo sapiens
ggtgcggaccaggggaa

SEQ ID NO: 52307 - DNA, 18 bp, Homo sapiens
ggtgcggaccaggggaat

SEQ ID NO: 52308 - DNA, 19 bp, Homo sapiens
ggtgcggaccaggggaatc

SEQ ID NO: 52309 - DNA, 20 bp, Homo sapiens
ggtgcggaccaggggaatcc

SEQ ID NO: 52310 - DNA, 21 bp, Homo sapiens
ggtgcggaccaggggaatccg

SEQ ID NO: 52311 - DNA, 22 bp, Homo sapiens
ggtgcggaccaggggaatccga

SEQ ID NO: 52312 - DNA, 23 bp, Homo sapiens
ggtgcggaccaggggaatccgac

SEQ ID NO: 52313 - DNA, 24 bp, Homo sapiens
ggtgcggaccaggggaatccgact

SEQ ID NO: 52314 - DNA, 25 bp, Homo sapiens
ggtgcggaccaggggaatccgactg

SEQ ID NO: 52315 - DNA, 26 bp, Homo sapiens
ggtgcggaccaggggaatccgactgt

SEQ ID NO: 52316 - DNA, 27 bp, Homo sapiens
ggtgcggaccaggggaatccgactgtt

SEQ ID NO: 52317 - DNA, 28 bp, Homo sapiens
ggtgcggaccaggggaatccgactgttt

SEQ ID NO: 52318 - DNA, 29 bp, Homo sapiens
ggtgcggaccaggggaatccgactgttta

SEQ ID NO: 52319 - DNA, 16 bp, Homo sapiens
gtgcggaccaggggaa

SEQ ID NO: 52320 - DNA, 17 bp, Homo sapiens
gtgcggaccaggggaat

SEQ ID NO: 52321 - DNA, 18 bp, Homo sapiens
gtgcggaccaggggaatc

SEQ ID NO: 52322 - DNA, 19 bp, Homo sapiens
gtgcggaccaggggaatcc

SEQ ID NO: 52323 - DNA, 20 bp, Homo sapiens
gtgcggaccaggggaatccg

SEQ ID NO: 52324 - DNA, 21 bp, Homo sapiens
gtgcggaccaggggaatccga

SEQ ID NO: 52325 - DNA, 22 bp, Homo sapiens
gtgcggaccaggggaatccgac

SEQ ID NO: 52326 - DNA, 23 bp, Homo sapiens
gtgcggaccaggggaatccgact

SEQ ID NO: 52327 - DNA, 24 bp, Homo sapiens
gtgcggaccaggggaatccgactg

SEQ ID NO: 52328 - DNA, 25 bp, Homo sapiens
gtgcggaccaggggaatccgactgt

SEQ ID NO: 52329 - DNA, 26 bp, Homo sapiens
gtgcggaccaggggaatccgactgtt

SEQ ID NO: 52330 - DNA, 27 bp, Homo sapiens
gtgcggaccaggggaatccgactgttt

SEQ ID NO: 52331 - DNA, 28 bp, Homo sapiens
gtgcggaccaggggaatccgactgttta

SEQ ID NO: 52332 - DNA, 16 bp, Homo sapiens
tgcggaccaggggaat

SEQ ID NO: 52333 - DNA, 17 bp, Homo sapiens
tgcggaccaggggaatc

SEQ ID NO: 52334 - DNA, 18 bp, Homo sapiens
tgcggaccaggggaatcc

SEQ ID NO: 52335 - DNA, 19 bp, Homo sapiens
tgcggaccaggggaatccg

SEQ ID NO: 52336 - DNA, 20 bp, Homo sapiens
tgcggaccaggggaatccga

SEQ ID NO: 52337 - DNA, 21 bp, Homo sapiens
tgcggaccaggggaatccgac

SEQ ID NO: 52338 - DNA, 22 bp, Homo sapiens
tgcggaccaggggaatccgact

SEQ ID NO: 52339 - DNA, 23 bp, Homo sapiens
tgcggaccaggggaatccgactg

SEQ ID NO: 52340 - DNA, 24 bp, Homo sapiens
tgcggaccaggggaatccgactgt

SEQ ID NO: 52341 - DNA, 25 bp, Homo sapiens
tgcggaccaggggaatccgactgtt

SEQ ID NO: 52342 - DNA, 26 bp, Homo sapiens
tgcggaccaggggaatccgactgttt

SEQ ID NO: 52343 - DNA, 30 bp, Homo sapiens; identical to SEQ ID NO: 5483

SEQ ID NO: 52344 - DNA, 16 bp, Homo sapiens
gcggaccaggggaatc

SEQ ID NO: 52345 - DNA, 17 bp, Homo sapiens
gcggaccaggggaatcc

SEQ ID NO: 52346 - DNA, 18 bp, Homo sapiens
gcggaccaggggaatccg

SEQ ID NO: 52347 - DNA, 19 bp, Homo sapiens
gcggaccaggggaatccga

SEQ ID NO: 52348 - DNA, 20 bp, Homo sapiens
gcggaccaggggaatccgac

SEQ ID NO: 52349 - DNA, 21 bp, Homo sapiens
gcggaccaggggaatccgact

SEQ ID NO: 52350 - DNA, 22 bp, Homo sapiens
gcggaccaggggaatccgactg

SEQ ID NO: 52351 - DNA, 23 bp, Homo sapiens
gcggaccaggggaatccgactgt

SEQ ID NO: 52352 - DNA, 24 bp, Homo sapiens
gcggaccaggggaatccgactgtt

SEQ ID NO: 52353 - DNA, 25 bp, Homo sapiens
gcggaccaggggaatccgactgttt

SEQ ID NO: 52354 - DNA, 16 bp, Homo sapiens
cggaccaggggaatcc

SEQ ID NO: 52355 - DNA, 17 bp, Homo sapiens
cggaccaggggaatccg

SEQ ID NO: 52356 - DNA, 18 bp, Homo sapiens
cggaccaggggaatccga

SEQ ID NO: 52357 - DNA, 19 bp, Homo sapiens
cggaccaggggaatccgac

SEQ ID NO: 52358 - DNA, 20 bp, Homo sapiens
cggaccaggggaatccgact

SEQ ID NO: 52359 - DNA, 21 bp, Homo sapiens
cggaccaggggaatccgactg

SEQ ID NO: 52360 - DNA, 22 bp, Homo sapiens
cggaccaggggaatccgactgt

SEQ ID NO: 52361 - DNA, 23 bp, Homo sapiens
cggaccaggggaatccgactgtt

SEQ ID NO: 52362 - DNA, 24 bp, Homo sapiens
cggaccaggggaatccgactgttt

SEQ ID NO: 52363 - DNA, 25 bp, Homo sapiens
cggaccaggggaatccgactgttta

SEQ ID NO: 52364 - DNA, 29 bp, Homo sapiens
cggaccaggggaatccgactgtttaatta

SEQ ID NO: 52365 - DNA, 16 bp, Homo sapiens
ggaccaggggaatccg

SEQ ID NO: 52366 - DNA, 17 bp, Homo sapiens
ggaccaggggaatccga

SEQ ID NO: 52367 - DNA, 18 bp, Homo sapiens
ggaccaggggaatccgac

SEQ ID NO: 52368 - DNA, 20 bp, Homo sapiens
ggaccaggggaatccgactg

SEQ ID NO: 52369 - DNA, 21 bp, Homo sapiens
ggaccaggggaatccgactgt

SEQ ID NO: 52370 - DNA, 22 bp, Homo sapiens
ggaccaggggaatccgactgtt

SEQ ID NO: 52371 - DNA, 23 bp, Homo sapiens
ggaccaggggaatccgactgttt

SEQ ID NO: 52372 - DNA, 16 bp, Homo sapiens
gaccaggggaatccga

SEQ ID NO: 52373 - DNA, 19 bp, Homo sapiens
gaccaggggaatccgactg

SEQ ID NO: 52374 - DNA, 21 bp, Homo sapiens
gaccaggggaatccgactgtt

SEQ ID NO: 52375 - DNA, 19 bp, Homo sapiens
accaggggaatccgactgt

SEQ ID NO: 52376 - DNA, 20 bp, Homo sapiens
accaggggaatccgactgtt

SEQ ID NO: 52377 - DNA, 21 bp, Homo sapiens
accaggggaatccgactgttt

SEQ ID NO: 52378 - DNA, 18 bp, Homo sapiens
ccaggggaatccgactgt

SEQ ID NO: 52379 - DNA, 19 bp, Homo sapiens
ccaggggaatccgactgtt

SEQ ID NO: 52380 - DNA, 20 bp, Homo sapiens
ccaggggaatccgactgttt

SEQ ID NO: 52381 - DNA, 21 bp, Homo sapiens
ccaggggaatccgactgttta

SEQ ID NO: 52382 - DNA, 22 bp, Homo sapiens
ccaggggaatccgactgtttaa

SEQ ID NO: 52383 - DNA, 23 bp, Homo sapiens
ccaggggaatccgactgtttaat

SEQ ID NO: 52384 - DNA, 24 bp, Homo sapiens
ccaggggaatccgactgtttaatt

SEQ ID NO: 52385 - DNA, 25 bp, Homo sapiens
ccaggggaatccgactgtttaatta

SEQ ID NO: 52386 - DNA, 26 bp, Homo sapiens
ccaggggaatccgactgtttaattaa

SEQ ID NO: 52387 - DNA, 27 bp, Homo sapiens
ccaggggaatccgactgtttaattaaa

SEQ ID NO: 52388 - DNA, 29 bp, Homo sapiens
ccaggggaatccgactgtttaattaaaac

SEQ ID NO: 52389 - DNA, 17 bp, Homo sapiens
caggggaatccgactgt

SEQ ID NO: 52390 - DNA, 18 bp, Homo sapiens
caggggaatccgactgtt

SEQ ID NO: 52391 - DNA, 19 bp, Homo sapiens
caggggaatccgactgttt

SEQ ID NO: 52392 - DNA, 20 bp, Homo sapiens
caggggaatccgactgttta

SEQ ID NO: 52393 - DNA, 21 bp, Homo sapiens
caggggaatccgactgtttaa

SEQ ID NO: 52394 - DNA, 22 bp, Homo sapiens
caggggaatccgactgtttaat

SEQ ID NO: 52395 - DNA, 23 bp, Homo sapiens
caggggaatccgactgtttaatt

SEQ ID NO: 52396 - DNA, 16 bp, Homo sapiens
aggggaatccgactgt

SEQ ID NO: 52397 - DNA, 17 bp, Homo sapiens
aggggaatccgactgtt

SEQ ID NO: 52398 - DNA, 18 bp, Homo sapiens
aggggaatccgactgttt

SEQ ID NO: 52399 - DNA, 19 bp, Homo sapiens
aggggaatccgactgttta

SEQ ID NO: 52400 - DNA, 20 bp, Homo sapiens
aggggaatccgactgtttaa

SEQ ID NO: 52401 - DNA, 21 bp, Homo sapiens
aggggaatccgactgtttaat

SEQ ID NO: 52402 - DNA, 22 bp, Homo sapiens
aggggaatccgactgtttaatt

SEQ ID NO: 52403 - DNA, 23 bp, Homo sapiens
aggggaatccgactgtttaatta

SEQ ID NO: 52404 - DNA, 16 bp, Homo sapiens
ggggaatccgactgtt

SEQ ID NO: 52405 - DNA, 17 bp, Homo sapiens
ggggaatccgactgttt

SEQ ID NO: 52406 - DNA, 18 bp, Homo sapiens
ggggaatccgactgttta

SEQ ID NO: 52407 - DNA, 21 bp, Homo sapiens
ggggaatccgactgtttaatt

SEQ ID NO: 52408 - DNA, 16 bp, Homo sapiens
gggaatccgactgttt

SEQ ID NO: 52409 - DNA, 17 bp, Homo sapiens
gggaatccgactgttta

SEQ ID NO: 52410 - DNA, 19 bp, Homo sapiens
gggaatccgactgtttaat

SEQ ID NO: 52411 - DNA, 20 bp, Homo sapiens
gggaatccgactgtttaatt

SEQ ID NO: 52412 - DNA, 21 bp, Homo sapiens
gggaatccgactgtttaatta

SEQ ID NO: 52413 - DNA, 22 bp, Homo sapiens
gggaatccgactgtttaattaa

SEQ ID NO: 52414 - DNA, 16 bp, Homo sapiens
ggaatccgactgttta

SEQ ID NO: 52415 - DNA, 17 bp, Homo sapiens
ggaatccgactgtttaa

SEQ ID NO: 52416 - DNA, 18 bp, Homo sapiens
ggaatccgactgtttaat

SEQ ID NO: 52417 - DNA, 19 bp, Homo sapiens
ggaatccgactgtttaatt

SEQ ID NO: 52418 - DNA, 20 bp, Homo sapiens
ggaatccgactgtttaatta

SEQ ID NO: 52419 - DNA, 21 bp, Homo sapiens
ggaatccgactgtttaattaa

SEQ ID NO: 52420 - DNA, 16 bp, Homo sapiens
aatccgactgtttaat

SEQ ID NO: 52421 - DNA, 17 bp, Homo sapiens
aatccgactgtttaatt

SEQ ID NO: 52422 - DNA, 18 bp, Homo sapiens
aatccgactgtttaatta

SEQ ID NO: 52423 - DNA, 19 bp, Homo sapiens
aatccgactgtttaattaa

SEQ ID NO: 52424 - DNA, 20 bp, Homo sapiens
aatccgactgtttaattaaa

SEQ ID NO: 52425 - DNA, 21 bp, Homo sapiens
aatccgactgtttaattaaaa

SEQ ID NO: 52426 - DNA, 16 bp, Homo sapiens
atccgactgtttaatt

SEQ ID NO: 52427 - DNA, 17 bp, Homo sapiens
atccgactgtttaatta

SEQ ID NO: 52428 - DNA, 18 bp, Homo sapiens
atccgactgtttaattaa

SEQ ID NO: 52429 - DNA, 19 bp, Homo sapiens
atccgactgtttaattaaa

SEQ ID NO: 52430 - DNA, 20 bp, Homo sapiens
atccgactgtttaattaaaa

SEQ ID NO: 52431 - DNA, 21 bp, Homo sapiens
atccgactgtttaattaaaac

SEQ ID NO: 52432 - DNA, 22 bp, Homo sapiens
atccgactgtttaattaaaaca

SEQ ID NO: 52433 - DNA, 17 bp, Homo sapiens
tccgactgtttaattaa

SEQ ID NO: 52434 - DNA, 18 bp, Homo sapiens
tccgactgtttaattaaa

SEQ ID NO: 52435 - DNA, 19 bp, Homo sapiens
tccgactgtttaattaaaa

SEQ ID NO: 52436 - DNA, 16 bp, Homo sapiens
ccgactgtttaattaa

SEQ ID NO: 52437 - DNA, 17 bp, Homo sapiens
ccgactgtttaattaaa

SEQ ID NO: 52438 - DNA, 18 bp, Homo sapiens
ccgactgtttaattaaaa

SEQ ID NO: 52439 - DNA, 20 bp, Homo sapiens
ccgactgtttaattaaaaca

SEQ ID NO: 52440 - DNA, 24 bp, Homo sapiens
ccgactgtttaattaaaacaaagc

SEQ ID NO: 52441 - DNA, 23 bp, Homo sapiens
cgactgtttaattaaaacaaagc

SEQ ID NO: 52442 - DNA, 22 bp, Homo sapiens
gactgtttaattaaaacaaagc

SEQ ID NO: 52443 - DNA, 21 bp, Homo sapiens
actgtttaattaaaacaaagc

SEQ ID NO: 52444 - DNA, 20 bp, Homo sapiens
ctgtttaattaaaacaaagc

SEQ ID NO: 52445 - DNA, 17 bp, Homo sapiens
tttaattaaaacaaagc

SEQ ID NO: 52446 - DNA, 30 bp, Homo sapiens
aattaaaacaaagcatcgcgaaggcccgcg

SEQ ID NO: 52447 - DNA, 30 bp, Homo sapiens
aaaacaaagcatcgcgaaggcccgcggcgg

SEQ ID NO: 52448 - DNA, 30 bp, Homo sapiens
aaacaaagcatcgcgaaggcccgcggcggg

SEQ ID NO: 52449 - DNA, 17 bp, Homo sapiens
aacaaagcatcgcgaag

SEQ ID NO: 52450 - DNA, 20 bp, Homo sapiens
aacaaagcatcgcgaaggcc

SEQ ID NO: 52451 - DNA, 21 bp, Homo sapiens
aacaaagcatcgcgaaggccc

SEQ ID NO: 52452 - DNA, 22 bp, Homo sapiens
aacaaagcatcgcgaaggcccg

SEQ ID NO: 52453 - DNA, 30 bp, Homo sapiens
aacaaagcatcgcgaaggcccgcggcgggt

SEQ ID NO: 52454 - DNA, 30 bp, Homo sapiens
acaaagcatcgcgaaggcccgcggcgggtg

SEQ ID NO: 52455 - DNA, 22 bp, Homo sapiens
caaagcatcgcgaaggcccgcg

SEQ ID NO: 52456 - DNA, 30 bp, Homo sapiens
caaagcatcgcgaaggcccgcggcgggtgt

SEQ ID NO: 52457 - DNA, 18 bp, Homo sapiens
aaagcatcgcgaaggccc

SEQ ID NO: 52458 - DNA, 19 bp, Homo sapiens
aaagcatcgcgaaggcccg

SEQ ID NO: 52459 - DNA, 20 bp, Homo sapiens
aaagcatcgcgaaggcccgc

SEQ ID NO: 52460 - DNA, 30 bp, Homo sapiens
aaagcatcgcgaaggcccgcggcgggtgtt

SEQ ID NO: 52461 - DNA, 16 bp, Homo sapiens
gcatcgcgaaggcccg

SEQ ID NO: 52462 - DNA, 17 bp, Homo sapiens
gcatcgcgaaggcccgc

SEQ ID NO: 52463 - DNA, 20 bp, Homo sapiens
gcatcgcgaaggcccgcggc

SEQ ID NO: 52464 - DNA, 20 bp, Homo sapiens
catcgcgaaggcccgcggcg

SEQ ID NO: 52465 - DNA, 21 bp, Homo sapiens
catcgcgaaggcccgcggcgg

SEQ ID NO: 52466 - DNA, 30 bp, Homo sapiens
atcgcgaaggcccgcggcgggtgttgacgc

SEQ ID NO: 52467 - DNA, 19 bp, Homo sapiens
tcgcgaaggcccgcggcgg

SEQ ID NO: 52468 - DNA, 20 bp, Homo sapiens
tcgcgaaggcccgcggcggg

SEQ ID NO: 52469 - DNA, 21 bp, Homo sapiens
tcgcgaaggcccgcggcgggt

SEQ ID NO: 52470 - DNA, 26 bp, Homo sapiens
tcgcgaaggcccgcggcgggtgttga

SEQ ID NO: 52471 - DNA, 29 bp, Homo sapiens
tcgcgaaggcccgcggcgggtgttgacgc

SEQ ID NO: 52472 - DNA, 30 bp, Homo sapiens
tcgcgaaggcccgcggcgggtgttgacgcg

SEQ ID NO: 52473 - DNA, 18 bp, Homo sapiens
cgcgaaggcccgcggcgg

SEQ ID NO: 52474 - DNA, 19 bp, Homo sapiens
cgcgaaggcccgcggcggg

SEQ ID NO: 52475 - DNA, 20 bp, Homo sapiens
cgcgaaggcccgcggcgggt

SEQ ID NO: 52476 - DNA, 25 bp, Homo sapiens
cgcgaaggcccgcggcgggtgttga

SEQ ID NO: 52477 - DNA, 28 bp, Homo sapiens
cgcgaaggcccgcggcgggtgttgacgc

SEQ ID NO: 52478 - DNA, 29 bp, Homo sapiens
cgcgaaggcccgcggcgggtgttgacgcg

SEQ ID NO: 52479 - DNA, 16 bp, Homo sapiens
gcgaaggcccgcggcg

SEQ ID NO: 52480 - DNA, 17 bp, Homo sapiens
gcgaaggcccgcggcgg

SEQ ID NO: 52481 - DNA, 18 bp, Homo sapiens
gcgaaggcccgcggcggg

SEQ ID NO: 52482 - DNA, 19 bp, Homo sapiens
gcgaaggcccgcggcgggt

SEQ ID NO: 52483 - DNA, 16 bp, Homo sapiens
cgaaggcccgcggcgg

SEQ ID NO: 52484 - DNA, 23 bp, Homo sapiens
cgaaggcccgcggcgggtgttga

SEQ ID NO: 52485 - DNA, 27 bp, Homo sapiens
cgaaggcccgcggcgggtgttgacgcg

SEQ ID NO: 52486 - DNA, 16 bp, Homo sapiens
aaggcccgcggcgggt

SEQ ID NO: 52487 - DNA, 23 bp, Homo sapiens
aaggcccgcggcgggtgttgacg

SEQ ID NO: 52488 - DNA, 21 bp, Homo sapiens
ggcccgcggcgggtgttgacg

SEQ ID NO: 52489 - DNA, 26 bp, Homo sapiens
ggcccgcggcgggtgttgacgcgatg

SEQ ID NO: 52490 - DNA, 20 bp, Homo sapiens
gcccgcggcgggtgttgacg

SEQ ID NO: 52491 - DNA, 21 bp, Homo sapiens
gcccgcggcgggtgttgacgc

SEQ ID NO: 52492 - DNA, 22 bp, Homo sapiens
gcccgcggcgggtgttgacgcg

SEQ ID NO: 52493 - DNA, 23 bp, Homo sapiens
gcccgcggcgggtgttgacgcga

SEQ ID NO: 52494 - DNA, 25 bp, Homo sapiens
gcccgcggcgggtgttgacgcgatg

SEQ ID NO: 52495 - DNA, 27 bp, Homo sapiens
gcccgcggcgggtgttgacgcgatgtg

SEQ ID NO: 52496 - DNA, 28 bp, Homo sapiens
gcccgcggcgggtgttgacgcgatgtga

SEQ ID NO: 52497 - DNA, 30 bp, Homo sapiens
gcccgcggcgggtgttgacgcgatgtgatt

SEQ ID NO: 52498 - DNA, 19 bp, Homo sapiens
cccgcggcgggtgttgacg

SEQ ID NO: 52499 - DNA, 21 bp, Homo sapiens
cccgcggcgggtgttgacgcg

SEQ ID NO: 52500 - DNA, 24 bp, Homo sapiens
cccgcggcgggtgttgacgcgatg

SEQ ID NO: 52501 - DNA, 16 bp, Homo sapiens
ccgcggcgggtgttga

SEQ ID NO: 52502 - DNA, 21 bp, Homo sapiens
gcggcgggtgttgacgcgatg

SEQ ID NO: 52503 - DNA, 23 bp, Homo sapiens
gcggcgggtgttgacgcgatgtg

SEQ ID NO: 52504 - DNA, 24 bp, Homo sapiens
gcggcgggtgttgacgcgatgtga

SEQ ID NO: 52505 - DNA, 25 bp, Homo sapiens
gcggcgggtgttgacgcgatgtgat

SEQ ID NO: 52506 - DNA, 26 bp, Homo sapiens
gcggcgggtgttgacgcgatgtgatt

SEQ ID NO: 52507 - DNA, 20 bp, Homo sapiens
ggcgggtgttgacgcgatgt

SEQ ID NO: 52508 - DNA, 22 bp, Homo sapiens
ggcgggtgttgacgcgatgtga

SEQ ID NO: 52509 - DNA, 18 bp, Homo sapiens
gcgggtgttgacgcgatg

SEQ ID NO: 52510 - DNA, 19 bp, Homo sapiens
gcgggtgttgacgcgatgt

SEQ ID NO: 52511 - DNA, 21 bp, Homo sapiens
gcgggtgttgacgcgatgtga

SEQ ID NO: 52512 - DNA, 23 bp, Homo sapiens
gcgggtgttgacgcgatgtgatt

SEQ ID NO: 52513 - DNA, 19 bp, Homo sapiens
cgggtgttgacgcgatgtg

SEQ ID NO: 52514 - DNA, 20 bp, Homo sapiens
cgggtgttgacgcgatgtga

SEQ ID NO: 52515 - DNA, 21 bp, Homo sapiens
cgggtgttgacgcgatgtgat

SEQ ID NO: 52516 - DNA, 22 bp, Homo sapiens
cgggtgttgacgcgatgtgatt

SEQ ID NO: 52517 - DNA, 26 bp, Homo sapiens
cgggtgttgacgcgatgtgatttctg

SEQ ID NO: 52518 - DNA, 16 bp, Homo sapiens
gggtgttgacgcgatg

SEQ ID NO: 52519 - DNA, 18 bp, Homo sapiens
ggtgttgacgcgatgtga

SEQ ID NO: 52520 - DNA, 20 bp, Homo sapiens
ggtgttgacgcgatgtgatt

SEQ ID NO: 52521 - DNA, 22 bp, Homo sapiens
ggtgttgacgcgatgtgatttc

SEQ ID NO: 52522 - DNA, 30 bp, Homo sapiens
ggtgttgacgcgatgtgatttctgcccagt

SEQ ID NO: 52523 - DNA, 23 bp, Homo sapiens
gtgttgacgcgatgtgatttctg

SEQ ID NO: 52524 - DNA, 30 bp, Homo sapiens
gtgttgacgcgatgtgatttctgcccagtg

SEQ ID NO: 52525 - DNA, 22 bp, Homo sapiens
tgttgacgcgatgtgatttctg

SEQ ID NO: 52526 - DNA, 21 bp, Homo sapiens
gttgacgcgatgtgatttctg

SEQ ID NO: 52527 - DNA, 26 bp, Homo sapiens
gttgacgcgatgtgatttctgcccag

SEQ ID NO: 52528 - DNA, 20 bp, Homo sapiens
ttgacgcgatgtgatttctg

SEQ ID NO: 52529 - DNA, 25 bp, Homo sapiens
ttgacgcgatgtgatttctgcccag

SEQ ID NO: 52530 - DNA, 19 bp, Homo sapiens
tgacgcgatgtgatttctg

SEQ ID NO: 52531 - DNA, 24 bp, Homo sapiens
tgacgcgatgtgatttctgcccag

SEQ ID NO: 52532 - DNA, 17 bp, Homo sapiens
gacgcgatgtgatttct

SEQ ID NO: 52533 - DNA, 22 bp, Homo sapiens
gacgcgatgtgatttctgccca

SEQ ID NO: 52534 - DNA, 23 bp, Homo sapiens
gacgcgatgtgatttctgcccag

SEQ ID NO: 52535 - DNA, 24 bp, Homo sapiens
gacgcgatgtgatttctgcccagt

SEQ ID NO: 52536 - DNA, 17 bp, Homo sapiens
acgcgatgtgatttctg

SEQ ID NO: 52537 - DNA, 22 bp, Homo sapiens
acgcgatgtgatttctgcccag

SEQ ID NO: 52538 - DNA, 23 bp, Homo sapiens
acgcgatgtgatttctgcccagt

SEQ ID NO: 52539 - DNA, 29 bp, Homo sapiens
acgcgatgtgatttctgcccagtgctctg

SEQ ID NO: 52540 - DNA, 20 bp, Homo sapiens
cgcgatgtgatttctgccca

SEQ ID NO: 52541 - DNA, 21 bp, Homo sapiens
cgcgatgtgatttctgcccag

SEQ ID NO: 52542 - DNA, 22 bp, Homo sapiens
cgcgatgtgatttctgcccagt

SEQ ID NO: 52543 - DNA, 24 bp, Homo sapiens
cgcgatgtgatttctgcccagtgc

SEQ ID NO: 52544 - DNA, 29 bp, Homo sapiens
cgcgatgtgatttctgcccagtgctctga

SEQ ID NO: 52545 - DNA, 19 bp, Homo sapiens
gcgatgtgatttctgccca

SEQ ID NO: 52546 - DNA, 20 bp, Homo sapiens
gcgatgtgatttctgcccag

SEQ ID NO: 52547 - DNA, 21 bp, Homo sapiens
gcgatgtgatttctgcccagt

SEQ ID NO: 52548 - DNA, 22 bp, Homo sapiens
gcgatgtgatttctgcccagtg

SEQ ID NO: 52549 - DNA, 23 bp, Homo sapiens
gcgatgtgatttctgcccagtgc

SEQ ID NO: 52550 - DNA, 24 bp, Homo sapiens
gcgatgtgatttctgcccagtgct

SEQ ID NO: 52551 - DNA, 28 bp, Homo sapiens
gcgatgtgatttctgcccagtgctctga

SEQ ID NO: 52552 - DNA, 18 bp, Homo sapiens
cgatgtgatttctgccca

SEQ ID NO: 52553 - DNA, 19 bp, Homo sapiens
cgatgtgatttctgcccag

SEQ ID NO: 52554 - DNA, 20 bp, Homo sapiens
cgatgtgatttctgcccagt

SEQ ID NO: 52555 - DNA, 21 bp, Homo sapiens
cgatgtgatttctgcccagtg

SEQ ID NO: 52556 - DNA, 22 bp, Homo sapiens
cgatgtgatttctgcccagtgc

SEQ ID NO: 52557 - DNA, 23 bp, Homo sapiens
cgatgtgatttctgcccagtgct

SEQ ID NO: 52558 - DNA, 26 bp, Homo sapiens
cgatgtgatttctgcccagtgctctg

SEQ ID NO: 52559 - DNA, 27 bp, Homo sapiens
cgatgtgatttctgcccagtgctctga

SEQ ID NO: 52560 - DNA, 29 bp, Homo sapiens
cgatgtgatttctgcccagtgctctgaat

SEQ ID NO: 52561 - DNA, 30 bp, Homo sapiens
cgatgtgatttctgcccagtgctctgaatg

SEQ ID NO: 52562 - DNA, 18 bp, Homo sapiens
gatgtgatttctgcccag

SEQ ID NO: 52563 - DNA, 19 bp, Homo sapiens
gatgtgatttctgcccagt

SEQ ID NO: 52564 - DNA, 25 bp, Homo sapiens
gatgtgatttctgcccagtgctctg

SEQ ID NO: 52565 - DNA, 26 bp, Homo sapiens
gatgtgatttctgcccagtgctctga

SEQ ID NO: 52566 - DNA, 28 bp, Homo sapiens
gatgtgatttctgcccagtgctctgaat

SEQ ID NO: 52567 - DNA, 29 bp, Homo sapiens
gatgtgatttctgcccagtgctctgaatg

SEQ ID NO: 52568 - DNA, 30 bp, Homo sapiens
gatgtgatttctgcccagtgctctgaatgt

SEQ ID NO: 52569 - DNA, 17 bp, Homo sapiens
atgtgatttctgcccag

SEQ ID NO: 52570 - DNA, 18 bp, Homo sapiens
atgtgatttctgcccagt

SEQ ID NO: 52571 - DNA, 19 bp, Homo sapiens
atgtgatttctgcccagtg

SEQ ID NO: 52572 - DNA, 24 bp, Homo sapiens
atgtgatttctgcccagtgctctg

SEQ ID NO: 52573 - DNA, 25 bp, Homo sapiens
atgtgatttctgcccagtgctctga

SEQ ID NO: 52574 - DNA, 27 bp, Homo sapiens
atgtgatttctgcccagtgctctgaat

SEQ ID NO: 52575 - DNA, 28 bp, Homo sapiens
atgtgatttctgcccagtgctctgaatg

SEQ ID NO: 52576 - DNA, 30 bp, Homo sapiens; identical to SEQ ID NO: 25348

SEQ ID NO: 52577 - DNA, 16 bp, Homo sapiens
tgtgatttctgcccag

SEQ ID NO: 52578 - DNA, 17 bp, Homo sapiens
tgtgatttctgcccagt

SEQ ID NO: 52579 - DNA, 23 bp, Homo sapiens
tgtgatttctgcccagtgctctg

SEQ ID NO: 52580 - DNA, 24 bp, Homo sapiens
tgtgatttctgcccagtgctctga

SEQ ID NO: 52581 - DNA, 25 bp, Homo sapiens
tgtgatttctgcccagtgctctgaa

SEQ ID NO: 52582 - DNA, 26 bp, Homo sapiens
tgtgatttctgcccagtgctctgaat

SEQ ID NO: 52583 - DNA, 27 bp, Homo sapiens
tgtgatttctgcccagtgctctgaatg

SEQ ID NO: 52584 - DNA, 28 bp, Homo sapiens
tgtgatttctgcccagtgctctgaatgt

SEQ ID NO: 52585 - DNA, 29 bp, Homo sapiens
tgtgatttctgcccagtgctctgaatgtc

SEQ ID NO: 52586 - DNA, 16 bp, Homo sapiens
gtgatttctgcccagt

SEQ ID NO: 52587 - DNA, 20 bp, Homo sapiens
gtgatttctgcccagtgctc

SEQ ID NO: 52588 - DNA, 21 bp, Homo sapiens
gtgatttctgcccagtgctct

SEQ ID NO: 52589 - DNA, 22 bp, Homo sapiens
gtgatttctgcccagtgctctg

SEQ ID NO: 52590 - DNA, 23 bp, Homo sapiens
gtgatttctgcccagtgctctga

SEQ ID NO: 52591 - DNA, 25 bp, Homo sapiens
gtgatttctgcccagtgctctgaat

SEQ ID NO: 52592 - DNA, 26 bp, Homo sapiens
gtgatttctgcccagtgctctgaatg

SEQ ID NO: 52593 - DNA, 27 bp, Homo sapiens
gtgatttctgcccagtgctctgaatgt

SEQ ID NO: 52594 - DNA, 28 bp, Homo sapiens
gtgatttctgcccagtgctctgaatgtc

SEQ ID NO: 52595 - DNA, 29 bp, Homo sapiens
gtgatttctgcccagtgctctgaatgtca

SEQ ID NO: 52596 - DNA, 21 bp, Homo sapiens
tgatttctgcccagtgctctg

SEQ ID NO: 52597 - DNA, 22 bp, Homo sapiens
tgatttctgcccagtgctctga

SEQ ID NO: 52598 - DNA, 23 bp, Homo sapiens
tgatttctgcccagtgctctgaa

SEQ ID NO: 52599 - DNA, 24 bp, Homo sapiens
tgatttctgcccagtgctctgaat

SEQ ID NO: 52600 - DNA, 25 bp, Homo sapiens
tgatttctgcccagtgctctgaatg

SEQ ID NO: 52601 - DNA, 26 bp, Homo sapiens
tgatttctgcccagtgctctgaatgt

SEQ ID NO: 52602 - DNA, 27 bp, Homo sapiens
tgatttctgcccagtgctctgaatgtc

SEQ ID NO: 52603 - DNA, 28 bp, Homo sapiens
tgatttctgcccagtgctctgaatgtca

SEQ ID NO: 52604 - DNA, 29 bp, Homo sapiens
tgatttctgcccagtgctctgaatgtcaa

SEQ ID NO: 52605 - DNA, 18 bp, Homo sapiens
gatttctgcccagtgctc

SEQ ID NO: 52606 - DNA, 19 bp, Homo sapiens
gatttctgcccagtgctct

SEQ ID NO: 52607 - DNA, 20 bp, Homo sapiens
gatttctgcccagtgctctg

SEQ ID NO: 52608 - DNA, 21 bp, Homo sapiens
gatttctgcccagtgctctga

SEQ ID NO: 52609 - DNA, 22 bp, Homo sapiens
gatttctgcccagtgctctgaa

SEQ ID NO: 52610 - DNA, 23 bp, Homo sapiens
gatttctgcccagtgctctgaat

SEQ ID NO: 52611 - DNA, 24 bp, Homo sapiens
gatttctgcccagtgctctgaatg

SEQ ID NO: 52612 - DNA, 25 bp, Homo sapiens
gatttctgcccagtgctctgaatgt

SEQ ID NO: 52613 - DNA, 26 bp, Homo sapiens
gatttctgcccagtgctctgaatgtc

SEQ ID NO: 52614 - DNA, 27 bp, Homo sapiens
gatttctgcccagtgctctgaatgtca

SEQ ID NO: 52615 - DNA, 29 bp, Homo sapiens
gatttctgcccagtgctctgaatgtcaaa

SEQ ID NO: 52616 - DNA, 30 bp, Homo sapiens
gatttctgcccagtgctctgaatgtcaaag

SEQ ID NO: 52617 - DNA, 19 bp, Homo sapiens
atttctgcccagtgctctg

SEQ ID NO: 52618 - DNA, 20 bp, Homo sapiens
atttctgcccagtgctctga

SEQ ID NO: 52619 - DNA, 21 bp, Homo sapiens
atttctgcccagtgctctgaa

SEQ ID NO: 52620 - DNA, 22 bp, Homo sapiens
atttctgcccagtgctctgaat

SEQ ID NO: 52621 - DNA, 23 bp, Homo sapiens
atttctgcccagtgctctgaatg

SEQ ID NO: 52622 - DNA, 24 bp, Homo sapiens
atttctgcccagtgctctgaatgt

SEQ ID NO: 52623 - DNA, 25 bp, Homo sapiens
atttctgcccagtgctctgaatgtc

SEQ ID NO: 52624 - DNA, 26 bp, Homo sapiens
atttctgcccagtgctctgaatgtca

SEQ ID NO: 52625 - DNA, 28 bp, Homo sapiens
atttctgcccagtgctctgaatgtcaaa

SEQ ID NO: 52626 - DNA, 29 bp, Homo sapiens
atttctgcccagtgctctgaatgtcaaag

SEQ ID NO: 52627 - DNA, 30 bp, Homo sapiens
atttctgcccagtgctctgaatgtcaaagt

SEQ ID NO: 52628 - DNA, 18 bp, Homo sapiens
tttctgcccagtgctctg

SEQ ID NO: 52629 - DNA, 19 bp, Homo sapiens
tttctgcccagtgctctga

SEQ ID NO: 52630 - DNA, 20 bp, Homo sapiens
tttctgcccagtgctctgaa

SEQ ID NO: 52631 - DNA, 21 bp, Homo sapiens
tttctgcccagtgctctgaat

SEQ ID NO: 52632 - DNA, 22 bp, Homo sapiens
tttctgcccagtgctctgaatg

SEQ ID NO: 52633 - DNA, 23 bp, Homo sapiens
tttctgcccagtgctctgaatgt

SEQ ID NO: 52634 - DNA, 24 bp, Homo sapiens
tttctgcccagtgctctgaatgtc

SEQ ID NO: 52635 - DNA, 25 bp, Homo sapiens
tttctgcccagtgctctgaatgtca

SEQ ID NO: 52636 - DNA, 27 bp, Homo sapiens
tttctgcccagtgctctgaatgtcaaa

SEQ ID NO: 52637 - DNA, 28 bp, Homo sapiens
tttctgcccagtgctctgaatgtcaaag

SEQ ID NO: 52638 - DNA, 29 bp, Homo sapiens
tttctgcccagtgctctgaatgtcaaagt

SEQ ID NO: 52639 - DNA, 30 bp, Homo sapiens
tttctgcccagtgctctgaatgtcaaagtg

SEQ ID NO: 52640 - DNA, 17 bp, Homo sapiens
ttctgcccagtgctctg

SEQ ID NO: 52641 - DNA, 18 bp, Homo sapiens
ttctgcccagtgctctga

SEQ ID NO: 52642 - DNA, 19 bp, Homo sapiens
ttctgcccagtgctctgaa

SEQ ID NO: 52643 - DNA, 20 bp, Homo sapiens
ttctgcccagtgctctgaat

SEQ ID NO: 52644 - DNA, 21 bp, Homo sapiens
ttctgcccagtgctctgaatg

SEQ ID NO: 52645 - DNA, 22 bp, Homo sapiens
ttctgcccagtgctctgaatgt

SEQ ID NO: 52646 - DNA, 23 bp, Homo sapiens
ttctgcccagtgctctgaatgtc

SEQ ID NO: 52647 - DNA, 24 bp, Homo sapiens
ttctgcccagtgctctgaatgtca

SEQ ID NO: 52648 - DNA, 26 bp, Homo sapiens
ttctgcccagtgctctgaatgtcaaa

SEQ ID NO: 52649 - DNA, 27 bp, Homo sapiens
ttctgcccagtgctctgaatgtcaaag

SEQ ID NO: 52650 - DNA, 28 bp, Homo sapiens
ttctgcccagtgctctgaatgtcaaagt

SEQ ID NO: 52651 - DNA, 29 bp, Homo sapiens
ttctgcccagtgctctgaatgtcaaagtg

SEQ ID NO: 52652 - DNA, 16 bp, Homo sapiens
tctgcccagtgctctg

SEQ ID NO: 52653 - DNA, 17 bp, Homo sapiens
tctgcccagtgctctga

SEQ ID NO: 52654 - DNA, 18 bp, Homo sapiens
tctgcccagtgctctgaa

SEQ ID NO: 52655 - DNA, 19 bp, Homo sapiens
tctgcccagtgctctgaat

SEQ ID NO: 52656 - DNA, 20 bp, Homo sapiens
tctgcccagtgctctgaatg

SEQ ID NO: 52657 - DNA, 21 bp, Homo sapiens
tctgcccagtgctctgaatgt

SEQ ID NO: 52658 - DNA, 22 bp, Homo sapiens
tctgcccagtgctctgaatgtc

SEQ ID NO: 52659 - DNA, 23 bp, Homo sapiens
tctgcccagtgctctgaatgtca

SEQ ID NO: 52660 - DNA, 24 bp, Homo sapiens
tctgcccagtgctctgaatgtcaa

SEQ ID NO: 52661 - DNA, 25 bp, Homo sapiens
tctgcccagtgctctgaatgtcaaa

SEQ ID NO: 52662 - DNA, 26 bp, Homo sapiens
tctgcccagtgctctgaatgtcaaag

SEQ ID NO: 52663 - DNA, 27 bp, Homo sapiens
tctgcccagtgctctgaatgtcaaagt

SEQ ID NO: 52664 - DNA, 28 bp, Homo sapiens
tctgcccagtgctctgaatgtcaaagtg

SEQ ID NO: 52665 - DNA, 29 bp, Homo sapiens
tctgcccagtgctctgaatgtcaaagtga

SEQ ID NO: 52666 - DNA, 30 bp, Homo sapiens
tctgcccagtgctctgaatgtcaaagtgaa

SEQ ID NO: 52667 - DNA, 16 bp, Homo sapiens
ctgcccagtgctctga

SEQ ID NO: 52668 - DNA, 17 bp, Homo sapiens
ctgcccagtgctctgaa

SEQ ID NO: 52669 - DNA, 18 bp, Homo sapiens
ctgcccagtgctctgaat

SEQ ID NO: 52670 - DNA, 19 bp, Homo sapiens
ctgcccagtgctctgaatg

SEQ ID NO: 52671 - DNA, 20 bp, Homo sapiens
ctgcccagtgctctgaatgt

SEQ ID NO: 52672 - DNA, 21 bp, Homo sapiens
ctgcccagtgctctgaatgtc

SEQ ID NO: 52673 - DNA, 22 bp, Homo sapiens
ctgcccagtgctctgaatgtca

SEQ ID NO: 52674 - DNA, 24 bp, Homo sapiens
ctgcccagtgctctgaatgtcaaa

SEQ ID NO: 52675 - DNA, 25 bp, Homo sapiens
ctgcccagtgctctgaatgtcaaag

SEQ ID NO: 52676 - DNA, 26 bp, Homo sapiens
ctgcccagtgctctgaatgtcaaagt

SEQ ID NO: 52677 - DNA, 27 bp, Homo sapiens
ctgcccagtgctctgaatgtcaaagtg

SEQ ID NO: 52678 - DNA, 30 bp, Homo sapiens; identical to SEQ ID NO: 5646

SEQ ID NO: 52679 - DNA, 16 bp, Homo sapiens
tgcccagtgctctgaa

SEQ ID NO: 52680 - DNA, 17 bp, Homo sapiens
tgcccagtgctctgaat

SEQ ID NO: 52681 - DNA, 18 bp, Homo sapiens
tgcccagtgctctgaatg

SEQ ID NO: 52682 - DNA, 19 bp, Homo sapiens
tgcccagtgctctgaatgt

SEQ ID NO: 52683 - DNA, 20 bp, Homo sapiens
tgcccagtgctctgaatgtc

SEQ ID NO: 52684 - DNA, 21 bp, Homo sapiens
tgcccagtgctctgaatgtca

SEQ ID NO: 52685 - DNA, 22 bp, Homo sapiens
tgcccagtgctctgaatgtcaa

SEQ ID NO: 52686 - DNA, 23 bp, Homo sapiens
tgcccagtgctctgaatgtcaaa

SEQ ID NO: 52687 - DNA, 24 bp, Homo sapiens
tgcccagtgctctgaatgtcaaag

SEQ ID NO: 52688 - DNA, 25 bp, Homo sapiens
tgcccagtgctctgaatgtcaaagt

SEQ ID NO: 52689 - DNA, 26 bp, Homo sapiens
tgcccagtgctctgaatgtcaaagtg

SEQ ID NO: 52690 - DNA, 29 bp, Homo sapiens
tgcccagtgctctgaatgtcaaagtgaag

SEQ ID NO: 52691 - DNA, 16 bp, Homo sapiens
gcccagtgctctgaat

SEQ ID NO: 52692 - DNA, 17 bp, Homo sapiens
gcccagtgctctgaatg

SEQ ID NO: 52693 - DNA, 18 bp, Homo sapiens
gcccagtgctctgaatgt

SEQ ID NO: 52694 - DNA, 19 bp, Homo sapiens
gcccagtgctctgaatgtc

SEQ ID NO: 52695 - DNA, 20 bp, Homo sapiens
gcccagtgctctgaatgtca

SEQ ID NO: 52696 - DNA, 21 bp, Homo sapiens
gcccagtgctctgaatgtcaa

SEQ ID NO: 52697 - DNA, 22 bp, Homo sapiens
gcccagtgctctgaatgtcaaa

SEQ ID NO: 52698 - DNA, 23 bp, Homo sapiens
gcccagtgctctgaatgtcaaag

SEQ ID NO: 52699 - DNA, 24 bp, Homo sapiens
gcccagtgctctgaatgtcaaagt

SEQ ID NO: 52700 - DNA, 25 bp, Homo sapiens
gcccagtgctctgaatgtcaaagtg

SEQ ID NO: 52701 - DNA, 28 bp, Homo sapiens
gcccagtgctctgaatgtcaaagtgaag

SEQ ID NO: 52702 - DNA, 29 bp, Homo sapiens
gcccagtgctctgaatgtcaaagtgaaga

SEQ ID NO: 52703 - DNA, 16 bp, Homo sapiens
cccagtgctctgaatg

SEQ ID NO: 52704 - DNA, 17 bp, Homo sapiens
cccagtgctctgaatgt

SEQ ID NO: 52705 - DNA, 18 bp, Homo sapiens
cccagtgctctgaatgtc

SEQ ID NO: 52706 - DNA, 19 bp, Homo sapiens
cccagtgctctgaatgtca

SEQ ID NO: 52707 - DNA, 20 bp, Homo sapiens
cccagtgctctgaatgtcaa

SEQ ID NO: 52708 - DNA, 21 bp, Homo sapiens
cccagtgctctgaatgtcaaa

SEQ ID NO: 52709 - DNA, 22 bp, Homo sapiens
cccagtgctctgaatgtcaaag

SEQ ID NO: 52710 - DNA, 23 bp, Homo sapiens
cccagtgctctgaatgtcaaagt

SEQ ID NO: 52711 - DNA, 24 bp, Homo sapiens
cccagtgctctgaatgtcaaagtg

SEQ ID NO: 52712 - DNA, 25 bp, Homo sapiens
cccagtgctctgaatgtcaaagtga

SEQ ID NO: 52713 - DNA, 27 bp, Homo sapiens
cccagtgctctgaatgtcaaagtgaag

SEQ ID NO: 52714 - DNA, 28 bp, Homo sapiens
cccagtgctctgaatgtcaaagtgaaga

SEQ ID NO: 52715 - DNA, 29 bp, Homo sapiens
cccagtgctctgaatgtcaaagtgaagaa

SEQ ID NO: 52716 - DNA, 16 bp, Homo sapiens
ccagtgctctgaatgt

SEQ ID NO: 52717 - DNA, 17 bp, Homo sapiens
ccagtgctctgaatgtc

SEQ ID NO: 52718 - DNA, 18 bp, Homo sapiens
ccagtgctctgaatgtca

SEQ ID NO: 52719 - DNA, 20 bp, Homo sapiens
ccagtgctctgaatgtcaaa

SEQ ID NO: 52720 - DNA, 21 bp, Homo sapiens
ccagtgctctgaatgtcaaag

SEQ ID NO: 52721 - DNA, 22 bp, Homo sapiens
ccagtgctctgaatgtcaaagt

SEQ ID NO: 52722 - DNA, 23 bp, Homo sapiens
ccagtgctctgaatgtcaaagtg

SEQ ID NO: 52723 - DNA, 24 bp, Homo sapiens
ccagtgctctgaatgtcaaagtga

SEQ ID NO: 52724 - DNA, 26 bp, Homo sapiens
ccagtgctctgaatgtcaaagtgaag

SEQ ID NO: 52725 - DNA, 27 bp, Homo sapiens
ccagtgctctgaatgtcaaagtgaaga

SEQ ID NO: 52726 - DNA, 28 bp, Homo sapiens
ccagtgctctgaatgtcaaagtgaagaa

SEQ ID NO: 52727 - DNA, 29 bp, Homo sapiens
ccagtgctctgaatgtcaaagtgaagaaa

SEQ ID NO: 52728 - DNA, 16 bp, Homo sapiens
cagtgctctgaatgtc

SEQ ID NO: 52729 - DNA, 17 bp, Homo sapiens
cagtgctctgaatgtca

SEQ ID NO: 52730 - DNA, 18 bp, Homo sapiens
cagtgctctgaatgtcaa

SEQ ID NO: 52731 - DNA, 19 bp, Homo sapiens
cagtgctctgaatgtcaaa

SEQ ID NO: 52732 - DNA, 20 bp, Homo sapiens
cagtgctctgaatgtcaaag

SEQ ID NO: 52733 - DNA, 21 bp, Homo sapiens
cagtgctctgaatgtcaaagt

SEQ ID NO: 52734 - DNA, 22 bp, Homo sapiens
cagtgctctgaatgtcaaagtg

SEQ ID NO: 52735 - DNA, 23 bp, Homo sapiens
cagtgctctgaatgtcaaagtga

SEQ ID NO: 52736 - DNA, 24 bp, Homo sapiens
cagtgctctgaatgtcaaagtgaa

SEQ ID NO: 52737 - DNA, 25 bp, Homo sapiens
cagtgctctgaatgtcaaagtgaag

SEQ ID NO: 52738 - DNA, 26 bp, Homo sapiens
cagtgctctgaatgtcaaagtgaaga

SEQ ID NO: 52739 - DNA, 27 bp, Homo sapiens
cagtgctctgaatgtcaaagtgaagaa

SEQ ID NO: 52740 - DNA, 28 bp, Homo sapiens
cagtgctctgaatgtcaaagtgaagaaa

SEQ ID NO: 52741 - DNA, 30 bp, Homo sapiens
cagtgctctgaatgtcaaagtgaagaaatt

SEQ ID NO: 52742 - DNA, 18 bp, Homo sapiens
agtgctctgaatgtcaaa

SEQ ID NO: 52743 - DNA, 19 bp, Homo sapiens
agtgctctgaatgtcaaag

SEQ ID NO: 52744 - DNA, 20 bp, Homo sapiens
agtgctctgaatgtcaaagt

SEQ ID NO: 52745 - DNA, 21 bp, Homo sapiens
agtgctctgaatgtcaaagtg

SEQ ID NO: 52746 - DNA, 24 bp, Homo sapiens
agtgctctgaatgtcaaagtgaag

SEQ ID NO: 52747 - DNA, 25 bp, Homo sapiens
agtgctctgaatgtcaaagtgaaga

SEQ ID NO: 52748 - DNA, 27 bp, Homo sapiens
agtgctctgaatgtcaaagtgaagaaa

SEQ ID NO: 52749 - DNA, 17 bp, Homo sapiens
gtgctctgaatgtcaaa

SEQ ID NO: 52750 - DNA, 18 bp, Homo sapiens
gtgctctgaatgtcaaag

SEQ ID NO: 52751 - DNA, 19 bp, Homo sapiens
gtgctctgaatgtcaaagt

SEQ ID NO: 52752 - DNA, 20 bp, Homo sapiens
gtgctctgaatgtcaaagtg

SEQ ID NO: 52753 - DNA, 21 bp, Homo sapiens
gtgctctgaatgtcaaagtga

SEQ ID NO: 52754 - DNA, 22 bp, Homo sapiens
gtgctctgaatgtcaaagtgaa

SEQ ID NO: 52755 - DNA, 23 bp, Homo sapiens
gtgctctgaatgtcaaagtgaag

SEQ ID NO: 52756 - DNA, 24 bp, Homo sapiens
gtgctctgaatgtcaaagtgaaga

SEQ ID NO: 52757 - DNA, 25 bp, Homo sapiens
gtgctctgaatgtcaaagtgaagaa

SEQ ID NO: 52758 - DNA, 26 bp, Homo sapiens
gtgctctgaatgtcaaagtgaagaaa

SEQ ID NO: 52759 - DNA, 27 bp, Homo sapiens
gtgctctgaatgtcaaagtgaagaaat

SEQ ID NO: 52760 - DNA, 29 bp, Homo sapiens
gtgctctgaatgtcaaagtgaagaaattc

SEQ ID NO: 52761 - DNA, 16 bp, Homo sapiens
tgctctgaatgtcaaa

SEQ ID NO: 52762 - DNA, 17 bp, Homo sapiens
tgctctgaatgtcaaag

SEQ ID NO: 52763 - DNA, 18 bp, Homo sapiens
tgctctgaatgtcaaagt

SEQ ID NO: 52764 - DNA, 19 bp, Homo sapiens
tgctctgaatgtcaaagtg

SEQ ID NO: 52765 - DNA, 20 bp, Homo sapiens
tgctctgaatgtcaaagtga

SEQ ID NO: 52766 - DNA, 22 bp, Homo sapiens
tgctctgaatgtcaaagtgaag

SEQ ID NO: 52767 - DNA, 23 bp, Homo sapiens
tgctctgaatgtcaaagtgaaga

SEQ ID NO: 52768 - DNA, 24 bp, Homo sapiens
tgctctgaatgtcaaagtgaagaa

SEQ ID NO: 52769 - DNA, 25 bp, Homo sapiens
tgctctgaatgtcaaagtgaagaaa

SEQ ID NO: 52770 - DNA, 26 bp, Homo sapiens
tgctctgaatgtcaaagtgaagaaat

SEQ ID NO: 52771 - DNA, 16 bp, Homo sapiens
gctctgaatgtcaaag

SEQ ID NO: 52772 - DNA, 17 bp, Homo sapiens
gctctgaatgtcaaagt

SEQ ID NO: 52773 - DNA, 18 bp, Homo sapiens
gctctgaatgtcaaagtg

SEQ ID NO: 52774 - DNA, 19 bp, Homo sapiens
gctctgaatgtcaaagtga

SEQ ID NO: 52775 - DNA, 21 bp, Homo sapiens
gctctgaatgtcaaagtgaag

SEQ ID NO: 52776 - DNA, 22 bp, Homo sapiens
gctctgaatgtcaaagtgaaga

SEQ ID NO: 52777 - DNA, 23 bp, Homo sapiens
gctctgaatgtcaaagtgaagaa

SEQ ID NO: 52778 - DNA, 24 bp, Homo sapiens
gctctgaatgtcaaagtgaagaaa

SEQ ID NO: 52779 - DNA, 25 bp, Homo sapiens
gctctgaatgtcaaagtgaagaaat

SEQ ID NO: 52780 - DNA, 16 bp, Homo sapiens
ctctgaatgtcaaagt

SEQ ID NO: 52781 - DNA, 17 bp, Homo sapiens
ctctgaatgtcaaagtg

SEQ ID NO: 52782 - DNA, 18 bp, Homo sapiens
ctctgaatgtcaaagtga

SEQ ID NO: 52783 - DNA, 20 bp, Homo sapiens
ctctgaatgtcaaagtgaag

SEQ ID NO: 52784 - DNA, 21 bp, Homo sapiens
ctctgaatgtcaaagtgaaga

SEQ ID NO: 52785 - DNA, 22 bp, Homo sapiens
ctctgaatgtcaaagtgaagaa

SEQ ID NO: 52786 - DNA, 23 bp, Homo sapiens
ctctgaatgtcaaagtgaagaaa

SEQ ID NO: 52787 - DNA, 24 bp, Homo sapiens
ctctgaatgtcaaagtgaagaaat

SEQ ID NO: 52788 - DNA, 26 bp, Homo sapiens
ctctgaatgtcaaagtgaagaaattc

SEQ ID NO: 52789 - DNA, 30 bp, Homo sapiens
ctctgaatgtcaaagtgaagaaattcaatg

SEQ ID NO: 52790 - DNA, 19 bp, Homo sapiens
tctgaatgtcaaagtgaag

SEQ ID NO: 52791 - DNA, 18 bp, Homo sapiens
ctgaatgtcaaagtgaag

SEQ ID NO: 52792 - DNA, 21 bp, Homo sapiens
agtgaagaaattcaatgaagc

SEQ ID NO: 52793 - DNA, 23 bp, Homo sapiens
tgaagaaattcaatgaagcgcgg

SEQ ID NO: 52794 - DNA, 24 bp, Homo sapiens
tgaagaaattcaatgaagcgcggg

SEQ ID NO: 52795 - DNA, 20 bp, Homo sapiens
gaagaaattcaatgaagcgc

SEQ ID NO: 52796 - DNA, 18 bp, Homo sapiens
agaaattcaatgaagcgc

SEQ ID NO: 52797 - DNA, 20 bp, Homo sapiens
atgaagcgcgggtaaacggc

SEQ ID NO: 52798 - DNA, 18 bp, Homo sapiens
gcgcgggtaaacggcggg

SEQ ID NO: 52799 - DNA, 20 bp, Homo sapiens
gcgcgggtaaacggcgggag

SEQ ID NO: 52800 - DNA, 24 bp, Homo sapiens
gcgcgggtaaacggcgggagtaac

SEQ ID NO: 52801 - DNA, 21 bp, Homo sapiens
gcgggtaaacggcgggagtaa

SEQ ID NO: 52802 - DNA, 22 bp, Homo sapiens
gcgggtaaacggcgggagtaac

SEQ ID NO: 52803 - DNA, 23 bp, Homo sapiens
gcgggtaaacggcgggagtaact

SEQ ID NO: 52804 - DNA, 23 bp, Homo sapiens
cgggtaaacggcgggagtaacta

SEQ ID NO: 52805 - DNA, 19 bp, Homo sapiens
aacggcgggagtaactatg

SEQ ID NO: 52806 - DNA, 20 bp, Homo sapiens
aacggcgggagtaactatga

SEQ ID NO: 52807 - DNA, 22 bp, Homo sapiens
ggcgggagtaactatgactctc

SEQ ID NO: 52808 - DNA, 25 bp, Homo sapiens
gggagtaactatgactctcttaagg

SEQ ID NO: 52809 - DNA, 26 bp, Homo sapiens
gagtaactatgactctcttaaggtag

SEQ ID NO: 52810 - DNA, 16 bp, Homo sapiens
agtaactatgactctc

SEQ ID NO: 52811 - DNA, 17 bp, Homo sapiens
agtaactatgactctct

SEQ ID NO: 52812 - DNA, 18 bp, Homo sapiens
agtaactatgactctctt

SEQ ID NO: 52813 - DNA, 19 bp, Homo sapiens
agtaactatgactctctta

SEQ ID NO: 52814 - DNA, 23 bp, Homo sapiens
agtaactatgactctcttaaggt

SEQ ID NO: 52815 - DNA, 18 bp, Homo sapiens
gtaactatgactctctta

SEQ ID NO: 52816 - DNA, 20 bp, Homo sapiens
gtaactatgactctcttaag

SEQ ID NO: 52817 - DNA, 22 bp, Homo sapiens
gtaactatgactctcttaaggt

SEQ ID NO: 52818 - DNA, 24 bp, Homo sapiens
gtaactatgactctcttaaggtag

SEQ ID NO: 52819 - DNA, 16 bp, Homo sapiens
taactatgactctctt

SEQ ID NO: 52820 - DNA, 17 bp, Homo sapiens
taactatgactctctta

SEQ ID NO: 52821 - DNA, 18 bp, Homo sapiens
taactatgactctcttaa

SEQ ID NO: 52822 - DNA, 19 bp, Homo sapiens
taactatgactctcttaag

SEQ ID NO: 52823 - DNA, 20 bp, Homo sapiens
taactatgactctcttaagg

SEQ ID NO: 52824 - DNA, 21 bp, Homo sapiens
taactatgactctcttaaggt

SEQ ID NO: 52825 - DNA, 22 bp, Homo sapiens
taactatgactctcttaaggta

SEQ ID NO: 52826 - DNA, 23 bp, Homo sapiens
taactatgactctcttaaggtag

SEQ ID NO: 52827 - DNA, 19 bp, Homo sapiens
aactatgactctcttaagg

SEQ ID NO: 52828 - DNA, 20 bp, Homo sapiens
aactatgactctcttaaggt

SEQ ID NO: 52829 - DNA, 22 bp, Homo sapiens
aactatgactctcttaaggtag

SEQ ID NO: 52830 - DNA, 17 bp, Homo sapiens
actatgactctcttaag

SEQ ID NO: 52831 - DNA, 18 bp, Homo sapiens
actatgactctcttaagg

SEQ ID NO: 52832 - DNA, 19 bp, Homo sapiens
actatgactctcttaaggt

SEQ ID NO: 52833 - DNA, 21 bp, Homo sapiens
actatgactctcttaaggtag

SEQ ID NO: 52834 - DNA, 18 bp, Homo sapiens
ctatgactctcttaaggt

SEQ ID NO: 52835 - DNA, 17 bp, Homo sapiens
gactctcttaaggtagc

SEQ ID NO: 52836 - DNA, 18 bp, Homo sapiens
gactctcttaaggtagcc

SEQ ID NO: 52837 - DNA, 16 bp, Homo sapiens
actctcttaaggtagc

SEQ ID NO: 52838 - DNA, 17 bp, Homo sapiens
actctcttaaggtagcc

SEQ ID NO: 52839 - DNA, 26 bp, Homo sapiens
ctcttaaggtagccaaatgcctcgtc

SEQ ID NO: 52840 - DNA, 22 bp, Homo sapiens
taaggtagccaaatgcctcgtc

SEQ ID NO: 52841 - DNA, 21 bp, Homo sapiens
aaggtagccaaatgcctcgtc

SEQ ID NO: 52842 - DNA, 25 bp, Homo sapiens
aaggtagccaaatgcctcgtcatct

SEQ ID NO: 52843 - DNA, 19 bp, Homo sapiens
ggtagccaaatgcctcgtc

SEQ ID NO: 52844 - DNA, 20 bp, Homo sapiens
ggtagccaaatgcctcgtca

SEQ ID NO: 52845 - DNA, 21 bp, Homo sapiens
ggtagccaaatgcctcgtcat

SEQ ID NO: 52846 - DNA, 22 bp, Homo sapiens
ggtagccaaatgcctcgtcatc

SEQ ID NO: 52847 - DNA, 23 bp, Homo sapiens
ggtagccaaatgcctcgtcatct

SEQ ID NO: 52848 - DNA, 21 bp, Homo sapiens
gtagccaaatgcctcgtcatc

SEQ ID NO: 52849 - DNA, 22 bp, Homo sapiens
gtagccaaatgcctcgtcatct

SEQ ID NO: 52850 - DNA, 23 bp, Homo sapiens
gtagccaaatgcctcgtcatcta

SEQ ID NO: 52851 - DNA, 21 bp, Homo sapiens
tagccaaatgcctcgtcatct

SEQ ID NO: 52852 - DNA, 16 bp, Homo sapiens
agccaaatgcctcgtc

SEQ ID NO: 52853 - DNA, 19 bp, Homo sapiens
agccaaatgcctcgtcatc

SEQ ID NO: 52854 - DNA, 20 bp, Homo sapiens
agccaaatgcctcgtcatct

SEQ ID NO: 52855 - DNA, 19 bp, Homo sapiens
gccaaatgcctcgtcatct

SEQ ID NO: 52856 - DNA, 21 bp, Homo sapiens
ccaaatgcctcgtcatctaat

SEQ ID NO: 52857 - DNA, 22 bp, Homo sapiens
ccaaatgcctcgtcatctaatt

SEQ ID NO: 52858 - DNA, 24 bp, Homo sapiens
ccaaatgcctcgtcatctaattag

SEQ ID NO: 52859 - DNA, 21 bp, Homo sapiens
aatgcctcgtcatctaattag

SEQ ID NO: 52860 - DNA, 18 bp, Homo sapiens
gcctcgtcatctaattag

SEQ ID NO: 52861 - DNA, 17 bp, Homo sapiens
cctcgtcatctaattag

SEQ ID NO: 52862 - DNA, 16 bp, Homo sapiens
tcgtcatctaattagt

SEQ ID NO: 52863 - DNA, 21 bp, Homo sapiens
catctaattagtgacgcgcat

SEQ ID NO: 52864 - DNA, 21 bp, Homo sapiens
ctaattagtgacgcgcatgaa

SEQ ID NO: 52865 - DNA, 20 bp, Homo sapiens
aattagtgacgcgcatgaat

SEQ ID NO: 52866 - DNA, 21 bp, Homo sapiens
aattagtgacgcgcatgaatg

SEQ ID NO: 52867 - DNA, 25 bp, Homo sapiens
aattagtgacgcgcatgaatggatg

SEQ ID NO: 52868 - DNA, 29 bp, Homo sapiens
aattagtgacgcgcatgaatggatgaacg

SEQ ID NO: 52869 - DNA, 30 bp, Homo sapiens
aattagtgacgcgcatgaatggatgaacga

SEQ ID NO: 52870 - DNA, 24 bp, Homo sapiens
attagtgacgcgcatgaatggatg

SEQ ID NO: 52871 - DNA, 28 bp, Homo sapiens
attagtgacgcgcatgaatggatgaacg

SEQ ID NO: 52872 - DNA, 23 bp, Homo sapiens
ttagtgacgcgcatgaatggatg

SEQ ID NO: 52873 - DNA, 27 bp, Homo sapiens
tagtgacgcgcatgaatggatgaacga

SEQ ID NO: 52874 - DNA, 30 bp, Homo sapiens; identical to SEQ ID NO: 5767

SEQ ID NO: 52875 - DNA, 20 bp, Homo sapiens
gtgacgcgcatgaatggatg

SEQ ID NO: 52876 - DNA, 21 bp, Homo sapiens
gtgacgcgcatgaatggatga

SEQ ID NO: 52877 - DNA, 23 bp, Homo sapiens
gtgacgcgcatgaatggatgaac

SEQ ID NO: 52878 - DNA, 24 bp, Homo sapiens
gtgacgcgcatgaatggatgaacg

SEQ ID NO: 52879 - DNA, 25 bp, Homo sapiens
gtgacgcgcatgaatggatgaacga

SEQ ID NO: 52880 - DNA, 26 bp, Homo sapiens
gtgacgcgcatgaatggatgaacgag

SEQ ID NO: 52881 - DNA, 23 bp, Homo sapiens
tgacgcgcatgaatggatgaacg

SEQ ID NO: 52882 - DNA, 30 bp, Homo sapiens; identical to SEQ ID NO: 5778

SEQ ID NO: 52883 - DNA, 22 bp, Homo sapiens
gacgcgcatgaatggatgaacg

SEQ ID NO: 52884 - DNA, 29 bp, Homo sapiens
gacgcgcatgaatggatgaacgagattcc

SEQ ID NO: 52885 - DNA, 20 bp, Homo sapiens
acgcgcatgaatggatgaac

SEQ ID NO: 52886 - DNA, 21 bp, Homo sapiens
acgcgcatgaatggatgaacg

SEQ ID NO: 52887 - DNA, 22 bp, Homo sapiens
acgcgcatgaatggatgaacga

SEQ ID NO: 52888 - DNA, 23 bp, Homo sapiens
acgcgcatgaatggatgaacgag

SEQ ID NO: 52889 - DNA, 17 bp, Homo sapiens
cgcgcatgaatggatga

SEQ ID NO: 52890 - DNA, 19 bp, Homo sapiens
cgcgcatgaatggatgaac

SEQ ID NO: 52891 - DNA, 20 bp, Homo sapiens
cgcgcatgaatggatgaacg

SEQ ID NO: 52892 - DNA, 21 bp, Homo sapiens
cgcgcatgaatggatgaacga

SEQ ID NO: 52893 - DNA, 22 bp, Homo sapiens
cgcgcatgaatggatgaacgag

SEQ ID NO: 52894 - DNA, 23 bp, Homo sapiens
cgcgcatgaatggatgaacgaga

SEQ ID NO: 52895 - DNA, 24 bp, Homo sapiens
cgcgcatgaatggatgaacgagat

SEQ ID NO: 52896 - DNA, 30 bp, Homo sapiens; identical to SEQ ID NO: 5796

SEQ ID NO: 52897 - DNA, 18 bp, Homo sapiens
cgcatgaatggatgaacg

SEQ ID NO: 52898 - DNA, 19 bp, Homo sapiens
cgcatgaatggatgaacga

SEQ ID NO: 52899 - DNA, 20 bp, Homo sapiens
cgcatgaatggatgaacgag

SEQ ID NO: 52900 - DNA, 26 bp, Homo sapiens
cgcatgaatggatgaacgagattccc

SEQ ID NO: 52901 - DNA, 17 bp, Homo sapiens
gcatgaatggatgaacg

SEQ ID NO: 52902 - DNA, 18 bp, Homo sapiens
gcatgaatggatgaacga

SEQ ID NO: 52903 - DNA, 21 bp, Homo sapiens
gcatgaatggatgaacgagat

SEQ ID NO: 52904 - DNA, 22 bp, Homo sapiens
gcatgaatggatgaacgagatt

SEQ ID NO: 52905 - DNA, 23 bp, Homo sapiens
gcatgaatggatgaacgagattc

SEQ ID NO: 52906 - DNA, 24 bp, Homo sapiens
gcatgaatggatgaacgagattcc

SEQ ID NO: 52907 - DNA, 25 bp, Homo sapiens
gcatgaatggatgaacgagattccc

SEQ ID NO: 52908 - DNA, 28 bp, Homo sapiens
gcatgaatggatgaacgagattcccact

SEQ ID NO: 52909 - DNA, 16 bp, Homo sapiens
catgaatggatgaacg

SEQ ID NO: 52910 - DNA, 17 bp, Homo sapiens
catgaatggatgaacga

SEQ ID NO: 52911 - DNA, 18 bp, Homo sapiens
catgaatggatgaacgag

SEQ ID NO: 52912 - DNA, 16 bp, Homo sapiens
atgaatggatgaacga

SEQ ID NO: 52913 - DNA, 30 bp, Homo sapiens
atgaatggatgaacgagattcccactgtcc

SEQ ID NO: 52914 - DNA, 16 bp, Homo sapiens
tgaatggatgaacgag

SEQ ID NO: 52915 - DNA, 20 bp, Homo sapiens
gaatggatgaacgagattcc

SEQ ID NO: 52916 - DNA, 21 bp, Homo sapiens
gaatggatgaacgagattccc

SEQ ID NO: 52917 - DNA, 29 bp, Homo sapiens
gaatggatgaacgagattcccactgtccc

SEQ ID NO: 52918 - DNA, 30 bp, Homo sapiens
gaatggatgaacgagattcccactgtccct

SEQ ID NO: 52919 - DNA, 18 bp, Homo sapiens
tggatgaacgagattccc

SEQ ID NO: 52920 - DNA, 21 bp, Homo sapiens
tggatgaacgagattcccact

SEQ ID NO: 52921 - DNA, 22 bp, Homo sapiens
tggatgaacgagattcccactg

SEQ ID NO: 52922 - DNA, 23 bp, Homo sapiens
tggatgaacgagattcccactgt

SEQ ID NO: 52923 - DNA, 30 bp, Homo sapiens
tggatgaacgagattcccactgtccctacc

SEQ ID NO: 52924 - DNA, 16 bp, Homo sapiens
gatgaacgagattccc

SEQ ID NO: 52925 - DNA, 19 bp, Homo sapiens
gatgaacgagattcccact

SEQ ID NO: 52926 - DNA, 28 bp, Homo sapiens
aacgagattcccactgtccctacctact

SEQ ID NO: 52927 - DNA, 21 bp, Homo sapiens
agattcccactgtccctacct

SEQ ID NO: 52928 - DNA, 20 bp, Homo sapiens
gattcccactgtccctacct

SEQ ID NO: 52929 - DNA, 21 bp, Homo sapiens
gattcccactgtccctaccta

SEQ ID NO: 52930 - DNA, 24 bp, Homo sapiens
gattcccactgtccctacctacta

SEQ ID NO: 52931 - DNA, 19 bp, Homo sapiens
attcccactgtccctacct

SEQ ID NO: 52932 - DNA, 21 bp, Homo sapiens
attcccactgtccctacctac

SEQ ID NO: 52933 - DNA, 23 bp, Homo sapiens
attcccactgtccctacctacta

SEQ ID NO: 52934 - DNA, 25 bp, Homo sapiens
attcccactgtccctacctactatc

SEQ ID NO: 52935 - DNA, 26 bp, Homo sapiens
attcccactgtccctacctactatcc

SEQ ID NO: 52936 - DNA, 24 bp, Homo sapiens
tcccactgtccctacctactatcc

SEQ ID NO: 52937 - DNA, 16 bp, Homo sapiens
cccactgtccctacct

SEQ ID NO: 52938 - DNA, 18 bp, Homo sapiens
cccactgtccctacctac

SEQ ID NO: 52939 - DNA, 20 bp, Homo sapiens
cccactgtccctacctacta

SEQ ID NO: 52940 - DNA, 22 bp, Homo sapiens
cccactgtccctacctactatc

SEQ ID NO: 52941 - DNA, 23 bp, Homo sapiens
cccactgtccctacctactatcc

SEQ ID NO: 52942 - DNA, 24 bp, Homo sapiens
cccactgtccctacctactatcca

SEQ ID NO: 52943 - DNA, 25 bp, Homo sapiens
cccactgtccctacctactatccag

SEQ ID NO: 52944 - DNA, 27 bp, Homo sapiens
cccactgtccctacctactatccagcg

SEQ ID NO: 52945 - DNA, 19 bp, Homo sapiens
ccactgtccctacctacta

SEQ ID NO: 52946 - DNA, 21 bp, Homo sapiens
ccactgtccctacctactatc

SEQ ID NO: 52947 - DNA, 22 bp, Homo sapiens
ccactgtccctacctactatcc

SEQ ID NO: 52948 - DNA, 23 bp, Homo sapiens
ccactgtccctacctactatcca

SEQ ID NO: 52949 - DNA, 25 bp, Homo sapiens
ccactgtccctacctactatccagc

SEQ ID NO: 52950 - DNA, 17 bp, Homo sapiens
cactgtccctacctact

SEQ ID NO: 52951 - DNA, 18 bp, Homo sapiens
cactgtccctacctacta

SEQ ID NO: 52952 - DNA, 19 bp, Homo sapiens
cactgtccctacctactat

SEQ ID NO: 52953 - DNA, 20 bp, Homo sapiens
cactgtccctacctactatc

SEQ ID NO: 52954 - DNA, 21 bp, Homo sapiens
cactgtccctacctactatcc

SEQ ID NO: 52955 - DNA, 22 bp, Homo sapiens
cactgtccctacctactatcca

SEQ ID NO: 52956 - DNA, 23 bp, Homo sapiens
cactgtccctacctactatccag

SEQ ID NO: 52957 - DNA, 24 bp, Homo sapiens
cactgtccctacctactatccagc

SEQ ID NO: 52958 - DNA, 25 bp, Homo sapiens
cactgtccctacctactatccagcg

SEQ ID NO: 52959 - DNA, 26 bp, Homo sapiens
cactgtccctacctactatccagcga

SEQ ID NO: 52960 - DNA, 17 bp, Homo sapiens
actgtccctacctacta

SEQ ID NO: 52961 - DNA, 18 bp, Homo sapiens
actgtccctacctactat

SEQ ID NO: 52962 - DNA, 19 bp, Homo sapiens
actgtccctacctactatc

SEQ ID NO: 52963 - DNA, 20 bp, Homo sapiens
actgtccctacctactatcc

SEQ ID NO: 52964 - DNA, 21 bp, Homo sapiens
actgtccctacctactatcca

SEQ ID NO: 52965 - DNA, 22 bp, Homo sapiens
actgtccctacctactatccag

SEQ ID NO: 52966 - DNA, 23 bp, Homo sapiens
actgtccctacctactatccagc

SEQ ID NO: 52967 - DNA, 24 bp, Homo sapiens
actgtccctacctactatccagcg

SEQ ID NO: 52968 - DNA, 25 bp, Homo sapiens
actgtccctacctactatccagcga

SEQ ID NO: 52969 - DNA, 16 bp, Homo sapiens
ctgtccctacctacta

SEQ ID NO: 52970 - DNA, 17 bp, Homo sapiens
ctgtccctacctactat

SEQ ID NO: 52971 - DNA, 18 bp, Homo sapiens
ctgtccctacctactatc

SEQ ID NO: 52972 - DNA, 19 bp, Homo sapiens
ctgtccctacctactatcc

SEQ ID NO: 52973 - DNA, 20 bp, Homo sapiens
ctgtccctacctactatcca

SEQ ID NO: 52974 - DNA, 21 bp, Homo sapiens
ctgtccctacctactatccag

SEQ ID NO: 52975 - DNA, 22 bp, Homo sapiens
ctgtccctacctactatccagc

SEQ ID NO: 52976 - DNA, 23 bp, Homo sapiens
ctgtccctacctactatccagcg

SEQ ID NO: 52977 - DNA, 24 bp, Homo sapiens
ctgtccctacctactatccagcga

SEQ ID NO: 52978 - DNA, 25 bp, Homo sapiens
ctgtccctacctactatccagcgaa

SEQ ID NO: 52979 - DNA, 17 bp, Homo sapiens
tgtccctacctactatc

SEQ ID NO: 52980 - DNA, 18 bp, Homo sapiens
tgtccctacctactatcc

SEQ ID NO: 52981 - DNA, 16 bp, Homo sapiens
gtccctacctactatc

SEQ ID NO: 52982 - DNA, 17 bp, Homo sapiens
gtccctacctactatcc

SEQ ID NO: 52983 - DNA, 19 bp, Homo sapiens
gtccctacctactatccag

SEQ ID NO: 52984 - DNA, 20 bp, Homo sapiens
gtccctacctactatccagc

SEQ ID NO: 52985 - DNA, 21 bp, Homo sapiens
gtccctacctactatccagcg

SEQ ID NO: 52986 - DNA, 22 bp, Homo sapiens
gtccctacctactatccagcga

SEQ ID NO: 52987 - DNA, 18 bp, Homo sapiens
tccctacctactatccag

SEQ ID NO: 52988 - DNA, 19 bp, Homo sapiens
ccctacctactatccagcg

SEQ ID NO: 52989 - DNA, 19 bp, Homo sapiens
cctactatccagcgaaacc

SEQ ID NO: 52990 - DNA, 24 bp, Homo sapiens
ctatccagcgaaaccacagccaag

SEQ ID NO: 52991 - DNA, 21 bp, Homo sapiens
tccagcgaaaccacagccaag

SEQ ID NO: 52992 - DNA, 22 bp, Homo sapiens
tccagcgaaaccacagccaagg

SEQ ID NO: 52993 - DNA, 23 bp, Homo sapiens
tccagcgaaaccacagccaaggg

SEQ ID NO: 52994 - DNA, 20 bp, Homo sapiens
ccagcgaaaccacagccaag

SEQ ID NO: 52995 - DNA, 21 bp, Homo sapiens
ccagcgaaaccacagccaagg

SEQ ID NO: 52996 - DNA, 22 bp, Homo sapiens
ccagcgaaaccacagccaaggg

SEQ ID NO: 52997 - DNA, 19 bp, Homo sapiens
gcgaaaccacagccaaggg

SEQ ID NO: 52998 - DNA, 20 bp, Homo sapiens
gcgaaaccacagccaaggga

SEQ ID NO: 52999 - DNA, 30 bp, Homo sapiens
gcgaaaccacagccaagggaacgggcttgg

SEQ ID NO: 53000 - DNA, 16 bp, Homo sapiens
cgaaaccacagccaag

SEQ ID NO: 53001 - DNA, 17 bp, Homo sapiens
cgaaaccacagccaagg

SEQ ID NO: 53002 - DNA, 18 bp, Homo sapiens
cgaaaccacagccaaggg

SEQ ID NO: 53003 - DNA, 24 bp, Homo sapiens
gaaaccacagccaagggaacgggc

SEQ ID NO: 53004 - DNA, 20 bp, Homo sapiens
aaaccacagccaagggaacg

SEQ ID NO: 53005 - DNA, 19 bp, Homo sapiens
aaccacagccaagggaacg

SEQ ID NO: 53006 - DNA, 24 bp, Homo sapiens
accacagccaagggaacgggcttg

SEQ ID NO: 53007 - DNA, 23 bp, Homo sapiens
ccacagccaagggaacgggcttg

SEQ ID NO: 53008 - DNA, 22 bp, Homo sapiens
cacagccaagggaacgggcttg

SEQ ID NO: 53009 - DNA, 23 bp, Homo sapiens
cacagccaagggaacgggcttgg

SEQ ID NO: 53010 - DNA, 21 bp, Homo sapiens
acagccaagggaacgggcttg

SEQ ID NO: 53011 - DNA, 22 bp, Homo sapiens
acagccaagggaacgggcttgg

SEQ ID NO: 53012 - DNA, 20 bp, Homo sapiens
cagccaagggaacgggcttg

SEQ ID NO: 53013 - DNA, 21 bp, Homo sapiens
cagccaagggaacgggcttgg

SEQ ID NO: 53014 - DNA, 18 bp, Homo sapiens
gccaagggaacgggcttg

SEQ ID NO: 53015 - DNA, 22 bp, Homo sapiens
gccaagggaacgggcttggcgg

SEQ ID NO: 53016 - DNA, 23 bp, Homo sapiens
gccaagggaacgggcttggcgga

SEQ ID NO: 53017 - DNA, 28 bp, Homo sapiens
gccaagggaacgggcttggcggaatcag

SEQ ID NO: 53018 - DNA, 18 bp, Homo sapiens
ccaagggaacgggcttgg

SEQ ID NO: 53019 - DNA, 21 bp, Homo sapiens
ccaagggaacgggcttggcgg

SEQ ID NO: 53020 - DNA, 23 bp, Homo sapiens
ccaagggaacgggcttggcggaa

SEQ ID NO: 53021 - DNA, 24 bp, Homo sapiens
ccaagggaacgggcttggcggaat

SEQ ID NO: 53022 - DNA, 17 bp, Homo sapiens
caagggaacgggcttgg

SEQ ID NO: 53023 - DNA, 19 bp, Homo sapiens
caagggaacgggcttggcg

SEQ ID NO: 53024 - DNA, 16 bp, Homo sapiens
aagggaacgggcttgg

SEQ ID NO: 53025 - DNA, 18 bp, Homo sapiens
aagggaacgggcttggcg

SEQ ID NO: 53026 - DNA, 19 bp, Homo sapiens
aagggaacgggcttggcgg

SEQ ID NO: 53027 - DNA, 20 bp, Homo sapiens
aagggaacgggcttggcgga

SEQ ID NO: 53028 - DNA, 21 bp, Homo sapiens
aagggaacgggcttggcggaa

SEQ ID NO: 53029 - DNA, 22 bp, Homo sapiens
aagggaacgggcttggcggaat

SEQ ID NO: 53030 - DNA, 23 bp, Homo sapiens
aagggaacgggcttggcggaatc

SEQ ID NO: 53031 - DNA, 17 bp, Homo sapiens
agggaacgggcttggcg

SEQ ID NO: 53032 - DNA, 18 bp, Homo sapiens
agggaacgggcttggcgg

SEQ ID NO: 53033 - DNA, 19 bp, Homo sapiens
agggaacgggcttggcgga

SEQ ID NO: 53034 - DNA, 20 bp, Homo sapiens
agggaacgggcttggcggaa

SEQ ID NO: 53035 - DNA, 21 bp, Homo sapiens
agggaacgggcttggcggaat

SEQ ID NO: 53036 - DNA, 22 bp, Homo sapiens
agggaacgggcttggcggaatc

SEQ ID NO: 53037 - DNA, 23 bp, Homo sapiens
agggaacgggcttggcggaatca

SEQ ID NO: 53038 - DNA, 25 bp, Homo sapiens
agggaacgggcttggcggaatcagc

SEQ ID NO: 53039 - DNA, 16 bp, Homo sapiens
gggaacgggcttggcg

SEQ ID NO: 53040 - DNA, 20 bp, Homo sapiens
gggaacgggcttggcggaat

SEQ ID NO: 53041 - DNA, 21 bp, Homo sapiens
gggaacgggcttggcggaatc

SEQ ID NO: 53042 - DNA, 25 bp, Homo sapiens
ggaacgggcttggcggaatcagcgg

SEQ ID NO: 53043 - DNA, 17 bp, Homo sapiens
aacgggcttggcggaat

SEQ ID NO: 53044 - DNA, 19 bp, Homo sapiens
aacgggcttggcggaatca

SEQ ID NO: 53045 - DNA, 20 bp, Homo sapiens
aacgggcttggcggaatcag

SEQ ID NO: 53046 - DNA, 23 bp, Homo sapiens
aacgggcttggcggaatcagcgg

SEQ ID NO: 53047 - DNA, 16 bp, Homo sapiens
acgggcttggcggaat

SEQ ID NO: 53048 - DNA, 22 bp, Homo sapiens
acgggcttggcggaatcagcgg

SEQ ID NO: 53049 - DNA, 23 bp, Homo sapiens
acgggcttggcggaatcagcggg

SEQ ID NO: 53050 - DNA, 24 bp, Homo sapiens
acgggcttggcggaatcagcgggg

SEQ ID NO: 53051 - DNA, 21 bp, Homo sapiens
cgggcttggcggaatcagcgg

SEQ ID NO: 53052 - DNA, 18 bp, Homo sapiens
ggcttggcggaatcagcg

SEQ ID NO: 53053 - DNA, 19 bp, Homo sapiens
ggcttggcggaatcagcgg

SEQ ID NO: 53054 - DNA, 21 bp, Homo sapiens
ggcttggcggaatcagcgggg

SEQ ID NO: 53055 - DNA, 16 bp, Homo sapiens
gcggaatcagcgggga

SEQ ID NO: 53056 - DNA, 19 bp, Homo sapiens
gcggaatcagcggggaaag

SEQ ID NO: 53057 - DNA, 20 bp, Homo sapiens
gcggaatcagcggggaaaga

SEQ ID NO: 53058 - DNA, 22 bp, Homo sapiens
gcggaatcagcggggaaagaag

SEQ ID NO: 53059 - DNA, 23 bp, Homo sapiens
gcggaatcagcggggaaagaaga

SEQ ID NO: 53060 - DNA, 30 bp, Homo sapiens
gcggaatcagcggggaaagaagaccctgtt

SEQ ID NO: 53061 - DNA, 18 bp, Homo sapiens
cggaatcagcggggaaag

SEQ ID NO: 53062 - DNA, 19 bp, Homo sapiens
cggaatcagcggggaaaga

SEQ ID NO: 53063 - DNA, 21 bp, Homo sapiens
cggaatcagcggggaaagaag

SEQ ID NO: 53064 - DNA, 29 bp, Homo sapiens
ggaatcagcggggaaagaagaccctgttg

SEQ ID NO: 53065 - DNA, 30 bp, Homo sapiens
gaatcagcggggaaagaagaccctgttgag

SEQ ID NO: 53066 - DNA, 18 bp, Homo sapiens
aatcagcggggaaagaag

SEQ ID NO: 53067 - DNA, 16 bp, Homo sapiens
cggggaaagaagaccc

SEQ ID NO: 53068 - DNA, 21 bp, Homo sapiens
cggggaaagaagaccctgttg

SEQ ID NO: 53069 - DNA, 22 bp, Homo sapiens
cggggaaagaagaccctgttga

SEQ ID NO: 53070 - DNA, 23 bp, Homo sapiens
cggggaaagaagaccctgttgag

SEQ ID NO: 53071 - DNA, 25 bp, Homo sapiens
cggggaaagaagaccctgttgagct

SEQ ID NO: 53072 - DNA, 26 bp, Homo sapiens
cggggaaagaagaccctgttgagctt

SEQ ID NO: 53073 - DNA, 27 bp, Homo sapiens
cggggaaagaagaccctgttgagcttg

SEQ ID NO: 53074 - DNA, 28 bp, Homo sapiens
cggggaaagaagaccctgttgagcttga

SEQ ID NO: 53075 - DNA, 29 bp, Homo sapiens
cggggaaagaagaccctgttgagcttgac

SEQ ID NO: 53076 - DNA, 30 bp, Homo sapiens
cggggaaagaagaccctgttgagcttgact

SEQ ID NO: 53077 - DNA, 19 bp, Homo sapiens
ggggaaagaagaccctgtt

SEQ ID NO: 53078 - DNA, 25 bp, Homo sapiens
ggggaaagaagaccctgttgagctt

SEQ ID NO: 53079 - DNA, 26 bp, Homo sapiens
ggggaaagaagaccctgttgagcttg

SEQ ID NO: 53080 - DNA, 28 bp, Homo sapiens
ggggaaagaagaccctgttgagcttgac

SEQ ID NO: 53081 - DNA, 22 bp, Homo sapiens
gggaaagaagaccctgttgagc

SEQ ID NO: 53082 - DNA, 24 bp, Homo sapiens
gggaaagaagaccctgttgagctt

SEQ ID NO: 53083 - DNA, 28 bp, Homo sapiens
gggaaagaagaccctgttgagcttgact

SEQ ID NO: 53084 - DNA, 30 bp, Homo sapiens
gggaaagaagaccctgttgagcttgactct

SEQ ID NO: 53085 - DNA, 18 bp, Homo sapiens
aaagaagaccctgttgag

SEQ ID NO: 53086 - DNA, 16 bp, Homo sapiens
aagaagaccctgttga

SEQ ID NO: 53087 - DNA, 23 bp, Homo sapiens
aagaagaccctgttgagcttgac

SEQ ID NO: 53088 - DNA, 22 bp, Homo sapiens
agaagaccctgttgagcttgac

SEQ ID NO: 53089 - DNA, 20 bp, Homo sapiens
gaagaccctgttgagcttga

SEQ ID NO: 53090 - DNA, 24 bp, Homo sapiens
gaagaccctgttgagcttgactct

SEQ ID NO: 53091 - DNA, 17 bp, Homo sapiens
aagaccctgttgagctt

SEQ ID NO: 53092 - DNA, 18 bp, Homo sapiens
aagaccctgttgagcttg

SEQ ID NO: 53093 - DNA, 19 bp, Homo sapiens
aagaccctgttgagcttga

SEQ ID NO: 53094 - DNA, 20 bp, Homo sapiens
aagaccctgttgagcttgac

SEQ ID NO: 53095 - DNA, 21 bp, Homo sapiens
aagaccctgttgagcttgact

SEQ ID NO: 53096 - DNA, 22 bp, Homo sapiens
aagaccctgttgagcttgactc

SEQ ID NO: 53097 - DNA, 23 bp, Homo sapiens
aagaccctgttgagcttgactct

SEQ ID NO: 53098 - DNA, 24 bp, Homo sapiens
aagaccctgttgagcttgactcta

SEQ ID NO: 53099 - DNA, 25 bp, Homo sapiens
aagaccctgttgagcttgactctag

SEQ ID NO: 53100 - DNA, 26 bp, Homo sapiens
aagaccctgttgagcttgactctagt

SEQ ID NO: 53101 - DNA, 17 bp, Homo sapiens
agaccctgttgagcttg

SEQ ID NO: 53102 - DNA, 18 bp, Homo sapiens
agaccctgttgagcttga

SEQ ID NO: 53103 - DNA, 19 bp, Homo sapiens
agaccctgttgagcttgac

SEQ ID NO: 53104 - DNA, 20 bp, Homo sapiens
agaccctgttgagcttgact

SEQ ID NO: 53105 - DNA, 21 bp, Homo sapiens
agaccctgttgagcttgactc

SEQ ID NO: 53106 - DNA, 22 bp, Homo sapiens
agaccctgttgagcttgactct

SEQ ID NO: 53107 - DNA, 23 bp, Homo sapiens
agaccctgttgagcttgactcta

SEQ ID NO: 53108 - DNA, 24 bp, Homo sapiens
agaccctgttgagcttgactctag

SEQ ID NO: 53109 - DNA, 25 bp, Homo sapiens
agaccctgttgagcttgactctagt

SEQ ID NO: 53110 - DNA, 16 bp, Homo sapiens
gaccctgttgagcttg

SEQ ID NO: 53111 - DNA, 17 bp, Homo sapiens
gaccctgttgagcttga

SEQ ID NO: 53112 - DNA, 18 bp, Homo sapiens
gaccctgttgagcttgac

SEQ ID NO: 53113 - DNA, 19 bp, Homo sapiens
gaccctgttgagcttgact

SEQ ID NO: 53114 - DNA, 20 bp, Homo sapiens
gaccctgttgagcttgactc

SEQ ID NO: 53115 - DNA, 21 bp, Homo sapiens
gaccctgttgagcttgactct

SEQ ID NO: 53116 - DNA, 22 bp, Homo sapiens
gaccctgttgagcttgactcta

SEQ ID NO: 53117 - DNA, 23 bp, Homo sapiens
gaccctgttgagcttgactctag

SEQ ID NO: 53118 - DNA, 24 bp, Homo sapiens
gaccctgttgagcttgactctagt

SEQ ID NO: 53119 - DNA, 27 bp, Homo sapiens
gaccctgttgagcttgactctagtctg

SEQ ID NO: 53120 - DNA, 28 bp, Homo sapiens
gaccctgttgagcttgactctagtctgg

SEQ ID NO: 53121 - DNA, 16 bp, Homo sapiens
accctgttgagcttga

SEQ ID NO: 53122 - DNA, 17 bp, Homo sapiens
accctgttgagcttgac

SEQ ID NO: 53123 - DNA, 18 bp, Homo sapiens
accctgttgagcttgact

SEQ ID NO: 53124 - DNA, 19 bp, Homo sapiens
accctgttgagcttgactc

SEQ ID NO: 53125 - DNA, 20 bp, Homo sapiens
accctgttgagcttgactct

SEQ ID NO: 53126 - DNA, 21 bp, Homo sapiens
accctgttgagcttgactcta

SEQ ID NO: 53127 - DNA, 22 bp, Homo sapiens
accctgttgagcttgactctag

SEQ ID NO: 53128 - DNA, 23 bp, Homo sapiens
accctgttgagcttgactctagt

SEQ ID NO: 53129 - DNA, 26 bp, Homo sapiens
accctgttgagcttgactctagtctg

SEQ ID NO: 53130 - DNA, 27 bp, Homo sapiens
accctgttgagcttgactctagtctgg

SEQ ID NO: 53131 - DNA, 16 bp, Homo sapiens
ccctgttgagcttgac

SEQ ID NO: 53132 - DNA, 17 bp, Homo sapiens
ccctgttgagcttgact

SEQ ID NO: 53133 - DNA, 18 bp, Homo sapiens
ccctgttgagcttgactc

SEQ ID NO: 53134 - DNA, 19 bp, Homo sapiens
ccctgttgagcttgactct

SEQ ID NO: 53135 - DNA, 20 bp, Homo sapiens
ccctgttgagcttgactcta

SEQ ID NO: 53136 - DNA, 21 bp, Homo sapiens
ccctgttgagcttgactctag

SEQ ID NO: 53137 - DNA, 22 bp, Homo sapiens
ccctgttgagcttgactctagt

SEQ ID NO: 53138 - DNA, 23 bp, Homo sapiens
ccctgttgagcttgactctagtc

SEQ ID NO: 53139 - DNA, 27 bp, Homo sapiens
ccctgttgagcttgactctagtctggc

SEQ ID NO: 53140 - DNA, 17 bp, Homo sapiens
cctgttgagcttgactc

SEQ ID NO: 53141 - DNA, 18 bp, Homo sapiens
cctgttgagcttgactct

SEQ ID NO: 53142 - DNA, 20 bp, Homo sapiens
cctgttgagcttgactctag

SEQ ID NO: 53143 - DNA, 22 bp, Homo sapiens
cctgttgagcttgactctagtc

SEQ ID NO: 53144 - DNA, 23 bp, Homo sapiens
cctgttgagcttgactctagtct

SEQ ID NO: 53145 - DNA, 16 bp, Homo sapiens
ctgttgagcttgactc

SEQ ID NO: 53146 - DNA, 17 bp, Homo sapiens
ctgttgagcttgactct

SEQ ID NO: 53147 - DNA, 18 bp, Homo sapiens
ctgttgagcttgactcta

SEQ ID NO: 53148 - DNA, 19 bp, Homo sapiens
ctgttgagcttgactctag

SEQ ID NO: 53149 - DNA, 20 bp, Homo sapiens
ctgttgagcttgactctagt

SEQ ID NO: 53150 - DNA, 21 bp, Homo sapiens
ctgttgagcttgactctagtc

SEQ ID NO: 53151 - DNA, 22 bp, Homo sapiens
ctgttgagcttgactctagtct

SEQ ID NO: 53152 - DNA, 25 bp, Homo sapiens
ctgttgagcttgactctagtctggc

SEQ ID NO: 53153 - DNA, 28 bp, Homo sapiens
ctgttgagcttgactctagtctggcacg

SEQ ID NO: 53154 - DNA, 29 bp, Homo sapiens
ctgttgagcttgactctagtctggcacgg

SEQ ID NO: 53155 - DNA, 30 bp, Homo sapiens
ctgttgagcttgactctagtctggcacggt

SEQ ID NO: 53156 - DNA, 21 bp, Homo sapiens
gttgagcttgactctagtctg

SEQ ID NO: 53157 - DNA, 22 bp, Homo sapiens
gttgagcttgactctagtctgg

SEQ ID NO: 53158 - DNA, 20 bp, Homo sapiens
ttgagcttgactctagtctg

SEQ ID NO: 53159 - DNA, 21 bp, Homo sapiens
ttgagcttgactctagtctgg

SEQ ID NO: 53160 - DNA, 19 bp, Homo sapiens
tgagcttgactctagtctg

SEQ ID NO: 53161 - DNA, 20 bp, Homo sapiens
tgagcttgactctagtctgg

SEQ ID NO: 53162 - DNA, 18 bp, Homo sapiens
gagcttgactctagtctg

SEQ ID NO: 53163 - DNA, 19 bp, Homo sapiens
gagcttgactctagtctgg

SEQ ID NO: 53164 - DNA, 17 bp, Homo sapiens
agcttgactctagtctg

SEQ ID NO: 53165 - DNA, 18 bp, Homo sapiens
agcttgactctagtctgg

SEQ ID NO: 53166 - DNA, 21 bp, Homo sapiens
cttgactctagtctggcacgg

SEQ ID NO: 53167 - DNA, 22 bp, Homo sapiens
cttgactctagtctggcacggt

SEQ ID NO: 53168 - DNA, 23 bp, Homo sapiens
cttgactctagtctggcacggtg

SEQ ID NO: 53169 - DNA, 16 bp, Homo sapiens
ttgactctagtctggc

SEQ ID NO: 53170 - DNA, 20 bp, Homo sapiens
ttgactctagtctggcacgg

SEQ ID NO: 53171 - DNA, 21 bp, Homo sapiens
ttgactctagtctggcacggt

SEQ ID NO: 53172 - DNA, 22 bp, Homo sapiens
ttgactctagtctggcacggtg

SEQ ID NO: 53173 - DNA, 23 bp, Homo sapiens
ttgactctagtctggcacggtga

SEQ ID NO: 53174 - DNA, 24 bp, Homo sapiens
ttgactctagtctggcacggtgaa

SEQ ID NO: 53175 - DNA, 29 bp, Homo sapiens
ttgactctagtctggcacggtgaagagac

SEQ ID NO: 53176 - DNA, 17 bp, Homo sapiens
tgactctagtctggcac

SEQ ID NO: 53177 - DNA, 18 bp, Homo sapiens
tgactctagtctggcacg

SEQ ID NO: 53178 - DNA, 19 bp, Homo sapiens
tgactctagtctggcacgg

SEQ ID NO: 53179 - DNA, 20 bp, Homo sapiens
tgactctagtctggcacggt

SEQ ID NO: 53180 - DNA, 21 bp, Homo sapiens
tgactctagtctggcacggtg

SEQ ID NO: 53181 - DNA, 22 bp, Homo sapiens
tgactctagtctggcacggtga

SEQ ID NO: 53182 - DNA, 23 bp, Homo sapiens
tgactctagtctggcacggtgaa

SEQ ID NO: 53183 - DNA, 18 bp, Homo sapiens
gactctagtctggcacgg

SEQ ID NO: 53184 - DNA, 19 bp, Homo sapiens
gactctagtctggcacggt

SEQ ID NO: 53185 - DNA, 20 bp, Homo sapiens
gactctagtctggcacggtg

SEQ ID NO: 53186 - DNA, 21 bp, Homo sapiens
gactctagtctggcacggtga

SEQ ID NO: 53187 - DNA, 16 bp, Homo sapiens
actctagtctggcacg

SEQ ID NO: 53188 - DNA, 17 bp, Homo sapiens
actctagtctggcacgg

SEQ ID NO: 53189 - DNA, 18 bp, Homo sapiens
actctagtctggcacggt

SEQ ID NO: 53190 - DNA, 19 bp, Homo sapiens
actctagtctggcacggtg

SEQ ID NO: 53191 - DNA, 20 bp, Homo sapiens
actctagtctggcacggtga

SEQ ID NO: 53192 - DNA, 21 bp, Homo sapiens
actctagtctggcacggtgaa

SEQ ID NO: 53193 - DNA, 23 bp, Homo sapiens
actctagtctggcacggtgaaga

SEQ ID NO: 53194 - DNA, 24 bp, Homo sapiens
actctagtctggcacggtgaagag

SEQ ID NO: 53195 - DNA, 25 bp, Homo sapiens
actctagtctggcacggtgaagaga

SEQ ID NO: 53196 - DNA, 29 bp, Homo sapiens
actctagtctggcacggtgaagagacatg

SEQ ID NO: 53197 - DNA, 16 bp, Homo sapiens
ctctagtctggcacgg

SEQ ID NO: 53198 - DNA, 17 bp, Homo sapiens
ctctagtctggcacggt

SEQ ID NO: 53199 - DNA, 18 bp, Homo sapiens
ctctagtctggcacggtg

SEQ ID NO: 53200 - DNA, 19 bp, Homo sapiens
ctctagtctggcacggtga

SEQ ID NO: 53201 - DNA, 20 bp, Homo sapiens
ctctagtctggcacggtgaa

SEQ ID NO: 53202 - DNA, 21 bp, Homo sapiens
ctctagtctggcacggtgaag

SEQ ID NO: 53203 - DNA, 22 bp, Homo sapiens
ctctagtctggcacggtgaaga

SEQ ID NO: 53204 - DNA, 23 bp, Homo sapiens
ctctagtctggcacggtgaagag

SEQ ID NO: 53205 - DNA, 24 bp, Homo sapiens
ctctagtctggcacggtgaagaga

SEQ ID NO: 53206 - DNA, 25 bp, Homo sapiens
ctctagtctggcacggtgaagagac

SEQ ID NO: 53207 - DNA, 26 bp, Homo sapiens
ctctagtctggcacggtgaagagaca

SEQ ID NO: 53208 - DNA, 27 bp, Homo sapiens
ctctagtctggcacggtgaagagacat

SEQ ID NO: 53209 - DNA, 29 bp, Homo sapiens
ctctagtctggcacggtgaagagacatga

SEQ ID NO: 53210 - DNA, 30 bp, Homo sapiens
ctctagtctggcacggtgaagagacatgag

SEQ ID NO: 53211 - DNA, 21 bp, Homo sapiens
tctagtctggcacggtgaaga

SEQ ID NO: 53212 - DNA, 24 bp, Homo sapiens
ctagtctggcacggtgaagagaca

SEQ ID NO: 53213 - DNA, 19 bp, Homo sapiens
tagtctggcacggtgaaga

SEQ ID NO: 53214 - DNA, 19 bp, Homo sapiens
agtctggcacggtgaagag

SEQ ID NO: 53215 - DNA, 19 bp, Homo sapiens
tctggcacggtgaagagac

SEQ ID NO: 53216 - DNA, 18 bp, Homo sapiens
ctggcacggtgaagagac

SEQ ID NO: 53217 - DNA, 19 bp, Homo sapiens
cacggtgaagagacatgag

SEQ ID NO: 53218 - DNA, 22 bp, Homo sapiens
gtgaagagacatgagaggtgta

SEQ ID NO: 53219 - DNA, 22 bp, Homo sapiens
gaagagacatgagaggtgtaga

SEQ ID NO: 53220 - DNA, 17 bp, Homo sapiens
aagagacatgagaggtg

SEQ ID NO: 53221 - DNA, 20 bp, Homo sapiens
aagagacatgagaggtgtag

SEQ ID NO: 53222 - DNA, 21 bp, Homo sapiens
aagagacatgagaggtgtaga

SEQ ID NO: 53223 - DNA, 22 bp, Homo sapiens
aagagacatgagaggtgtagaa

SEQ ID NO: 53224 - DNA, 23 bp, Homo sapiens
aagagacatgagaggtgtagaat

SEQ ID NO: 53225 - DNA, 30 bp, Homo sapiens
aagagacatgagaggtgtagaataagtggg

SEQ ID NO: 53226 - DNA, 19 bp, Homo sapiens
agagacatgagaggtgtag

SEQ ID NO: 53227 - DNA, 20 bp, Homo sapiens
agagacatgagaggtgtaga

SEQ ID NO: 53228 - DNA, 21 bp, Homo sapiens
agagacatgagaggtgtagaa

SEQ ID NO: 53229 - DNA, 22 bp, Homo sapiens
agagacatgagaggtgtagaat

SEQ ID NO: 53230 - DNA, 23 bp, Homo sapiens
agagacatgagaggtgtagaata

SEQ ID NO: 53231 - DNA, 24 bp, Homo sapiens
agagacatgagaggtgtagaataa

SEQ ID NO: 53232 - DNA, 29 bp, Homo sapiens
agagacatgagaggtgtagaataagtggg

SEQ ID NO: 53233 - DNA, 18 bp, Homo sapiens
gagacatgagaggtgtag

SEQ ID NO: 53234 - DNA, 19 bp, Homo sapiens
gagacatgagaggtgtaga

SEQ ID NO: 53235 - DNA, 20 bp, Homo sapiens
gagacatgagaggtgtagaa

SEQ ID NO: 53236 - DNA, 21 bp, Homo sapiens
gagacatgagaggtgtagaat

SEQ ID NO: 53237 - DNA, 22 bp, Homo sapiens
gagacatgagaggtgtagaata

SEQ ID NO: 53238 - DNA, 23 bp, Homo sapiens
gagacatgagaggtgtagaataa

SEQ ID NO: 53239 - DNA, 26 bp, Homo sapiens
gagacatgagaggtgtagaataagtg

SEQ ID NO: 53240 - DNA, 29 bp, Homo sapiens
gagacatgagaggtgtagaataagtggga

SEQ ID NO: 53241 - DNA, 30 bp, Homo sapiens
gagacatgagaggtgtagaataagtgggag

SEQ ID NO: 53242 - DNA, 17 bp, Homo sapiens
gacatgagaggtgtaga

SEQ ID NO: 53243 - DNA, 18 bp, Homo sapiens
gacatgagaggtgtagaa

SEQ ID NO: 53244 - DNA, 19 bp, Homo sapiens
gacatgagaggtgtagaat

SEQ ID NO: 53245 - DNA, 20 bp, Homo sapiens
gacatgagaggtgtagaata

SEQ ID NO: 53246 - DNA, 16 bp, Homo sapiens
acatgagaggtgtaga

SEQ ID NO: 53247 - DNA, 18 bp, Homo sapiens
acatgagaggtgtagaat

SEQ ID NO: 53248 - DNA, 21 bp, Homo sapiens
acatgagaggtgtagaataag

SEQ ID NO: 53249 - DNA, 22 bp, Homo sapiens
acatgagaggtgtagaataagt

SEQ ID NO: 53250 - DNA, 23 bp, Homo sapiens
acatgagaggtgtagaataagtg

SEQ ID NO: 53251 - DNA, 24 bp, Homo sapiens
acatgagaggtgtagaataagtgg

SEQ ID NO: 53252 - DNA, 25 bp, Homo sapiens
acatgagaggtgtagaataagtggg

SEQ ID NO: 53253 - DNA, 30 bp, Homo sapiens
acatgagaggtgtagaataagtgggaggcc

SEQ ID NO: 53254 - DNA, 16 bp, Homo sapiens
catgagaggtgtagaa

SEQ ID NO: 53255 - DNA, 17 bp, Homo sapiens
catgagaggtgtagaat

SEQ ID NO: 53256 - DNA, 20 bp, Homo sapiens
catgagaggtgtagaataag

SEQ ID NO: 53257 - DNA, 21 bp, Homo sapiens
catgagaggtgtagaataagt

SEQ ID NO: 53258 - DNA, 22 bp, Homo sapiens
catgagaggtgtagaataagtg

SEQ ID NO: 53259 - DNA, 23 bp, Homo sapiens
catgagaggtgtagaataagtgg

SEQ ID NO: 53260 - DNA, 24 bp, Homo sapiens
catgagaggtgtagaataagtggg

SEQ ID NO: 53261 - DNA, 29 bp, Homo sapiens
catgagaggtgtagaataagtgggaggcc

SEQ ID NO: 53262 - DNA, 30 bp, Homo sapiens; identical to SEQ ID NO: 26123

SEQ ID NO: 53263 - DNA, 20 bp, Homo sapiens
atgagaggtgtagaataagt

SEQ ID NO: 53264 - DNA, 25 bp, Homo sapiens
atgagaggtgtagaataagtgggag

SEQ ID NO: 53265 - DNA, 27 bp, Homo sapiens
atgagaggtgtagaataagtgggaggc

SEQ ID NO: 53266 - DNA, 28 bp, Homo sapiens
atgagaggtgtagaataagtgggaggcc

SEQ ID NO: 53267 - DNA, 29 bp, Homo sapiens
atgagaggtgtagaataagtgggaggccc

SEQ ID NO: 53268 - DNA, 30 bp, Homo sapiens
atgagaggtgtagaataagtgggaggcccc

SEQ ID NO: 53269 - DNA, 17 bp, Homo sapiens
tgagaggtgtagaataa

SEQ ID NO: 53270 - DNA, 18 bp, Homo sapiens
tgagaggtgtagaataag

SEQ ID NO: 53271 - DNA, 20 bp, Homo sapiens
tgagaggtgtagaataagtg

SEQ ID NO: 53272 - DNA, 21 bp, Homo sapiens
tgagaggtgtagaataagtgg

SEQ ID NO: 53273 - DNA, 22 bp, Homo sapiens
tgagaggtgtagaataagtggg

SEQ ID NO: 53274 - DNA, 23 bp, Homo sapiens
tgagaggtgtagaataagtggga

SEQ ID NO: 53275 - DNA, 24 bp, Homo sapiens
tgagaggtgtagaataagtgggag

SEQ ID NO: 53276 - DNA, 26 bp, Homo sapiens
tgagaggtgtagaataagtgggaggc

SEQ ID NO: 53277 - DNA, 27 bp, Homo sapiens
tgagaggtgtagaataagtgggaggcc

SEQ ID NO: 53278 - DNA, 28 bp, Homo sapiens
tgagaggtgtagaataagtgggaggccc

SEQ ID NO: 53279 - DNA, 30 bp, Homo sapiens
tgagaggtgtagaataagtgggaggccccc

SEQ ID NO: 53280 - DNA, 16 bp, Homo sapiens
gagaggtgtagaataa

SEQ ID NO: 53281 - DNA, 17 bp, Homo sapiens
gagaggtgtagaataag

SEQ ID NO: 53282 - DNA, 18 bp, Homo sapiens
gagaggtgtagaataagt

SEQ ID NO: 53283 - DNA, 19 bp, Homo sapiens
gagaggtgtagaataagtg

SEQ ID NO: 53284 - DNA, 20 bp, Homo sapiens
gagaggtgtagaataagtgg

SEQ ID NO: 53285 - DNA, 21 bp, Homo sapiens
gagaggtgtagaataagtggg

SEQ ID NO: 53286 - DNA, 22 bp, Homo sapiens
gagaggtgtagaataagtggga

SEQ ID NO: 53287 - DNA, 23 bp, Homo sapiens
gagaggtgtagaataagtgggag

SEQ ID NO: 53288 - DNA, 24 bp, Homo sapiens
gagaggtgtagaataagtgggagg

SEQ ID NO: 53289 - DNA, 25 bp, Homo sapiens
gagaggtgtagaataagtgggaggc

SEQ ID NO: 53290 - DNA, 26 bp, Homo sapiens
gagaggtgtagaataagtgggaggcc

SEQ ID NO: 53291 - DNA, 27 bp, Homo sapiens
gagaggtgtagaataagtgggaggccc

SEQ ID NO: 53292 - DNA, 28 bp, Homo sapiens
gagaggtgtagaataagtgggaggcccc

SEQ ID NO: 53293 - DNA, 30 bp, Homo sapiens; identical to SEQ ID NO: 26142

SEQ ID NO: 53294 - DNA, 16 bp, Homo sapiens
agaggtgtagaataag

SEQ ID NO: 53295 - DNA, 17 bp, Homo sapiens
agaggtgtagaataagt

SEQ ID NO: 53296 - DNA, 18 bp, Homo sapiens
agaggtgtagaataagtg

SEQ ID NO: 53297 - DNA, 19 bp, Homo sapiens
agaggtgtagaataagtgg

SEQ ID NO: 53298 - DNA, 20 bp, Homo sapiens
agaggtgtagaataagtggg

SEQ ID NO: 53299 - DNA, 21 bp, Homo sapiens
agaggtgtagaataagtggga

SEQ ID NO: 53300 - DNA, 22 bp, Homo sapiens
agaggtgtagaataagtgggag

SEQ ID NO: 53301 - DNA, 23 bp, Homo sapiens
agaggtgtagaataagtgggagg

SEQ ID NO: 53302 - DNA, 24 bp, Homo sapiens
agaggtgtagaataagtgggaggc

SEQ ID NO: 53303 - DNA, 25 bp, Homo sapiens
agaggtgtagaataagtgggaggcc

SEQ ID NO: 53304 - DNA, 26 bp, Homo sapiens
agaggtgtagaataagtgggaggccc

SEQ ID NO: 53305 - DNA, 27 bp, Homo sapiens
agaggtgtagaataagtgggaggcccc

SEQ ID NO: 53306 - DNA, 28 bp, Homo sapiens
agaggtgtagaataagtgggaggccccc

SEQ ID NO: 53307 - DNA, 29 bp, Homo sapiens
agaggtgtagaataagtgggaggcccccg

SEQ ID NO: 53308 - DNA, 30 bp, Homo sapiens; identical to SEQ ID NO: 26151

SEQ ID NO: 53309 - DNA, 16 bp, Homo sapiens
gaggtgtagaataagt

SEQ ID NO: 53310 - DNA, 17 bp, Homo sapiens
gaggtgtagaataagtg

SEQ ID NO: 53311 - DNA, 18 bp, Homo sapiens
gaggtgtagaataagtgg

SEQ ID NO: 53312 - DNA, 19 bp, Homo sapiens
gaggtgtagaataagtggg

SEQ ID NO: 53313 - DNA, 20 bp, Homo sapiens
gaggtgtagaataagtggga

SEQ ID NO: 53314 - DNA, 21 bp, Homo sapiens
gaggtgtagaataagtgggag

SEQ ID NO: 53315 - DNA, 22 bp, Homo sapiens
gaggtgtagaataagtgggagg

SEQ ID NO: 53316 - DNA, 23 bp, Homo sapiens
gaggtgtagaataagtgggaggc

SEQ ID NO: 53317 - DNA, 24 bp, Homo sapiens
gaggtgtagaataagtgggaggcc

SEQ ID NO: 53318 - DNA, 25 bp, Homo sapiens
gaggtgtagaataagtgggaggccc

SEQ ID NO: 53319 - DNA, 26 bp, Homo sapiens
gaggtgtagaataagtgggaggcccc

SEQ ID NO: 53320 - DNA, 27 bp, Homo sapiens
gaggtgtagaataagtgggaggccccc

SEQ ID NO: 53321 - DNA, 28 bp, Homo sapiens
gaggtgtagaataagtgggaggcccccg

SEQ ID NO: 53322 - DNA, 29 bp, Homo sapiens
gaggtgtagaataagtgggaggcccccgg

SEQ ID NO: 53323 - DNA, 30 bp, Homo sapiens
gaggtgtagaataagtgggaggcccccggc

SEQ ID NO: 53324 - DNA, 16 bp, Homo sapiens
aggtgtagaataagtg

SEQ ID NO: 53325 - DNA, 17 bp, Homo sapiens
aggtgtagaataagtgg

SEQ ID NO: 53326 - DNA, 18 bp, Homo sapiens
aggtgtagaataagtggg

SEQ ID NO: 53327 - DNA, 19 bp, Homo sapiens
aggtgtagaataagtggga

SEQ ID NO: 53328 - DNA, 20 bp, Homo sapiens
aggtgtagaataagtgggag

SEQ ID NO: 53329 - DNA, 21 bp, Homo sapiens
aggtgtagaataagtgggagg

SEQ ID NO: 53330 - DNA, 22 bp, Homo sapiens
aggtgtagaataagtgggaggc

SEQ ID NO: 53331 - DNA, 23 bp, Homo sapiens
aggtgtagaataagtgggaggcc

SEQ ID NO: 53332 - DNA, 24 bp, Homo sapiens
aggtgtagaataagtgggaggccc

SEQ ID NO: 53333 - DNA, 25 bp, Homo sapiens
aggtgtagaataagtgggaggcccc

SEQ ID NO: 53334 - DNA, 26 bp, Homo sapiens
aggtgtagaataagtgggaggccccc

SEQ ID NO: 53335 - DNA, 27 bp, Homo sapiens
aggtgtagaataagtgggaggcccccg

SEQ ID NO: 53336 - DNA, 28 bp, Homo sapiens
aggtgtagaataagtgggaggcccccgg

SEQ ID NO: 53337 - DNA, 29 bp, Homo sapiens
aggtgtagaataagtgggaggcccccggc

SEQ ID NO: 53338 - DNA, 30 bp, Homo sapiens
aggtgtagaataagtgggaggcccccggcg

SEQ ID NO: 53339 - DNA, 16 bp, Homo sapiens
ggtgtagaataagtgg

SEQ ID NO: 53340 - DNA, 17 bp, Homo sapiens
ggtgtagaataagtggg

SEQ ID NO: 53341 - DNA, 18 bp, Homo sapiens
ggtgtagaataagtggga

SEQ ID NO: 53342 - DNA, 19 bp, Homo sapiens
ggtgtagaataagtgggag

SEQ ID NO: 53343 - DNA, 20 bp, Homo sapiens
ggtgtagaataagtgggagg

SEQ ID NO: 53344 - DNA, 21 bp, Homo sapiens
ggtgtagaataagtgggaggc

SEQ ID NO: 53345 - DNA, 22 bp, Homo sapiens
ggtgtagaataagtgggaggcc

SEQ ID NO: 53346 - DNA, 23 bp, Homo sapiens
ggtgtagaataagtgggaggccc

SEQ ID NO: 53347 - DNA, 24 bp, Homo sapiens
ggtgtagaataagtgggaggcccc

SEQ ID NO: 53348 - DNA, 25 bp, Homo sapiens
ggtgtagaataagtgggaggccccc

SEQ ID NO: 53349 - DNA, 26 bp, Homo sapiens
ggtgtagaataagtgggaggcccccg

SEQ ID NO: 53350 - DNA, 27 bp, Homo sapiens
ggtgtagaataagtgggaggcccccgg

SEQ ID NO: 53351 - DNA, 28 bp, Homo sapiens
ggtgtagaataagtgggaggcccccggc

SEQ ID NO: 53352 - DNA, 16 bp, Homo sapiens
gtgtagaataagtggg

SEQ ID NO: 53353 - DNA, 17 bp, Homo sapiens
gtgtagaataagtggga

SEQ ID NO: 53354 - DNA, 18 bp, Homo sapiens
gtgtagaataagtgggag

SEQ ID NO: 53355 - DNA, 19 bp, Homo sapiens
gtgtagaataagtgggagg

SEQ ID NO: 53356 - DNA, 21 bp, Homo sapiens
gtgtagaataagtgggaggcc

SEQ ID NO: 53357 - DNA, 22 bp, Homo sapiens
gtgtagaataagtgggaggccc

SEQ ID NO: 53358 - DNA, 24 bp, Homo sapiens
gtgtagaataagtgggaggccccc

SEQ ID NO: 53359 - DNA, 27 bp, Homo sapiens
gtgtagaataagtgggaggcccccggc

SEQ ID NO: 53360 - DNA, 18 bp, Homo sapiens
tgtagaataagtgggagg

SEQ ID NO: 53361 - DNA, 20 bp, Homo sapiens
tgtagaataagtgggaggcc

SEQ ID NO: 53362 - DNA, 21 bp, Homo sapiens
tgtagaataagtgggaggccc

SEQ ID NO: 53363 - DNA, 22 bp, Homo sapiens
tgtagaataagtgggaggcccc

SEQ ID NO: 53364 - DNA, 26 bp, Homo sapiens
tgtagaataagtgggaggcccccggc

SEQ ID NO: 53365 - DNA, 19 bp, Homo sapiens
gtagaataagtgggaggcc

SEQ ID NO: 53366 - DNA, 20 bp, Homo sapiens
gtagaataagtgggaggccc

SEQ ID NO: 53367 - DNA, 21 bp, Homo sapiens
gtagaataagtgggaggcccc

SEQ ID NO: 53368 - DNA, 22 bp, Homo sapiens
gtagaataagtgggaggccccc

SEQ ID NO: 53369 - DNA, 25 bp, Homo sapiens
gtagaataagtgggaggcccccggc

SEQ ID NO: 53370 - DNA, 19 bp, Homo sapiens
tagaataagtgggaggccc

SEQ ID NO: 53371 - DNA, 24 bp, Homo sapiens
tagaataagtgggaggcccccggc

SEQ ID NO: 53372 - DNA, 22 bp, Homo sapiens
gaataagtgggaggcccccggc

SEQ ID NO: 53373 - DNA, 18 bp, Homo sapiens
aataagtgggaggccccc

SEQ ID NO: 53374 - DNA, 20 bp, Homo sapiens
aataagtgggaggcccccgg

SEQ ID NO: 53375 - DNA, 21 bp, Homo sapiens
aataagtgggaggcccccggc

SEQ ID NO: 53376 - DNA, 18 bp, Homo sapiens
taagtgggaggcccccgg

SEQ ID NO: 53377 - DNA, 20 bp, Homo sapiens
taagtgggaggcccccggcg

SEQ ID NO: 53378 - DNA, 22 bp, Homo sapiens
taagtgggaggcccccggcgcc

SEQ ID NO: 53379 - DNA, 17 bp, Homo sapiens
agtgggaggcccccggc

SEQ ID NO: 53380 - DNA, 22 bp, Homo sapiens
gaggcccccggcgcccccccgg

SEQ ID NO: 53381 - DNA, 17 bp, Homo sapiens
gcccccggcgccccccc

SEQ ID NO: 53382 - DNA, 18 bp, Homo sapiens
gcccccggcgcccccccg

SEQ ID NO: 53383 - DNA, 16 bp, Homo sapiens
cccccggcgccccccc

SEQ ID NO: 53384 - DNA, 22 bp, Homo sapiens
cccggcgcccccccggtgtccc

SEQ ID NO: 53385 - DNA, 21 bp, Homo sapiens
ccggcgcccccccggtgtccc

SEQ ID NO: 53386 - DNA, 18 bp, Homo sapiens
cggcgcccccccggtgtc

SEQ ID NO: 53387 - DNA, 19 bp, Homo sapiens
cggcgcccccccggtgtcc

SEQ ID NO: 53388 - DNA, 17 bp, Homo sapiens
ggcgcccccccggtgtc

SEQ ID NO: 53389 - DNA, 18 bp, Homo sapiens
ggcgcccccccggtgtcc

SEQ ID NO: 53390 - DNA, 22 bp, Homo sapiens
ggcgcccccccggtgtccccgc

SEQ ID NO: 53391 - DNA, 16 bp, Homo sapiens
gcgcccccccggtgtc

SEQ ID NO: 53392 - DNA, 17 bp, Homo sapiens
gcgcccccccggtgtcc

SEQ ID NO: 53393 - DNA, 18 bp, Homo sapiens
gcgcccccccggtgtccc

SEQ ID NO: 53394 - DNA, 19 bp, Homo sapiens
gcgcccccccggtgtcccc

SEQ ID NO: 53395 - DNA, 21 bp, Homo sapiens
gcgcccccccggtgtccccgc

SEQ ID NO: 53396 - DNA, 22 bp, Homo sapiens
gcgcccccccggtgtccccgcg

SEQ ID NO: 53397 - DNA, 23 bp, Homo sapiens
gcgcccccccggtgtccccgcga

SEQ ID NO: 53398 - DNA, 17 bp, Homo sapiens
gcccccccggtgtcccc

SEQ ID NO: 53399 - DNA, 19 bp, Homo sapiens
gcccccccggtgtccccgc

SEQ ID NO: 53400 - DNA, 21 bp, Homo sapiens
cggtgtccccgcgaggggccc

SEQ ID NO: 53401 - DNA, 17 bp, Homo sapiens
ccccgcgaggggcccgg

SEQ ID NO: 53402 - DNA, 16 bp, Homo sapiens
cccgcgaggggcccgg

SEQ ID NO: 53403 - DNA, 20 bp, Homo sapiens
cccgcgaggggcccggggcg

SEQ ID NO: 53404 - DNA, 21 bp, Homo sapiens
cccgcgaggggcccggggcgg

SEQ ID NO: 53405 - DNA, 16 bp, Homo sapiens
ccgcgaggggcccggg

SEQ ID NO: 53406 - DNA, 17 bp, Homo sapiens
ccgcgaggggcccgggg

SEQ ID NO: 53407 - DNA, 18 bp, Homo sapiens
ccgcgaggggcccggggc

SEQ ID NO: 53408 - DNA, 19 bp, Homo sapiens
ccgcgaggggcccggggcg

SEQ ID NO: 53409 - DNA, 20 bp, Homo sapiens
ccgcgaggggcccggggcgg

SEQ ID NO: 53410 - DNA, 21 bp, Homo sapiens
ccgcgaggggcccggggcggg

SEQ ID NO: 53411 - DNA, 22 bp, Homo sapiens
ccgcgaggggcccggggcgggg

SEQ ID NO: 53412 - DNA, 23 bp, Homo sapiens
ccgcgaggggcccggggcggggt

SEQ ID NO: 53413 - DNA, 26 bp, Homo sapiens
ccgcgaggggcccggggcggggtccg

SEQ ID NO: 53414 - DNA, 16 bp, Homo sapiens
cgcgaggggcccgggg

SEQ ID NO: 53415 - DNA, 17 bp, Homo sapiens
cgcgaggggcccggggc

SEQ ID NO: 53416 - DNA, 18 bp, Homo sapiens
cgcgaggggcccggggcg

SEQ ID NO: 53417 - DNA, 19 bp, Homo sapiens
cgcgaggggcccggggcgg

SEQ ID NO: 53418 - DNA, 20 bp, Homo sapiens
cgcgaggggcccggggcggg

SEQ ID NO: 53419 - DNA, 21 bp, Homo sapiens
cgcgaggggcccggggcgggg

SEQ ID NO: 53420 - DNA, 22 bp, Homo sapiens
cgcgaggggcccggggcggggt

SEQ ID NO: 53421 - DNA, 23 bp, Homo sapiens
cgcgaggggcccggggcggggtc

SEQ ID NO: 53422 - DNA, 24 bp, Homo sapiens
cgcgaggggcccggggcggggtcc

SEQ ID NO: 53423 - DNA, 25 bp, Homo sapiens
cgcgaggggcccggggcggggtccg

SEQ ID NO: 53424 - DNA, 26 bp, Homo sapiens
cgcgaggggcccggggcggggtccgc

SEQ ID NO: 53425 - DNA, 30 bp, Homo sapiens; identical to SEQ ID NO: 26176

SEQ ID NO: 53426 - DNA, 16 bp, Homo sapiens
gcgaggggcccggggc

SEQ ID NO: 53427 - DNA, 17 bp, Homo sapiens
gcgaggggcccggggcg

SEQ ID NO: 53428 - DNA, 18 bp, Homo sapiens
gcgaggggcccggggcgg

SEQ ID NO: 53429 - DNA, 19 bp, Homo sapiens
gcgaggggcccggggcggg

SEQ ID NO: 53430 - DNA, 20 bp, Homo sapiens
gcgaggggcccggggcgggg

SEQ ID NO: 53431 - DNA, 21 bp, Homo sapiens
gcgaggggcccggggcggggt

SEQ ID NO: 53432 - DNA, 22 bp, Homo sapiens
gcgaggggcccggggcggggtc

SEQ ID NO: 53433 - DNA, 23 bp, Homo sapiens
gcgaggggcccggggcggggtcc

SEQ ID NO: 53434 - DNA, 24 bp, Homo sapiens
gcgaggggcccggggcggggtccg

SEQ ID NO: 53435 - DNA, 26 bp, Homo sapiens
gcgaggggcccggggcggggtccgcc

SEQ ID NO: 53436 - DNA, 30 bp, Homo sapiens
gcgaggggcccggggcggggtccgccggcc

SEQ ID NO: 53437 - DNA, 17 bp, Homo sapiens
cgaggggcccggggcgg

SEQ ID NO: 53438 - DNA, 21 bp, Homo sapiens
cgaggggcccggggcggggtc

SEQ ID NO: 53439 - DNA, 17 bp, Homo sapiens
gaggggcccggggcggg

SEQ ID NO: 53440 - DNA, 18 bp, Homo sapiens
gaggggcccggggcgggg

SEQ ID NO: 53441 - DNA, 19 bp, Homo sapiens
gaggggcccggggcggggt

SEQ ID NO: 53442 - DNA, 16 bp, Homo sapiens
aggggcccggggcggg

SEQ ID NO: 53443 - DNA, 25 bp, Homo sapiens
aggggcccggggcggggtccgccgg

SEQ ID NO: 53444 - DNA, 27 bp, Homo sapiens
aggggcccggggcggggtccgccggcc

SEQ ID NO: 53445 - DNA, 26 bp, Homo sapiens
ggggcccggggcggggtccgccggcc

SEQ ID NO: 53446 - DNA, 25 bp, Homo sapiens
gggcccggggcggggtccgccggcc

SEQ ID NO: 53447 - DNA, 19 bp, Homo sapiens
cggggcggggtccgccggc

SEQ ID NO: 53448 - DNA, 19 bp, Homo sapiens
ggggcggggtccgccggcc

SEQ ID NO: 53449 - DNA, 18 bp, Homo sapiens
gggcggggtccgccggcc

SEQ ID NO: 53450 - DNA, 21 bp, Homo sapiens
cggggtccgccggccctgcgg

SEQ ID NO: 53451 - DNA, 16 bp, Homo sapiens
ggggtccgccggccct

SEQ ID NO: 53452 - DNA, 17 bp, Homo sapiens
gggtccgccggccctgc

SEQ ID NO: 53453 - DNA, 18 bp, Homo sapiens
gggtccgccggccctgcg

SEQ ID NO: 53454 - DNA, 19 bp, Homo sapiens
gggtccgccggccctgcgg

SEQ ID NO: 53455 - DNA, 16 bp, Homo sapiens
ggtccgccggccctgc

SEQ ID NO: 53456 - DNA, 17 bp, Homo sapiens
ggtccgccggccctgcg

SEQ ID NO: 53457 - DNA, 18 bp, Homo sapiens
ggtccgccggccctgcgg

SEQ ID NO: 53458 - DNA, 17 bp, Homo sapiens
gtccgccggccctgcgg

SEQ ID NO: 53459 - DNA, 18 bp, Homo sapiens
ggccctgcgggccgccgg

SEQ ID NO: 53460 - DNA, 17 bp, Homo sapiens
gccctgcgggccgccgg

SEQ ID NO: 53461 - DNA, 16 bp, Homo sapiens
ccctgcgggccgccgg

SEQ ID NO: 53462 - DNA, 30 bp, Homo sapiens
ctgcgggccgccggtgaaataccactactc

SEQ ID NO: 53463 - DNA, 20 bp, Homo sapiens
tgcgggccgccggtgaaata

SEQ ID NO: 53464 - DNA, 30 bp, Homo sapiens; identical to SEQ ID NO: 26200

SEQ ID NO: 53465 - DNA, 18 bp, Homo sapiens
gcgggccgccggtgaaat

SEQ ID NO: 53466 - DNA, 19 bp, Homo sapiens
gcgggccgccggtgaaata

SEQ ID NO: 53467 - DNA, 24 bp, Homo sapiens
gcgggccgccggtgaaataccact

SEQ ID NO: 53468 - DNA, 26 bp, Homo sapiens
gcgggccgccggtgaaataccactac

SEQ ID NO: 53469 - DNA, 27 bp, Homo sapiens
gcgggccgccggtgaaataccactact

SEQ ID NO: 53470 - DNA, 30 bp, Homo sapiens; identical to SEQ ID NO: 5841

SEQ ID NO: 53471 - DNA, 23 bp, Homo sapiens
cgggccgccggtgaaataccact

SEQ ID NO: 53472 - DNA, 25 bp, Homo sapiens
cgggccgccggtgaaataccactac

SEQ ID NO: 53473 - DNA, 26 bp, Homo sapiens
cgggccgccggtgaaataccactact

SEQ ID NO: 53474 - DNA, 29 bp, Homo sapiens
cgggccgccggtgaaataccactactctg

SEQ ID NO: 53475 - DNA, 24 bp, Homo sapiens
gggccgccggtgaaataccactac

SEQ ID NO: 53476 - DNA, 25 bp, Homo sapiens
gggccgccggtgaaataccactact

SEQ ID NO: 53477 - DNA, 28 bp, Homo sapiens
gggccgccggtgaaataccactactctg

SEQ ID NO: 53478 - DNA, 29 bp, Homo sapiens
gggccgccggtgaaataccactactctga

SEQ ID NO: 53479 - DNA, 16 bp, Homo sapiens
ggccgccggtgaaata

SEQ ID NO: 53480 - DNA, 18 bp, Homo sapiens
ggccgccggtgaaatacc

SEQ ID NO: 53481 - DNA, 20 bp, Homo sapiens
ggccgccggtgaaataccac

SEQ ID NO: 53482 - DNA, 21 bp, Homo sapiens
ggccgccggtgaaataccact

SEQ ID NO: 53483 - DNA, 22 bp, Homo sapiens
ggccgccggtgaaataccacta

SEQ ID NO: 53484 - DNA, 23 bp, Homo sapiens
ggccgccggtgaaataccactac

SEQ ID NO: 53485 - DNA, 24 bp, Homo sapiens
ggccgccggtgaaataccactact

SEQ ID NO: 53486 - DNA, 25 bp, Homo sapiens
ggccgccggtgaaataccactactc

SEQ ID NO: 53487 - DNA, 26 bp, Homo sapiens
ggccgccggtgaaataccactactct

SEQ ID NO: 53488 - DNA, 27 bp, Homo sapiens
ggccgccggtgaaataccactactctg

SEQ ID NO: 53489 - DNA, 28 bp, Homo sapiens
ggccgccggtgaaataccactactctga

SEQ ID NO: 53490 - DNA, 29 bp, Homo sapiens
ggccgccggtgaaataccactactctgat

SEQ ID NO: 53491 - DNA, 17 bp, Homo sapiens
gccgccggtgaaatacc

SEQ ID NO: 53492 - DNA, 20 bp, Homo sapiens
gccgccggtgaaataccact

SEQ ID NO: 53493 - DNA, 21 bp, Homo sapiens
gccgccggtgaaataccacta

SEQ ID NO: 53494 - DNA, 22 bp, Homo sapiens
gccgccggtgaaataccactac

SEQ ID NO: 53495 - DNA, 23 bp, Homo sapiens
gccgccggtgaaataccactact

SEQ ID NO: 53496 - DNA, 24 bp, Homo sapiens
gccgccggtgaaataccactactc

SEQ ID NO: 53497 - DNA, 25 bp, Homo sapiens
gccgccggtgaaataccactactct

SEQ ID NO: 53498 - DNA, 26 bp, Homo sapiens
gccgccggtgaaataccactactctg

SEQ ID NO: 53499 - DNA, 27 bp, Homo sapiens
gccgccggtgaaataccactactctga

SEQ ID NO: 53500 - DNA, 28 bp, Homo sapiens
gccgccggtgaaataccactactctgat

SEQ ID NO: 53501 - DNA, 29 bp, Homo sapiens
gccgccggtgaaataccactactctgatc

SEQ ID NO: 53502 - DNA, 30 bp, Homo sapiens; identical to SEQ ID NO: 5864

SEQ ID NO: 53503 - DNA, 20 bp, Homo sapiens
ccgccggtgaaataccacta

SEQ ID NO: 53504 - DNA, 21 bp, Homo sapiens
ccgccggtgaaataccactac

SEQ ID NO: 53505 - DNA, 22 bp, Homo sapiens
ccgccggtgaaataccactact

SEQ ID NO: 53506 - DNA, 23 bp, Homo sapiens
ccgccggtgaaataccactactc

SEQ ID NO: 53507 - DNA, 24 bp, Homo sapiens
ccgccggtgaaataccactactct

SEQ ID NO: 53508 - DNA, 25 bp, Homo sapiens
ccgccggtgaaataccactactctg

SEQ ID NO: 53509 - DNA, 26 bp, Homo sapiens
ccgccggtgaaataccactactctga

SEQ ID NO: 53510 - DNA, 27 bp, Homo sapiens
ccgccggtgaaataccactactctgat

SEQ ID NO: 53511 - DNA, 28 bp, Homo sapiens
ccgccggtgaaataccactactctgatc

SEQ ID NO: 53512 - DNA, 29 bp, Homo sapiens
ccgccggtgaaataccactactctgatcg

SEQ ID NO: 53513 - DNA, 30 bp, Homo sapiens
ccgccggtgaaataccactactctgatcgt

SEQ ID NO: 53514 - DNA, 20 bp, Homo sapiens
cgccggtgaaataccactac

SEQ ID NO: 53515 - DNA, 21 bp, Homo sapiens
cgccggtgaaataccactact

SEQ ID NO: 53516 - DNA, 24 bp, Homo sapiens
cgccggtgaaataccactactctg

SEQ ID NO: 53517 - DNA, 25 bp, Homo sapiens
cgccggtgaaataccactactctga

SEQ ID NO: 53518 - DNA, 27 bp, Homo sapiens
cgccggtgaaataccactactctgatc

SEQ ID NO: 53519 - DNA, 19 bp, Homo sapiens
gccggtgaaataccactac

SEQ ID NO: 53520 - DNA, 20 bp, Homo sapiens
gccggtgaaataccactact

SEQ ID NO: 53521 - DNA, 23 bp, Homo sapiens
gccggtgaaataccactactctg

SEQ ID NO: 53522 - DNA, 24 bp, Homo sapiens
gccggtgaaataccactactctga

SEQ ID NO: 53523 - DNA, 23 bp, Homo sapiens
ccggtgaaataccactactctga

SEQ ID NO: 53524 - DNA, 22 bp, Homo sapiens
cggtgaaataccactactctga

SEQ ID NO: 53525 - DNA, 22 bp, Homo sapiens
gtgaaataccactactctgatc

SEQ ID NO: 53526 - DNA, 18 bp, Homo sapiens
tgaaataccactactctg

SEQ ID NO: 53527 - DNA, 19 bp, Homo sapiens
tgaaataccactactctga

SEQ ID NO: 53528 - DNA, 20 bp, Homo sapiens
tgaaataccactactctgat

SEQ ID NO: 53529 - DNA, 21 bp, Homo sapiens
tgaaataccactactctgatc

SEQ ID NO: 53530 - DNA, 22 bp, Homo sapiens
tgaaataccactactctgatcg

SEQ ID NO: 53531 - DNA, 23 bp, Homo sapiens
tgaaataccactactctgatcgt

SEQ ID NO: 53532 - DNA, 24 bp, Homo sapiens
tgaaataccactactctgatcgtt

SEQ ID NO: 53533 - DNA, 29 bp, Homo sapiens
tgaaataccactactctgatcgttttttc

SEQ ID NO: 53534 - DNA, 17 bp, Homo sapiens
gaaataccactactctg

SEQ ID NO: 53535 - DNA, 18 bp, Homo sapiens
gaaataccactactctga

SEQ ID NO: 53536 - DNA, 19 bp, Homo sapiens
gaaataccactactctgat

SEQ ID NO: 53537 - DNA, 20 bp, Homo sapiens
gaaataccactactctgatc

SEQ ID NO: 53538 - DNA, 21 bp, Homo sapiens
gaaataccactactctgatcg

SEQ ID NO: 53539 - DNA, 22 bp, Homo sapiens
gaaataccactactctgatcgt

SEQ ID NO: 53540 - DNA, 23 bp, Homo sapiens
gaaataccactactctgatcgtt

SEQ ID NO: 53541 - DNA, 24 bp, Homo sapiens
gaaataccactactctgatcgttt

SEQ ID NO: 53542 - DNA, 25 bp, Homo sapiens
gaaataccactactctgatcgtttt

SEQ ID NO: 53543 - DNA, 16 bp, Homo sapiens
aaataccactactctg

SEQ ID NO: 53544 - DNA, 17 bp, Homo sapiens
aaataccactactctga

SEQ ID NO: 53545 - DNA, 18 bp, Homo sapiens
aaataccactactctgat

SEQ ID NO: 53546 - DNA, 19 bp, Homo sapiens
aaataccactactctgatc

SEQ ID NO: 53547 - DNA, 20 bp, Homo sapiens
aaataccactactctgatcg

SEQ ID NO: 53548 - DNA, 21 bp, Homo sapiens
aaataccactactctgatcgt

SEQ ID NO: 53549 - DNA, 22 bp, Homo sapiens
aaataccactactctgatcgtt

SEQ ID NO: 53550 - DNA, 23 bp, Homo sapiens
aaataccactactctgatcgttt

SEQ ID NO: 53551 - DNA, 26 bp, Homo sapiens
aaataccactactctgatcgtttttt

SEQ ID NO: 53552 - DNA, 30 bp, Homo sapiens
aaataccactactctgatcgttttttcact

SEQ ID NO: 53553 - DNA, 16 bp, Homo sapiens
aataccactactctga

SEQ ID NO: 53554 - DNA, 17 bp, Homo sapiens
aataccactactctgat

SEQ ID NO: 53555 - DNA, 18 bp, Homo sapiens
aataccactactctgatc

SEQ ID NO: 53556 - DNA, 19 bp, Homo sapiens
aataccactactctgatcg

SEQ ID NO: 53557 - DNA, 20 bp, Homo sapiens
aataccactactctgatcgt

SEQ ID NO: 53558 - DNA, 21 bp, Homo sapiens
aataccactactctgatcgtt

SEQ ID NO: 53559 - DNA, 22 bp, Homo sapiens
aataccactactctgatcgttt

SEQ ID NO: 53560 - DNA, 23 bp, Homo sapiens
aataccactactctgatcgtttt

SEQ ID NO: 53561 - DNA, 24 bp, Homo sapiens
aataccactactctgatcgttttt

SEQ ID NO: 53562 - DNA, 25 bp, Homo sapiens
aataccactactctgatcgtttttt

SEQ ID NO: 53563 - DNA, 26 bp, Homo sapiens
aataccactactctgatcgttttttc

SEQ ID NO: 53564 - DNA, 27 bp, Homo sapiens
aataccactactctgatcgttttttca

SEQ ID NO: 53565 - DNA, 16 bp, Homo sapiens
ataccactactctgat

SEQ ID NO: 53566 - DNA, 17 bp, Homo sapiens
ataccactactctgatc

SEQ ID NO: 53567 - DNA, 18 bp, Homo sapiens
ataccactactctgatcg

SEQ ID NO: 53568 - DNA, 19 bp, Homo sapiens
ataccactactctgatcgt

SEQ ID NO: 53569 - DNA, 20 bp, Homo sapiens
ataccactactctgatcgtt

SEQ ID NO: 53570 - DNA, 21 bp, Homo sapiens
ataccactactctgatcgttt

SEQ ID NO: 53571 - DNA, 22 bp, Homo sapiens
ataccactactctgatcgtttt

SEQ ID NO: 53572 - DNA, 23 bp, Homo sapiens
ataccactactctgatcgttttt

SEQ ID NO: 53573 - DNA, 24 bp, Homo sapiens
ataccactactctgatcgtttttt

SEQ ID NO: 53574 - DNA, 25 bp, Homo sapiens
ataccactactctgatcgttttttc

SEQ ID NO: 53575 - DNA, 26 bp, Homo sapiens
ataccactactctgatcgttttttca

SEQ ID NO: 53576 - DNA, 28 bp, Homo sapiens
ataccactactctgatcgttttttcact

SEQ ID NO: 53577 - DNA, 29 bp, Homo sapiens
ataccactactctgatcgttttttcactg

SEQ ID NO: 53578 - DNA, 16 bp, Homo sapiens
taccactactctgatc

SEQ ID NO: 53579 - DNA, 17 bp, Homo sapiens
taccactactctgatcg

SEQ ID NO: 53580 - DNA, 18 bp, Homo sapiens
taccactactctgatcgt

SEQ ID NO: 53581 - DNA, 19 bp, Homo sapiens
taccactactctgatcgtt

SEQ ID NO: 53582 - DNA, 20 bp, Homo sapiens
taccactactctgatcgttt

SEQ ID NO: 53583 - DNA, 21 bp, Homo sapiens
taccactactctgatcgtttt

SEQ ID NO: 53584 - DNA, 22 bp, Homo sapiens
taccactactctgatcgttttt

SEQ ID NO: 53585 - DNA, 23 bp, Homo sapiens
taccactactctgatcgtttttt

SEQ ID NO: 53586 - DNA, 24 bp, Homo sapiens
taccactactctgatcgttttttc

SEQ ID NO: 53587 - DNA, 25 bp, Homo sapiens
taccactactctgatcgttttttca

SEQ ID NO: 53588 - DNA, 27 bp, Homo sapiens
taccactactctgatcgttttttcact

SEQ ID NO: 53589 - DNA, 16 bp, Homo sapiens
accactactctgatcg

SEQ ID NO: 53590 - DNA, 17 bp, Homo sapiens
accactactctgatcgt

SEQ ID NO: 53591 - DNA, 18 bp, Homo sapiens
accactactctgatcgtt

SEQ ID NO: 53592 - DNA, 19 bp, Homo sapiens
accactactctgatcgttt

SEQ ID NO: 53593 - DNA, 20 bp, Homo sapiens
accactactctgatcgtttt

SEQ ID NO: 53594 - DNA, 21 bp, Homo sapiens
accactactctgatcgttttt

SEQ ID NO: 53595 - DNA, 22 bp, Homo sapiens
accactactctgatcgtttttt

SEQ ID NO: 53596 - DNA, 23 bp, Homo sapiens
accactactctgatcgttttttc

SEQ ID NO: 53597 - DNA, 24 bp, Homo sapiens
accactactctgatcgttttttca

SEQ ID NO: 53598 - DNA, 26 bp, Homo sapiens
accactactctgatcgttttttcact

SEQ ID NO: 53599 - DNA, 27 bp, Homo sapiens
accactactctgatcgttttttcactg

SEQ ID NO: 53600 - DNA, 30 bp, Homo sapiens
accactactctgatcgttttttcactgacc

SEQ ID NO: 53601 - DNA, 16 bp, Homo sapiens
ccactactctgatcgt

SEQ ID NO: 53602 - DNA, 17 bp, Homo sapiens
ccactactctgatcgtt

SEQ ID NO: 53603 - DNA, 18 bp, Homo sapiens
ccactactctgatcgttt

SEQ ID NO: 53604 - DNA, 19 bp, Homo sapiens
ccactactctgatcgtttt

SEQ ID NO: 53605 - DNA, 20 bp, Homo sapiens
ccactactctgatcgttttt

SEQ ID NO: 53606 - DNA, 21 bp, Homo sapiens
ccactactctgatcgtttttt

SEQ ID NO: 53607 - DNA, 22 bp, Homo sapiens
ccactactctgatcgttttttc

SEQ ID NO: 53608 - DNA, 23 bp, Homo sapiens
ccactactctgatcgttttttca

SEQ ID NO: 53609 - DNA, 24 bp, Homo sapiens
ccactactctgatcgttttttcac

SEQ ID NO: 53610 - DNA, 25 bp, Homo sapiens
ccactactctgatcgttttttcact

SEQ ID NO: 53611 - DNA, 26 bp, Homo sapiens
ccactactctgatcgttttttcactg

SEQ ID NO: 53612 - DNA, 27 bp, Homo sapiens
ccactactctgatcgttttttcactga

SEQ ID NO: 53613 - DNA, 28 bp, Homo sapiens
ccactactctgatcgttttttcactgac

SEQ ID NO: 53614 - DNA, 29 bp, Homo sapiens
ccactactctgatcgttttttcactgacc

SEQ ID NO: 53615 - DNA, 30 bp, Homo sapiens
ccactactctgatcgttttttcactgaccc

SEQ ID NO: 53616 - DNA, 16 bp, Homo sapiens
cactactctgatcgtt

SEQ ID NO: 53617 - DNA, 17 bp, Homo sapiens
cactactctgatcgttt

SEQ ID NO: 53618 - DNA, 18 bp, Homo sapiens
cactactctgatcgtttt

SEQ ID NO: 53619 - DNA, 19 bp, Homo sapiens
cactactctgatcgttttt

SEQ ID NO: 53620 - DNA, 20 bp, Homo sapiens
cactactctgatcgtttttt

SEQ ID NO: 53621 - DNA, 21 bp, Homo sapiens
cactactctgatcgttttttc

SEQ ID NO: 53622 - DNA, 22 bp, Homo sapiens
cactactctgatcgttttttca

SEQ ID NO: 53623 - DNA, 23 bp, Homo sapiens
cactactctgatcgttttttcac

SEQ ID NO: 53624 - DNA, 24 bp, Homo sapiens
cactactctgatcgttttttcact

SEQ ID NO: 53625 - DNA, 26 bp, Homo sapiens
cactactctgatcgttttttcactga

SEQ ID NO: 53626 - DNA, 19 bp, Homo sapiens
actactctgatcgtttttt

SEQ ID NO: 53627 - DNA, 20 bp, Homo sapiens
actactctgatcgttttttc

SEQ ID NO: 53628 - DNA, 21 bp, Homo sapiens
actactctgatcgttttttca

SEQ ID NO: 53629 - DNA, 22 bp, Homo sapiens
actactctgatcgttttttcac

SEQ ID NO: 53630 - DNA, 23 bp, Homo sapiens
actactctgatcgttttttcact

SEQ ID NO: 53631 - DNA, 18 bp, Homo sapiens
ctactctgatcgtttttt

SEQ ID NO: 53632 - DNA, 20 bp, Homo sapiens
ctactctgatcgttttttca

SEQ ID NO: 53633 - DNA, 22 bp, Homo sapiens
ctactctgatcgttttttcact

SEQ ID NO: 53634 - DNA, 23 bp, Homo sapiens
ctactctgatcgttttttcactg

SEQ ID NO: 53635 - DNA, 24 bp, Homo sapiens
ctactctgatcgttttttcactga

SEQ ID NO: 53636 - DNA, 26 bp, Homo sapiens
ctactctgatcgttttttcactgacc

SEQ ID NO: 53637 - DNA, 30 bp, Homo sapiens; identical to SEQ ID NO: 26302

SEQ ID NO: 53638 - DNA, 16 bp, Homo sapiens
actctgatcgtttttt

SEQ ID NO: 53639 - DNA, 17 bp, Homo sapiens
actctgatcgttttttc

SEQ ID NO: 53640 - DNA, 18 bp, Homo sapiens
actctgatcgttttttca

SEQ ID NO: 53641 - DNA, 19 bp, Homo sapiens
actctgatcgttttttcac

SEQ ID NO: 53642 - DNA, 20 bp, Homo sapiens
actctgatcgttttttcact

SEQ ID NO: 53643 - DNA, 21 bp, Homo sapiens
actctgatcgttttttcactg

SEQ ID NO: 53644 - DNA, 22 bp, Homo sapiens
actctgatcgttttttcactga

SEQ ID NO: 53645 - DNA, 23 bp, Homo sapiens
actctgatcgttttttcactgac

SEQ ID NO: 53646 - DNA, 25 bp, Homo sapiens
actctgatcgttttttcactgaccc

SEQ ID NO: 53647 - DNA, 27 bp, Homo sapiens
actctgatcgttttttcactgacccgg

SEQ ID NO: 53648 - DNA, 28 bp, Homo sapiens
actctgatcgttttttcactgacccggt

SEQ ID NO: 53649 - DNA, 29 bp, Homo sapiens
actctgatcgttttttcactgacccggtg

SEQ ID NO: 53650 - DNA, 17 bp, Homo sapiens
ctctgatcgttttttca

SEQ ID NO: 53651 - DNA, 18 bp, Homo sapiens
ctctgatcgttttttcac

SEQ ID NO: 53652 - DNA, 19 bp, Homo sapiens
ctctgatcgttttttcact

SEQ ID NO: 53653 - DNA, 20 bp, Homo sapiens
ctctgatcgttttttcactg

SEQ ID NO: 53654 - DNA, 21 bp, Homo sapiens
ctctgatcgttttttcactga

SEQ ID NO: 53655 - DNA, 22 bp, Homo sapiens
ctctgatcgttttttcactgac

SEQ ID NO: 53656 - DNA, 23 bp, Homo sapiens
ctctgatcgttttttcactgacc

SEQ ID NO: 53657 - DNA, 24 bp, Homo sapiens
ctctgatcgttttttcactgaccc

SEQ ID NO: 53658 - DNA, 25 bp, Homo sapiens
ctctgatcgttttttcactgacccg

SEQ ID NO: 53659 - DNA, 26 bp, Homo sapiens
ctctgatcgttttttcactgacccgg

SEQ ID NO: 53660 - DNA, 27 bp, Homo sapiens
ctctgatcgttttttcactgacccggt

SEQ ID NO: 53661 - DNA, 28 bp, Homo sapiens
ctctgatcgttttttcactgacccggtg

SEQ ID NO: 53662 - DNA, 29 bp, Homo sapiens
ctctgatcgttttttcactgacccggtga

SEQ ID NO: 53663 - DNA, 30 bp, Homo sapiens
ctctgatcgttttttcactgacccggtgag

SEQ ID NO: 53664 - DNA, 20 bp, Homo sapiens
tctgatcgttttttcactga

SEQ ID NO: 53665 - DNA, 21 bp, Homo sapiens
tctgatcgttttttcactgac

SEQ ID NO: 53666 - DNA, 22 bp, Homo sapiens
tctgatcgttttttcactgacc

SEQ ID NO: 53667 - DNA, 23 bp, Homo sapiens
tctgatcgttttttcactgaccc

SEQ ID NO: 53668 - DNA, 26 bp, Homo sapiens
tctgatcgttttttcactgacccggt

SEQ ID NO: 53669 - DNA, 18 bp, Homo sapiens
ctgatcgttttttcactg

SEQ ID NO: 53670 - DNA, 19 bp, Homo sapiens
ctgatcgttttttcactga

SEQ ID NO: 53671 - DNA, 20 bp, Homo sapiens
ctgatcgttttttcactgac

SEQ ID NO: 53672 - DNA, 21 bp, Homo sapiens
ctgatcgttttttcactgacc

SEQ ID NO: 53673 - DNA, 22 bp, Homo sapiens
ctgatcgttttttcactgaccc

SEQ ID NO: 53674 - DNA, 23 bp, Homo sapiens
ctgatcgttttttcactgacccg

SEQ ID NO: 53675 - DNA, 24 bp, Homo sapiens
ctgatcgttttttcactgacccgg

SEQ ID NO: 53676 - DNA, 25 bp, Homo sapiens
ctgatcgttttttcactgacccggt

SEQ ID NO: 53677 - DNA, 26 bp, Homo sapiens
ctgatcgttttttcactgacccggtg

SEQ ID NO: 53678 - DNA, 20 bp, Homo sapiens
tgatcgttttttcactgacc

SEQ ID NO: 53679 - DNA, 21 bp, Homo sapiens
tgatcgttttttcactgaccc

SEQ ID NO: 53680 - DNA, 22 bp, Homo sapiens
tgatcgttttttcactgacccg

SEQ ID NO: 53681 - DNA, 23 bp, Homo sapiens
tgatcgttttttcactgacccgg

SEQ ID NO: 53682 - DNA, 24 bp, Homo sapiens
tgatcgttttttcactgacccggt

SEQ ID NO: 53683 - DNA, 19 bp, Homo sapiens
gatcgttttttcactgacc

SEQ ID NO: 53684 - DNA, 20 bp, Homo sapiens
gatcgttttttcactgaccc

SEQ ID NO: 53685 - DNA, 21 bp, Homo sapiens
gatcgttttttcactgacccg

SEQ ID NO: 53686 - DNA, 22 bp, Homo sapiens
gatcgttttttcactgacccgg

SEQ ID NO: 53687 - DNA, 23 bp, Homo sapiens
gatcgttttttcactgacccggt

SEQ ID NO: 53688 - DNA, 20 bp, Homo sapiens
atcgttttttcactgacccg

SEQ ID NO: 53689 - DNA, 21 bp, Homo sapiens
atcgttttttcactgacccgg

SEQ ID NO: 53690 - DNA, 22 bp, Homo sapiens
atcgttttttcactgacccggt

SEQ ID NO: 53691 - DNA, 19 bp, Homo sapiens
tcgttttttcactgacccg

SEQ ID NO: 53692 - DNA, 20 bp, Homo sapiens
tcgttttttcactgacccgg

SEQ ID NO: 53693 - DNA, 21 bp, Homo sapiens
tcgttttttcactgacccggt

SEQ ID NO: 53694 - DNA, 22 bp, Homo sapiens
tcgttttttcactgacccggtg

SEQ ID NO: 53695 - DNA, 23 bp, Homo sapiens
tcgttttttcactgacccggtga

SEQ ID NO: 53696 - DNA, 18 bp, Homo sapiens
cgttttttcactgacccg

SEQ ID NO: 53697 - DNA, 19 bp, Homo sapiens
cgttttttcactgacccgg

SEQ ID NO: 53698 - DNA, 20 bp, Homo sapiens
cgttttttcactgacccggt

SEQ ID NO: 53699 - DNA, 21 bp, Homo sapiens
cgttttttcactgacccggtg

SEQ ID NO: 53700 - DNA, 22 bp, Homo sapiens
cgttttttcactgacccggtga

SEQ ID NO: 53701 - DNA, 23 bp, Homo sapiens
cgttttttcactgacccggtgag

SEQ ID NO: 53702 - DNA, 24 bp, Homo sapiens
cgttttttcactgacccggtgagg

SEQ ID NO: 53703 - DNA, 27 bp, Homo sapiens
cgttttttcactgacccggtgaggcgg

SEQ ID NO: 53704 - DNA, 28 bp, Homo sapiens
cgttttttcactgacccggtgaggcggg

SEQ ID NO: 53705 - DNA, 29 bp, Homo sapiens
cgttttttcactgacccggtgaggcgggg

SEQ ID NO: 53706 - DNA, 30 bp, Homo sapiens
cgttttttcactgacccggtgaggcggggg

SEQ ID NO: 53707 - DNA, 17 bp, Homo sapiens
gttttttcactgacccg

SEQ ID NO: 53708 - DNA, 18 bp, Homo sapiens
gttttttcactgacccgg

SEQ ID NO: 53709 - DNA, 16 bp, Homo sapiens
ttttttcactgacccg

SEQ ID NO: 53710 - DNA, 17 bp, Homo sapiens
ttttttcactgacccgg

SEQ ID NO: 53711 - DNA, 18 bp, Homo sapiens
ttttttcactgacccggt

SEQ ID NO: 53712 - DNA, 19 bp, Homo sapiens
ttttttcactgacccggtg

SEQ ID NO: 53713 - DNA, 22 bp, Homo sapiens
ttttttcactgacccggtgagg

SEQ ID NO: 53714 - DNA, 23 bp, Homo sapiens
ttttttcactgacccggtgaggc

SEQ ID NO: 53715 - DNA, 24 bp, Homo sapiens
ttttttcactgacccggtgaggcg

SEQ ID NO: 53716 - DNA, 25 bp, Homo sapiens
ttttttcactgacccggtgaggcgg

SEQ ID NO: 53717 - DNA, 28 bp, Homo sapiens
ttttttcactgacccggtgaggcggggg

SEQ ID NO: 53718 - DNA, 16 bp, Homo sapiens
tttttcactgacccgg

SEQ ID NO: 53719 - DNA, 17 bp, Homo sapiens
tttttcactgacccggt

SEQ ID NO: 53720 - DNA, 18 bp, Homo sapiens
tttttcactgacccggtg

SEQ ID NO: 53721 - DNA, 21 bp, Homo sapiens
tttttcactgacccggtgagg

SEQ ID NO: 53722 - DNA, 24 bp, Homo sapiens
tttttcactgacccggtgaggcgg

SEQ ID NO: 53723 - DNA, 26 bp, Homo sapiens
tttttcactgacccggtgaggcgggg

SEQ ID NO: 53724 - DNA, 27 bp, Homo sapiens
tttttcactgacccggtgaggcggggg

SEQ ID NO: 53725 - DNA, 16 bp, Homo sapiens
ttttcactgacccggt

SEQ ID NO: 53726 - DNA, 17 bp, Homo sapiens
ttttcactgacccggtg

SEQ ID NO: 53727 - DNA, 20 bp, Homo sapiens
ttttcactgacccggtgagg

SEQ ID NO: 53728 - DNA, 22 bp, Homo sapiens
ttttcactgacccggtgaggcg

SEQ ID NO: 53729 - DNA, 23 bp, Homo sapiens
ttttcactgacccggtgaggcgg

SEQ ID NO: 53730 - DNA, 25 bp, Homo sapiens
ttttcactgacccggtgaggcgggg

SEQ ID NO: 53731 - DNA, 26 bp, Homo sapiens
ttttcactgacccggtgaggcggggg

SEQ ID NO: 53732 - DNA, 16 bp, Homo sapiens
tttcactgacccggtg

SEQ ID NO: 53733 - DNA, 19 bp, Homo sapiens
tttcactgacccggtgagg

SEQ ID NO: 53734 - DNA, 21 bp, Homo sapiens
tttcactgacccggtgaggcg

SEQ ID NO: 53735 - DNA, 22 bp, Homo sapiens
tttcactgacccggtgaggcgg

SEQ ID NO: 53736 - DNA, 23 bp, Homo sapiens
tttcactgacccggtgaggcggg

SEQ ID NO: 53737 - DNA, 24 bp, Homo sapiens
tttcactgacccggtgaggcgggg

SEQ ID NO: 53738 - DNA, 25 bp, Homo sapiens
tttcactgacccggtgaggcggggg

SEQ ID NO: 53739 - DNA, 18 bp, Homo sapiens
ttcactgacccggtgagg

SEQ ID NO: 53740 - DNA, 20 bp, Homo sapiens
ttcactgacccggtgaggcg

SEQ ID NO: 53741 - DNA, 21 bp, Homo sapiens
ttcactgacccggtgaggcgg

SEQ ID NO: 53742 - DNA, 22 bp, Homo sapiens
ttcactgacccggtgaggcggg

SEQ ID NO: 53743 - DNA, 23 bp, Homo sapiens
ttcactgacccggtgaggcgggg

SEQ ID NO: 53744 - DNA, 24 bp, Homo sapiens
ttcactgacccggtgaggcggggg

SEQ ID NO: 53745 - DNA, 17 bp, Homo sapiens
tcactgacccggtgagg

SEQ ID NO: 53746 - DNA, 19 bp, Homo sapiens
tcactgacccggtgaggcg

SEQ ID NO: 53747 - DNA, 20 bp, Homo sapiens
tcactgacccggtgaggcgg

SEQ ID NO: 53748 - DNA, 21 bp, Homo sapiens
tcactgacccggtgaggcggg

SEQ ID NO: 53749 - DNA, 22 bp, Homo sapiens
tcactgacccggtgaggcgggg

SEQ ID NO: 53750 - DNA, 23 bp, Homo sapiens
tcactgacccggtgaggcggggg

SEQ ID NO: 53751 - DNA, 16 bp, Homo sapiens
cactgacccggtgagg

SEQ ID NO: 53752 - DNA, 17 bp, Homo sapiens
cactgacccggtgaggc

SEQ ID NO: 53753 - DNA, 18 bp, Homo sapiens
cactgacccggtgaggcg

SEQ ID NO: 53754 - DNA, 19 bp, Homo sapiens
cactgacccggtgaggcgg

SEQ ID NO: 53755 - DNA, 20 bp, Homo sapiens
cactgacccggtgaggcggg

SEQ ID NO: 53756 - DNA, 21 bp, Homo sapiens
cactgacccggtgaggcgggg

SEQ ID NO: 53757 - DNA, 22 bp, Homo sapiens
cactgacccggtgaggcggggg

SEQ ID NO: 53758 - DNA, 17 bp, Homo sapiens
actgacccggtgaggcg

SEQ ID NO: 53759 - DNA, 24 bp, Homo sapiens
ctgacccggtgaggcgggggggcg

SEQ ID NO: 53760 - DNA, 19 bp, Homo sapiens
ccggtgaggcgggggggcg

SEQ ID NO: 53761 - DNA, 21 bp, Homo sapiens
ccggtgaggcgggggggcgag

SEQ ID NO: 53762 - DNA, 18 bp, Homo sapiens
cggtgaggcgggggggcg

SEQ ID NO: 53763 - DNA, 20 bp, Homo sapiens
cggtgaggcgggggggcgag

SEQ ID NO: 53764 - DNA, 17 bp, Homo sapiens
ggtgaggcgggggggcg

SEQ ID NO: 53765 - DNA, 19 bp, Homo sapiens
ggtgaggcgggggggcgag

SEQ ID NO: 53766 - DNA, 20 bp, Homo sapiens
ggtgaggcgggggggcgagc

SEQ ID NO: 53767 - DNA, 21 bp, Homo sapiens
ggtgaggcgggggggcgagcc

SEQ ID NO: 53768 - DNA, 18 bp, Homo sapiens
gtgaggcgggggggcgag

SEQ ID NO: 53769 - DNA, 19 bp, Homo sapiens
gtgaggcgggggggcgagc

SEQ ID NO: 53770 - DNA, 20 bp, Homo sapiens
gtgaggcgggggggcgagcc

SEQ ID NO: 53771 - DNA, 21 bp, Homo sapiens
gtgaggcgggggggcgagccc

SEQ ID NO: 53772 - DNA, 27 bp, Homo sapiens
gtgaggcgggggggcgagccccgaggg

SEQ ID NO: 53773 - DNA, 17 bp, Homo sapiens
gaggcgggggggcgagc

SEQ ID NO: 53774 - DNA, 18 bp, Homo sapiens
aggcgggggggcgagccc

SEQ ID NO: 53775 - DNA, 19 bp, Homo sapiens
gagccccgaggggctctcg

SEQ ID NO: 53776 - DNA, 17 bp, Homo sapiens
gccccgaggggctctcg

SEQ ID NO: 53777 - DNA, 23 bp, Homo sapiens
ccccgaggggctctcgcttctgg

SEQ ID NO: 53778 - DNA, 22 bp, Homo sapiens
cccgaggggctctcgcttctgg

SEQ ID NO: 53779 - DNA, 23 bp, Homo sapiens
cccgaggggctctcgcttctggc

SEQ ID NO: 53780 - DNA, 30 bp, Homo sapiens
cccgaggggctctcgcttctggcgccaagc

SEQ ID NO: 53781 - DNA, 18 bp, Homo sapiens
ccgaggggctctcgcttc

SEQ ID NO: 53782 - DNA, 19 bp, Homo sapiens
ccgaggggctctcgcttct

SEQ ID NO: 53783 - DNA, 20 bp, Homo sapiens
ccgaggggctctcgcttctg

SEQ ID NO: 53784 - DNA, 21 bp, Homo sapiens
ccgaggggctctcgcttctgg

SEQ ID NO: 53785 - DNA, 22 bp, Homo sapiens
ccgaggggctctcgcttctggc

SEQ ID NO: 53786 - DNA, 23 bp, Homo sapiens
ccgaggggctctcgcttctggcg

SEQ ID NO: 53787 - DNA, 24 bp, Homo sapiens
ccgaggggctctcgcttctggcgc

SEQ ID NO: 53788 - DNA, 25 bp, Homo sapiens
ccgaggggctctcgcttctggcgcc

SEQ ID NO: 53789 - DNA, 26 bp, Homo sapiens
ccgaggggctctcgcttctggcgcca

SEQ ID NO: 53790 - DNA, 30 bp, Homo sapiens
ccgaggggctctcgcttctggcgccaagcg

SEQ ID NO: 53791 - DNA, 18 bp, Homo sapiens
gaggggctctcgcttctg

SEQ ID NO: 53792 - DNA, 19 bp, Homo sapiens
gaggggctctcgcttctgg

SEQ ID NO: 53793 - DNA, 20 bp, Homo sapiens
gaggggctctcgcttctggc

SEQ ID NO: 53794 - DNA, 21 bp, Homo sapiens
gaggggctctcgcttctggcg

SEQ ID NO: 53795 - DNA, 22 bp, Homo sapiens
gaggggctctcgcttctggcgc

SEQ ID NO: 53796 - DNA, 23 bp, Homo sapiens
gaggggctctcgcttctggcgcc

SEQ ID NO: 53797 - DNA, 30 bp, Homo sapiens
gaggggctctcgcttctggcgccaagcgcc

SEQ ID NO: 53798 - DNA, 18 bp, Homo sapiens
aggggctctcgcttctgg

SEQ ID NO: 53799 - DNA, 24 bp, Homo sapiens
ggggctctcgcttctggcgccaag

SEQ ID NO: 53800 - DNA, 16 bp, Homo sapiens
gggctctcgcttctgg

SEQ ID NO: 53801 - DNA, 19 bp, Homo sapiens
gggctctcgcttctggcgc

SEQ ID NO: 53802 - DNA, 20 bp, Homo sapiens
gggctctcgcttctggcgcc

SEQ ID NO: 53803 - DNA, 24 bp, Homo sapiens
gggctctcgcttctggcgccaagc

SEQ ID NO: 53804 - DNA, 26 bp, Homo sapiens
gggctctcgcttctggcgccaagcgc

SEQ ID NO: 53805 - DNA, 30 bp, Homo sapiens
gggctctcgcttctggcgccaagcgcccgg

SEQ ID NO: 53806 - DNA, 19 bp, Homo sapiens
ggctctcgcttctggcgcc

SEQ ID NO: 53807 - DNA, 24 bp, Homo sapiens
ggctctcgcttctggcgccaagcg

SEQ ID NO: 53808 - DNA, 25 bp, Homo sapiens
ggctctcgcttctggcgccaagcgc

SEQ ID NO: 53809 - DNA, 26 bp, Homo sapiens
ggctctcgcttctggcgccaagcgcc

SEQ ID NO: 53810 - DNA, 27 bp, Homo sapiens
ggctctcgcttctggcgccaagcgccc

SEQ ID NO: 53811 - DNA, 30 bp, Homo sapiens
ggctctcgcttctggcgccaagcgcccggc

SEQ ID NO: 53812 - DNA, 16 bp, Homo sapiens
gctctcgcttctggcg

SEQ ID NO: 53813 - DNA, 17 bp, Homo sapiens
gctctcgcttctggcgc

SEQ ID NO: 53814 - DNA, 18 bp, Homo sapiens
gctctcgcttctggcgcc

SEQ ID NO: 53815 - DNA, 21 bp, Homo sapiens
gctctcgcttctggcgccaag

SEQ ID NO: 53816 - DNA, 22 bp, Homo sapiens
gctctcgcttctggcgccaagc

SEQ ID NO: 53817 - DNA, 23 bp, Homo sapiens
gctctcgcttctggcgccaagcg

SEQ ID NO: 53818 - DNA, 24 bp, Homo sapiens
gctctcgcttctggcgccaagcgc

SEQ ID NO: 53819 - DNA, 25 bp, Homo sapiens
gctctcgcttctggcgccaagcgcc

SEQ ID NO: 53820 - DNA, 26 bp, Homo sapiens
gctctcgcttctggcgccaagcgccc

SEQ ID NO: 53821 - DNA, 27 bp, Homo sapiens
gctctcgcttctggcgccaagcgcccg

SEQ ID NO: 53822 - DNA, 28 bp, Homo sapiens
gctctcgcttctggcgccaagcgcccgg

SEQ ID NO: 53823 - DNA, 29 bp, Homo sapiens
gctctcgcttctggcgccaagcgcccggc

SEQ ID NO: 53824 - DNA, 30 bp, Homo sapiens; identical to SEQ ID NO: 26397

SEQ ID NO: 53825 - DNA, 17 bp, Homo sapiens
ctctcgcttctggcgcc

SEQ ID NO: 53826 - DNA, 21 bp, Homo sapiens
ctctcgcttctggcgccaagc

SEQ ID NO: 53827 - DNA, 22 bp, Homo sapiens
ctctcgcttctggcgccaagcg

SEQ ID NO: 53828 - DNA, 23 bp, Homo sapiens
ctctcgcttctggcgccaagcgc

SEQ ID NO: 53829 - DNA, 24 bp, Homo sapiens
ctctcgcttctggcgccaagcgcc

SEQ ID NO: 53830 - DNA, 25 bp, Homo sapiens
ctctcgcttctggcgccaagcgccc

SEQ ID NO: 53831 - DNA, 26 bp, Homo sapiens
ctctcgcttctggcgccaagcgcccg

SEQ ID NO: 53832 - DNA, 27 bp, Homo sapiens
ctctcgcttctggcgccaagcgcccgg

SEQ ID NO: 53833 - DNA, 28 bp, Homo sapiens
ctctcgcttctggcgccaagcgcccggc

SEQ ID NO: 53834 - DNA, 29 bp, Homo sapiens
ctctcgcttctggcgccaagcgcccggcc

SEQ ID NO: 53835 - DNA, 30 bp, Homo sapiens
ctctcgcttctggcgccaagcgcccggccg

SEQ ID NO: 53836 - DNA, 21 bp, Homo sapiens
tctcgcttctggcgccaagcg

SEQ ID NO: 53837 - DNA, 22 bp, Homo sapiens
tctcgcttctggcgccaagcgc

SEQ ID NO: 53838 - DNA, 23 bp, Homo sapiens
tctcgcttctggcgccaagcgcc

SEQ ID NO: 53839 - DNA, 24 bp, Homo sapiens
tctcgcttctggcgccaagcgccc

SEQ ID NO: 53840 - DNA, 20 bp, Homo sapiens
ctcgcttctggcgccaagcg

SEQ ID NO: 53841 - DNA, 21 bp, Homo sapiens
ctcgcttctggcgccaagcgc

SEQ ID NO: 53842 - DNA, 22 bp, Homo sapiens
ctcgcttctggcgccaagcgcc

SEQ ID NO: 53843 - DNA, 23 bp, Homo sapiens
ctcgcttctggcgccaagcgccc

SEQ ID NO: 53844 - DNA, 24 bp, Homo sapiens
ctcgcttctggcgccaagcgcccg

SEQ ID NO: 53845 - DNA, 25 bp, Homo sapiens
ctcgcttctggcgccaagcgcccgg

SEQ ID NO: 53846 - DNA, 26 bp, Homo sapiens
ctcgcttctggcgccaagcgcccggc

SEQ ID NO: 53847 - DNA, 27 bp, Homo sapiens
ctcgcttctggcgccaagcgcccggcc

SEQ ID NO: 53848 - DNA, 19 bp, Homo sapiens
tcgcttctggcgccaagcg

SEQ ID NO: 53849 - DNA, 20 bp, Homo sapiens
tcgcttctggcgccaagcgc

SEQ ID NO: 53850 - DNA, 21 bp, Homo sapiens
tcgcttctggcgccaagcgcc

SEQ ID NO: 53851 - DNA, 19 bp, Homo sapiens
cgcttctggcgccaagcgc

SEQ ID NO: 53852 - DNA, 20 bp, Homo sapiens
cgcttctggcgccaagcgcc

SEQ ID NO: 53853 - DNA, 22 bp, Homo sapiens
gcttctggcgccaagcgcccgg

SEQ ID NO: 53854 - DNA, 23 bp, Homo sapiens
gcttctggcgccaagcgcccggc

SEQ ID NO: 53855 - DNA, 22 bp, Homo sapiens
cttctggcgccaagcgcccggc

SEQ ID NO: 53856 - DNA, 23 bp, Homo sapiens
cttctggcgccaagcgcccggcc

SEQ ID NO: 53857 - DNA, 18 bp, Homo sapiens
ggcgccaagcgcccggcc

SEQ ID NO: 53858 - DNA, 19 bp, Homo sapiens
ggcgccaagcgcccggccg

SEQ ID NO: 53859 - DNA, 22 bp, Homo sapiens
ggccgcgcgccggccgggcgcg

SEQ ID NO: 53860 - DNA, 24 bp, Homo sapiens
ggccgcgcgccggccgggcgcgac

SEQ ID NO: 53861 - DNA, 25 bp, Homo sapiens
ggccgcgcgccggccgggcgcgacc

SEQ ID NO: 53862 - DNA, 19 bp, Homo sapiens
gccgcgcgccggccgggcg

SEQ ID NO: 53863 - DNA, 16 bp, Homo sapiens
cgcgcgccggccgggc

SEQ ID NO: 53864 - DNA, 20 bp, Homo sapiens
cgccggccgggcgcgacccg

SEQ ID NO: 53865 - DNA, 29 bp, Homo sapiens
gccggccgggcgcgacccgctccggggac

SEQ ID NO: 53866 - DNA, 18 bp, Homo sapiens
cggccgggcgcgacccgc

SEQ ID NO: 53867 - DNA, 24 bp, Homo sapiens
cggccgggcgcgacccgctccggg

SEQ ID NO: 53868 - DNA, 22 bp, Homo sapiens
cgggcgcgacccgctccgggga

SEQ ID NO: 53869 - DNA, 19 bp, Homo sapiens
gggcgcgacccgctccggg

SEQ ID NO: 53870 - DNA, 20 bp, Homo sapiens
gggcgcgacccgctccgggg

SEQ ID NO: 53871 - DNA, 21 bp, Homo sapiens
gggcgcgacccgctccgggga

SEQ ID NO: 53872 - DNA, 22 bp, Homo sapiens
gggcgcgacccgctccggggac

SEQ ID NO: 53873 - DNA, 17 bp, Homo sapiens
ggcgcgacccgctccgg

SEQ ID NO: 53874 - DNA, 18 bp, Homo sapiens
ggcgcgacccgctccggg

SEQ ID NO: 53875 - DNA, 19 bp, Homo sapiens
ggcgcgacccgctccgggg

SEQ ID NO: 53876 - DNA, 20 bp, Homo sapiens
ggcgcgacccgctccgggga

SEQ ID NO: 53877 - DNA, 21 bp, Homo sapiens
ggcgcgacccgctccggggac

SEQ ID NO: 53878 - DNA, 22 bp, Homo sapiens
ggcgcgacccgctccggggaca

SEQ ID NO: 53879 - DNA, 23 bp, Homo sapiens
ggcgcgacccgctccggggacag

SEQ ID NO: 53880 - DNA, 16 bp, Homo sapiens
gcgcgacccgctccgg

SEQ ID NO: 53881 - DNA, 20 bp, Homo sapiens
gcgcgacccgctccggggac

SEQ ID NO: 53882 - DNA, 17 bp, Homo sapiens
gcgacccgctccgggga

SEQ ID NO: 53883 - DNA, 18 bp, Homo sapiens
gcgacccgctccggggac

SEQ ID NO: 53884 - DNA, 24 bp, Homo sapiens
gcgacccgctccggggacagtgcc

SEQ ID NO: 53885 - DNA, 26 bp, Homo sapiens
gcgacccgctccggggacagtgccag

SEQ ID NO: 53886 - DNA, 30 bp, Homo sapiens
gcgacccgctccggggacagtgccaggtgg

SEQ ID NO: 53887 - DNA, 25 bp, Homo sapiens
cgacccgctccggggacagtgccag

SEQ ID NO: 53888 - DNA, 30 bp, Homo sapiens
cgacccgctccggggacagtgccaggtggg

SEQ ID NO: 53889 - DNA, 24 bp, Homo sapiens
gacccgctccggggacagtgccag

SEQ ID NO: 53890 - DNA, 23 bp, Homo sapiens
acccgctccggggacagtgccag

SEQ ID NO: 53891 - DNA, 24 bp, Homo sapiens
acccgctccggggacagtgccagg

SEQ ID NO: 53892 - DNA, 29 bp, Homo sapiens
acccgctccggggacagtgccaggtgggg

SEQ ID NO: 53893 - DNA, 22 bp, Homo sapiens
cccgctccggggacagtgccag

SEQ ID NO: 53894 - DNA, 17 bp, Homo sapiens
ccgctccggggacagtg

SEQ ID NO: 53895 - DNA, 21 bp, Homo sapiens
ccgctccggggacagtgccag

SEQ ID NO: 53896 - DNA, 16 bp, Homo sapiens
cgctccggggacagtg

SEQ ID NO: 53897 - DNA, 20 bp, Homo sapiens
cgctccggggacagtgccag

SEQ ID NO: 53898 - DNA, 22 bp, Homo sapiens
gctccggggacagtgccaggtg

SEQ ID NO: 53899 - DNA, 24 bp, Homo sapiens
gctccggggacagtgccaggtggg

SEQ ID NO: 53900 - DNA, 30 bp, Homo sapiens
gctccggggacagtgccaggtggggagttt

SEQ ID NO: 53901 - DNA, 18 bp, Homo sapiens
ctccggggacagtgccag

SEQ ID NO: 53902 - DNA, 19 bp, Homo sapiens
ctccggggacagtgccagg

SEQ ID NO: 53903 - DNA, 22 bp, Homo sapiens
ccggggacagtgccaggtgggg

SEQ ID NO: 53904 - DNA, 19 bp, Homo sapiens
cggggacagtgccaggtgg

SEQ ID NO: 53905 - DNA, 18 bp, Homo sapiens
ggggacagtgccaggtgg

SEQ ID NO: 53906 - DNA, 19 bp, Homo sapiens
ggggacagtgccaggtggg

SEQ ID NO: 53907 - DNA, 20 bp, Homo sapiens
ggggacagtgccaggtgggg

SEQ ID NO: 53908 - DNA, 21 bp, Homo sapiens
ggggacagtgccaggtgggga

SEQ ID NO: 53909 - DNA, 22 bp, Homo sapiens
ggggacagtgccaggtggggag

SEQ ID NO: 53910 - DNA, 18 bp, Homo sapiens
gggacagtgccaggtggg

SEQ ID NO: 53911 - DNA, 19 bp, Homo sapiens
gggacagtgccaggtgggg

SEQ ID NO: 53912 - DNA, 20 bp, Homo sapiens
gggacagtgccaggtgggga

SEQ ID NO: 53913 - DNA, 21 bp, Homo sapiens
gggacagtgccaggtggggag

SEQ ID NO: 53914 - DNA, 22 bp, Homo sapiens
gggacagtgccaggtggggagt

SEQ ID NO: 53915 - DNA, 18 bp, Homo sapiens
ggacagtgccaggtgggg

SEQ ID NO: 53916 - DNA, 19 bp, Homo sapiens
ggacagtgccaggtgggga

SEQ ID NO: 53917 - DNA, 20 bp, Homo sapiens
ggacagtgccaggtggggag

SEQ ID NO: 53918 - DNA, 30 bp, Homo sapiens
ggacagtgccaggtggggagtttgactggg

SEQ ID NO: 53919 - DNA, 17 bp, Homo sapiens
gacagtgccaggtgggg

SEQ ID NO: 53920 - DNA, 19 bp, Homo sapiens
gacagtgccaggtggggag

SEQ ID NO: 53921 - DNA, 20 bp, Homo sapiens
gacagtgccaggtggggagt

SEQ ID NO: 53922 - DNA, 23 bp, Homo sapiens
gacagtgccaggtggggagtttg

SEQ ID NO: 53923 - DNA, 24 bp, Homo sapiens
gacagtgccaggtggggagtttga

SEQ ID NO: 53924 - DNA, 29 bp, Homo sapiens
gacagtgccaggtggggagtttgactggg

SEQ ID NO: 53925 - DNA, 30 bp, Homo sapiens
gacagtgccaggtggggagtttgactgggg

SEQ ID NO: 53926 - DNA, 16 bp, Homo sapiens
acagtgccaggtgggg

SEQ ID NO: 53927 - DNA, 18 bp, Homo sapiens
acagtgccaggtggggag

SEQ ID NO: 53928 - DNA, 19 bp, Homo sapiens
acagtgccaggtggggagt

SEQ ID NO: 53929 - DNA, 20 bp, Homo sapiens
acagtgccaggtggggagtt

SEQ ID NO: 53930 - DNA, 22 bp, Homo sapiens
acagtgccaggtggggagtttg

SEQ ID NO: 53931 - DNA, 23 bp, Homo sapiens
acagtgccaggtggggagtttga

SEQ ID NO: 53932 - DNA, 25 bp, Homo sapiens
acagtgccaggtggggagtttgact

SEQ ID NO: 53933 - DNA, 26 bp, Homo sapiens
acagtgccaggtggggagtttgactg

SEQ ID NO: 53934 - DNA, 28 bp, Homo sapiens
acagtgccaggtggggagtttgactggg

SEQ ID NO: 53935 - DNA, 29 bp, Homo sapiens
acagtgccaggtggggagtttgactgggg

SEQ ID NO: 53936 - DNA, 17 bp, Homo sapiens
cagtgccaggtggggag

SEQ ID NO: 53937 - DNA, 18 bp, Homo sapiens
cagtgccaggtggggagt

SEQ ID NO: 53938 - DNA, 21 bp, Homo sapiens
cagtgccaggtggggagtttg

SEQ ID NO: 53939 - DNA, 22 bp, Homo sapiens
cagtgccaggtggggagtttga

SEQ ID NO: 53940 - DNA, 23 bp, Homo sapiens
cagtgccaggtggggagtttgac

SEQ ID NO: 53941 - DNA, 24 bp, Homo sapiens
cagtgccaggtggggagtttgact

SEQ ID NO: 53942 - DNA, 25 bp, Homo sapiens
cagtgccaggtggggagtttgactg

SEQ ID NO: 53943 - DNA, 27 bp, Homo sapiens
cagtgccaggtggggagtttgactggg

SEQ ID NO: 53944 - DNA, 28 bp, Homo sapiens
cagtgccaggtggggagtttgactgggg

SEQ ID NO: 53945 - DNA, 16 bp, Homo sapiens
agtgccaggtggggag

SEQ ID NO: 53946 - DNA, 17 bp, Homo sapiens
agtgccaggtggggagt

SEQ ID NO: 53947 - DNA, 20 bp, Homo sapiens
agtgccaggtggggagtttg

SEQ ID NO: 53948 - DNA, 21 bp, Homo sapiens
agtgccaggtggggagtttga

SEQ ID NO: 53949 - DNA, 23 bp, Homo sapiens
agtgccaggtggggagtttgact

SEQ ID NO: 53950 - DNA, 26 bp, Homo sapiens
agtgccaggtggggagtttgactggg

SEQ ID NO: 53951 - DNA, 27 bp, Homo sapiens
agtgccaggtggggagtttgactgggg

SEQ ID NO: 53952 - DNA, 28 bp, Homo sapiens
agtgccaggtggggagtttgactggggc

SEQ ID NO: 53953 - DNA, 30 bp, Homo sapiens
agtgccaggtggggagtttgactggggcgg

SEQ ID NO: 53954 - DNA, 17 bp, Homo sapiens
gtgccaggtggggagtt

SEQ ID NO: 53955 - DNA, 18 bp, Homo sapiens
gtgccaggtggggagttt

SEQ ID NO: 53956 - DNA, 19 bp, Homo sapiens
gtgccaggtggggagtttg

SEQ ID NO: 53957 - DNA, 20 bp, Homo sapiens
gtgccaggtggggagtttga

SEQ ID NO: 53958 - DNA, 21 bp, Homo sapiens
gtgccaggtggggagtttgac

SEQ ID NO: 53959 - DNA, 22 bp, Homo sapiens
gtgccaggtggggagtttgact

SEQ ID NO: 53960 - DNA, 23 bp, Homo sapiens
gtgccaggtggggagtttgactg

SEQ ID NO: 53961 - DNA, 25 bp, Homo sapiens
gtgccaggtggggagtttgactggg

SEQ ID NO: 53962 - DNA, 26 bp, Homo sapiens
gtgccaggtggggagtttgactgggg

SEQ ID NO: 53963 - DNA, 27 bp, Homo sapiens
gtgccaggtggggagtttgactggggc

SEQ ID NO: 53964 - DNA, 28 bp, Homo sapiens
gtgccaggtggggagtttgactggggcg

SEQ ID NO: 53965 - DNA, 30 bp, Homo sapiens
gtgccaggtggggagtttgactggggcggt

SEQ ID NO: 53966 - DNA, 19 bp, Homo sapiens
tgccaggtggggagtttga

SEQ ID NO: 53967 - DNA, 22 bp, Homo sapiens
tgccaggtggggagtttgactg

SEQ ID NO: 53968 - DNA, 23 bp, Homo sapiens
tgccaggtggggagtttgactgg

SEQ ID NO: 53969 - DNA, 24 bp, Homo sapiens
tgccaggtggggagtttgactggg

SEQ ID NO: 53970 - DNA, 25 bp, Homo sapiens
tgccaggtggggagtttgactgggg

SEQ ID NO: 53971 - DNA, 20 bp, Homo sapiens
gccaggtggggagtttgact

SEQ ID NO: 53972 - DNA, 21 bp, Homo sapiens
gccaggtggggagtttgactg

SEQ ID NO: 53973 - DNA, 22 bp, Homo sapiens
gccaggtggggagtttgactgg

SEQ ID NO: 53974 - DNA, 23 bp, Homo sapiens
gccaggtggggagtttgactggg

SEQ ID NO: 53975 - DNA, 20 bp, Homo sapiens
ccaggtggggagtttgactg

SEQ ID NO: 53976 - DNA, 21 bp, Homo sapiens
ccaggtggggagtttgactgg

SEQ ID NO: 53977 - DNA, 22 bp, Homo sapiens
ccaggtggggagtttgactggg

SEQ ID NO: 53978 - DNA, 23 bp, Homo sapiens
ccaggtggggagtttgactgggg

SEQ ID NO: 53979 - DNA, 20 bp, Homo sapiens
caggtggggagtttgactgg

SEQ ID NO: 53980 - DNA, 21 bp, Homo sapiens
caggtggggagtttgactggg

SEQ ID NO: 53981 - DNA, 22 bp, Homo sapiens
caggtggggagtttgactgggg

SEQ ID NO: 53982 - DNA, 23 bp, Homo sapiens
caggtggggagtttgactggggc

SEQ ID NO: 53983 - DNA, 24 bp, Homo sapiens
caggtggggagtttgactggggcg

SEQ ID NO: 53984 - DNA, 18 bp, Homo sapiens
aggtggggagtttgactg

SEQ ID NO: 53985 - DNA, 19 bp, Homo sapiens
aggtggggagtttgactgg

SEQ ID NO: 53986 - DNA, 20 bp, Homo sapiens
aggtggggagtttgactggg

SEQ ID NO: 53987 - DNA, 21 bp, Homo sapiens
aggtggggagtttgactgggg

SEQ ID NO: 53988 - DNA, 22 bp, Homo sapiens
aggtggggagtttgactggggc

SEQ ID NO: 53989 - DNA, 23 bp, Homo sapiens
aggtggggagtttgactggggcg

SEQ ID NO: 53990 - DNA, 24 bp, Homo sapiens
aggtggggagtttgactggggcgg

SEQ ID NO: 53991 - DNA, 25 bp, Homo sapiens
aggtggggagtttgactggggcggt

SEQ ID NO: 53992 - DNA, 26 bp, Homo sapiens
aggtggggagtttgactggggcggta

SEQ ID NO: 53993 - DNA, 19 bp, Homo sapiens
ggtggggagtttgactggg

SEQ ID NO: 53994 - DNA, 20 bp, Homo sapiens
ggtggggagtttgactgggg

SEQ ID NO: 53995 - DNA, 21 bp, Homo sapiens
ggtggggagtttgactggggc

SEQ ID NO: 53996 - DNA, 22 bp, Homo sapiens
ggtggggagtttgactggggcg

SEQ ID NO: 53997 - DNA, 23 bp, Homo sapiens
ggtggggagtttgactggggcgg

SEQ ID NO: 53998 - DNA, 24 bp, Homo sapiens
ggtggggagtttgactggggcggt

SEQ ID NO: 53999 - DNA, 25 bp, Homo sapiens
ggtggggagtttgactggggcggta

SEQ ID NO: 54000 - DNA, 16 bp, Homo sapiens
gtggggagtttgactg

SEQ ID NO: 54001 - DNA, 18 bp, Homo sapiens
gtggggagtttgactggg

SEQ ID NO: 54002 - DNA, 19 bp, Homo sapiens
gtggggagtttgactgggg

SEQ ID NO: 54003 - DNA, 20 bp, Homo sapiens
gtggggagtttgactggggc

SEQ ID NO: 54004 - DNA, 21 bp, Homo sapiens
gtggggagtttgactggggcg

SEQ ID NO: 54005 - DNA, 22 bp, Homo sapiens
gtggggagtttgactggggcgg

SEQ ID NO: 54006 - DNA, 23 bp, Homo sapiens
gtggggagtttgactggggcggt

SEQ ID NO: 54007 - DNA, 24 bp, Homo sapiens
gtggggagtttgactggggcggta

SEQ ID NO: 54008 - DNA, 17 bp, Homo sapiens
tggggagtttgactggg

SEQ ID NO: 54009 - DNA, 18 bp, Homo sapiens
tggggagtttgactgggg

SEQ ID NO: 54010 - DNA, 19 bp, Homo sapiens
tggggagtttgactggggc

SEQ ID NO: 54011 - DNA, 20 bp, Homo sapiens
tggggagtttgactggggcg

SEQ ID NO: 54012 - DNA, 21 bp, Homo sapiens
tggggagtttgactggggcgg

SEQ ID NO: 54013 - DNA, 22 bp, Homo sapiens
tggggagtttgactggggcggt

SEQ ID NO: 54014 - DNA, 23 bp, Homo sapiens
tggggagtttgactggggcggta

SEQ ID NO: 54015 - DNA, 16 bp, Homo sapiens
ggggagtttgactggg

SEQ ID NO: 54016 - DNA, 17 bp, Homo sapiens
ggggagtttgactgggg

SEQ ID NO: 54017 - DNA, 18 bp, Homo sapiens
ggggagtttgactggggc

SEQ ID NO: 54018 - DNA, 19 bp, Homo sapiens
ggggagtttgactggggcg

SEQ ID NO: 54019 - DNA, 20 bp, Homo sapiens
ggggagtttgactggggcgg

SEQ ID NO: 54020 - DNA, 21 bp, Homo sapiens
ggggagtttgactggggcggt

SEQ ID NO: 54021 - DNA, 22 bp, Homo sapiens
ggggagtttgactggggcggta

SEQ ID NO: 54022 - DNA, 16 bp, Homo sapiens
gggagtttgactgggg

SEQ ID NO: 54023 - DNA, 18 bp, Homo sapiens
gggagtttgactggggcg

SEQ ID NO: 54024 - DNA, 19 bp, Homo sapiens
gggagtttgactggggcgg

SEQ ID NO: 54025 - DNA, 20 bp, Homo sapiens
gggagtttgactggggcggt

SEQ ID NO: 54026 - DNA, 21 bp, Homo sapiens
gggagtttgactggggcggta

SEQ ID NO: 54027 - DNA, 17 bp, Homo sapiens
ggagtttgactggggcg

SEQ ID NO: 54028 - DNA, 18 bp, Homo sapiens
ggagtttgactggggcgg

SEQ ID NO: 54029 - DNA, 19 bp, Homo sapiens
ggagtttgactggggcggt

SEQ ID NO: 54030 - DNA, 20 bp, Homo sapiens
ggagtttgactggggcggta

SEQ ID NO: 54031 - DNA, 27 bp, Homo sapiens
ggagtttgactggggcggtacacctgt

SEQ ID NO: 54032 - DNA, 16 bp, Homo sapiens
gagtttgactggggcg

SEQ ID NO: 54033 - DNA, 17 bp, Homo sapiens
gagtttgactggggcgg

SEQ ID NO: 54034 - DNA, 18 bp, Homo sapiens
gagtttgactggggcggt

SEQ ID NO: 54035 - DNA, 19 bp, Homo sapiens
gagtttgactggggcggta

SEQ ID NO: 54036 - DNA, 21 bp, Homo sapiens
gagtttgactggggcggtaca

SEQ ID NO: 54037 - DNA, 22 bp, Homo sapiens
gagtttgactggggcggtacac

SEQ ID NO: 54038 - DNA, 23 bp, Homo sapiens
gagtttgactggggcggtacacc

SEQ ID NO: 54039 - DNA, 25 bp, Homo sapiens
gagtttgactggggcggtacacctg

SEQ ID NO: 54040 - DNA, 26 bp, Homo sapiens
gagtttgactggggcggtacacctgt

SEQ ID NO: 54041 - DNA, 16 bp, Homo sapiens
agtttgactggggcgg

SEQ ID NO: 54042 - DNA, 17 bp, Homo sapiens
agtttgactggggcggt

SEQ ID NO: 54043 - DNA, 18 bp, Homo sapiens
agtttgactggggcggta

SEQ ID NO: 54044 - DNA, 20 bp, Homo sapiens
agtttgactggggcggtaca

SEQ ID NO: 54045 - DNA, 21 bp, Homo sapiens
agtttgactggggcggtacac

SEQ ID NO: 54046 - DNA, 22 bp, Homo sapiens
agtttgactggggcggtacacc

SEQ ID NO: 54047 - DNA, 24 bp, Homo sapiens
agtttgactggggcggtacacctg

SEQ ID NO: 54048 - DNA, 25 bp, Homo sapiens
agtttgactggggcggtacacctgt

SEQ ID NO: 54049 - DNA, 21 bp, Homo sapiens
gactggggcggtacacctgtc

SEQ ID NO: 54050 - DNA, 21 bp, Homo sapiens
gcggtacacctgtcaaacggt

SEQ ID NO: 54051 - DNA, 19 bp, Homo sapiens
cggtacacctgtcaaacgg

SEQ ID NO: 54052 - DNA, 20 bp, Homo sapiens
cggtacacctgtcaaacggt

SEQ ID NO: 54053 - DNA, 17 bp, Homo sapiens
gtacacctgtcaaacgg

SEQ ID NO: 54054 - DNA, 20 bp, Homo sapiens
cctgtcaaacggtaacgcag

SEQ ID NO: 54055 - DNA, 30 bp, Homo sapiens; identical to SEQ ID NO: 26462

SEQ ID NO: 54056 - DNA, 19 bp, Homo sapiens
taacgcaggtgtcctaagg

SEQ ID NO: 54057 - DNA, 17 bp, Homo sapiens
aacgcaggtgtcctaag

SEQ ID NO: 54058 - DNA, 18 bp, Homo sapiens
aacgcaggtgtcctaagg

SEQ ID NO: 54059 - DNA, 20 bp, Homo sapiens
aacgcaggtgtcctaaggcg

SEQ ID NO: 54060 - DNA, 22 bp, Homo sapiens
aacgcaggtgtcctaaggcgag

SEQ ID NO: 54061 - DNA, 29 bp, Homo sapiens
aacgcaggtgtcctaaggcgagctcaggg

SEQ ID NO: 54062 - DNA, 29 bp, Homo sapiens
cgcaggtgtcctaaggcgagctcagggag

SEQ ID NO: 54063 - DNA, 20 bp, Homo sapiens
gcaggtgtcctaaggcgagc

SEQ ID NO: 54064 - DNA, 23 bp, Homo sapiens
gcaggtgtcctaaggcgagctca

SEQ ID NO: 54065 - DNA, 24 bp, Homo sapiens
gcaggtgtcctaaggcgagctcag

SEQ ID NO: 54066 - DNA, 25 bp, Homo sapiens
gcaggtgtcctaaggcgagctcagg

SEQ ID NO: 54067 - DNA, 19 bp, Homo sapiens
caggtgtcctaaggcgagc

SEQ ID NO: 54068 - DNA, 22 bp, Homo sapiens
caggtgtcctaaggcgagctca

SEQ ID NO: 54069 - DNA, 23 bp, Homo sapiens
caggtgtcctaaggcgagctcag

SEQ ID NO: 54070 - DNA, 24 bp, Homo sapiens
caggtgtcctaaggcgagctcagg

SEQ ID NO: 54071 - DNA, 25 bp, Homo sapiens
caggtgtcctaaggcgagctcaggg

SEQ ID NO: 54072 - DNA, 26 bp, Homo sapiens
caggtgtcctaaggcgagctcaggga

SEQ ID NO: 54073 - DNA, 17 bp, Homo sapiens
aggtgtcctaaggcgag

SEQ ID NO: 54074 - DNA, 19 bp, Homo sapiens
aggtgtcctaaggcgagct

SEQ ID NO: 54075 - DNA, 22 bp, Homo sapiens
aggtgtcctaaggcgagctcag

SEQ ID NO: 54076 - DNA, 16 bp, Homo sapiens
ggtgtcctaaggcgag

SEQ ID NO: 54077 - DNA, 17 bp, Homo sapiens
ggtgtcctaaggcgagc

SEQ ID NO: 54078 - DNA, 18 bp, Homo sapiens
ggtgtcctaaggcgagct

SEQ ID NO: 54079 - DNA, 20 bp, Homo sapiens
ggtgtcctaaggcgagctca

SEQ ID NO: 54080 - DNA, 21 bp, Homo sapiens
ggtgtcctaaggcgagctcag

SEQ ID NO: 54081 - DNA, 22 bp, Homo sapiens
ggtgtcctaaggcgagctcagg

SEQ ID NO: 54082 - DNA, 23 bp, Homo sapiens
ggtgtcctaaggcgagctcaggg

SEQ ID NO: 54083 - DNA, 30 bp, Homo sapiens
ggtgtcctaaggcgagctcagggaggacag

SEQ ID NO: 54084 - DNA, 17 bp, Homo sapiens
gtgtcctaaggcgagct

SEQ ID NO: 54085 - DNA, 20 bp, Homo sapiens
gtgtcctaaggcgagctcag

SEQ ID NO: 54086 - DNA, 22 bp, Homo sapiens
gtgtcctaaggcgagctcaggg

SEQ ID NO: 54087 - DNA, 23 bp, Homo sapiens
gtgtcctaaggcgagctcaggga

SEQ ID NO: 54088 - DNA, 24 bp, Homo sapiens
gtgtcctaaggcgagctcagggag

SEQ ID NO: 54089 - DNA, 25 bp, Homo sapiens
gtgtcctaaggcgagctcagggagg

SEQ ID NO: 54090 - DNA, 21 bp, Homo sapiens
tgtcctaaggcgagctcaggg

SEQ ID NO: 54091 - DNA, 23 bp, Homo sapiens
ctaaggcgagctcagggaggaca

SEQ ID NO: 54092 - DNA, 30 bp, Homo sapiens; identical to SEQ ID NO: 26482

SEQ ID NO: 54093 - DNA, 22 bp, Homo sapiens
taaggcgagctcagggaggaca

SEQ ID NO: 54094 - DNA, 16 bp, Homo sapiens
aaggcgagctcaggga

SEQ ID NO: 54095 - DNA, 17 bp, Homo sapiens
aaggcgagctcagggag

SEQ ID NO: 54096 - DNA, 18 bp, Homo sapiens
aaggcgagctcagggagg

SEQ ID NO: 54097 - DNA, 19 bp, Homo sapiens
aaggcgagctcagggagga

SEQ ID NO: 54098 - DNA, 20 bp, Homo sapiens
aaggcgagctcagggaggac

SEQ ID NO: 54099 - DNA, 21 bp, Homo sapiens
aaggcgagctcagggaggaca

SEQ ID NO: 54100 - DNA, 22 bp, Homo sapiens
aaggcgagctcagggaggacag

SEQ ID NO: 54101 - DNA, 23 bp, Homo sapiens
aaggcgagctcagggaggacaga

SEQ ID NO: 54102 - DNA, 18 bp, Homo sapiens
ggcgagctcagggaggac

SEQ ID NO: 54103 - DNA, 16 bp, Homo sapiens
gcgagctcagggagga

SEQ ID NO: 54104 - DNA, 17 bp, Homo sapiens
gcgagctcagggaggac

SEQ ID NO: 54105 - DNA, 18 bp, Homo sapiens
gcgagctcagggaggaca

SEQ ID NO: 54106 - DNA, 19 bp, Homo sapiens
gcgagctcagggaggacag

SEQ ID NO: 54107 - DNA, 20 bp, Homo sapiens
gcgagctcagggaggacaga

SEQ ID NO: 54108 - DNA, 21 bp, Homo sapiens
gcgagctcagggaggacagaa

SEQ ID NO: 54109 - DNA, 30 bp, Homo sapiens
gcgagctcagggaggacagaaacctcccgt

SEQ ID NO: 54110 - DNA, 17 bp, Homo sapiens
cgagctcagggaggaca

SEQ ID NO: 54111 - DNA, 18 bp, Homo sapiens
cgagctcagggaggacag

SEQ ID NO: 54112 - DNA, 19 bp, Homo sapiens
cgagctcagggaggacaga

SEQ ID NO: 54113 - DNA, 16 bp, Homo sapiens
gagctcagggaggaca

SEQ ID NO: 54114 - DNA, 17 bp, Homo sapiens
gagctcagggaggacag

SEQ ID NO: 54115 - DNA, 18 bp, Homo sapiens
gagctcagggaggacaga

SEQ ID NO: 54116 - DNA, 16 bp, Homo sapiens
agctcagggaggacag

SEQ ID NO: 54117 - DNA, 17 bp, Homo sapiens
agctcagggaggacaga

SEQ ID NO: 54118 - DNA, 16 bp, Homo sapiens
gctcagggaggacaga

SEQ ID NO: 54119 - DNA, 16 bp, Homo sapiens
ctcagggaggacagaa

SEQ ID NO: 54120 - DNA, 25 bp, Homo sapiens
gaggacagaaacctcccgtggagca

SEQ ID NO: 54121 - DNA, 26 bp, Homo sapiens
gaggacagaaacctcccgtggagcag

SEQ ID NO: 54122 - DNA, 20 bp, Homo sapiens
aggacagaaacctcccgtgg

SEQ ID NO: 54123 - DNA, 21 bp, Homo sapiens
aggacagaaacctcccgtgga

SEQ ID NO: 54124 - DNA, 17 bp, Homo sapiens
gacagaaacctcccgtg

SEQ ID NO: 54125 - DNA, 18 bp, Homo sapiens
gacagaaacctcccgtgg

SEQ ID NO: 54126 - DNA, 19 bp, Homo sapiens
gacagaaacctcccgtgga

SEQ ID NO: 54127 - DNA, 17 bp, Homo sapiens
acagaaacctcccgtgg

SEQ ID NO: 54128 - DNA, 21 bp, Homo sapiens
cagaaacctcccgtggagcag

SEQ ID NO: 54129 - DNA, 16 bp, Homo sapiens
aaacctcccgtggagc

SEQ ID NO: 54130 - DNA, 18 bp, Homo sapiens
aaacctcccgtggagcag

SEQ ID NO: 54131 - DNA, 19 bp, Homo sapiens
aaacctcccgtggagcaga

SEQ ID NO: 54132 - DNA, 20 bp, Homo sapiens
aaacctcccgtggagcagaa

SEQ ID NO: 54133 - DNA, 24 bp, Homo sapiens
aaacctcccgtggagcagaagggc

SEQ ID NO: 54134 - DNA, 16 bp, Homo sapiens
cccgtggagcagaagg

SEQ ID NO: 54135 - DNA, 28 bp, Homo sapiens
gtggagcagaagggcaaaagctcgcttg

SEQ ID NO: 54136 - DNA, 26 bp, Homo sapiens
gcagaagggcaaaagctcgcttgatc

SEQ ID NO: 54137 - DNA, 29 bp, Homo sapiens
gcagaagggcaaaagctcgcttgatcttg

SEQ ID NO: 54138 - DNA, 21 bp, Homo sapiens
agaagggcaaaagctcgcttg

SEQ ID NO: 54139 - DNA, 26 bp, Homo sapiens
agaagggcaaaagctcgcttgatctt

SEQ ID NO: 54140 - DNA, 27 bp, Homo sapiens
agaagggcaaaagctcgcttgatcttg

SEQ ID NO: 54141 - DNA, 30 bp, Homo sapiens; identical to SEQ ID NO: 5936

SEQ ID NO: 54142 - DNA, 20 bp, Homo sapiens
gaagggcaaaagctcgcttg

SEQ ID NO: 54143 - DNA, 21 bp, Homo sapiens
gaagggcaaaagctcgcttga

SEQ ID NO: 54144 - DNA, 22 bp, Homo sapiens
gaagggcaaaagctcgcttgat

SEQ ID NO: 54145 - DNA, 23 bp, Homo sapiens
gaagggcaaaagctcgcttgatc

SEQ ID NO: 54146 - DNA, 24 bp, Homo sapiens
gaagggcaaaagctcgcttgatct

SEQ ID NO: 54147 - DNA, 25 bp, Homo sapiens
gaagggcaaaagctcgcttgatctt

SEQ ID NO: 54148 - DNA, 26 bp, Homo sapiens
gaagggcaaaagctcgcttgatcttg

SEQ ID NO: 54149 - DNA, 27 bp, Homo sapiens
gaagggcaaaagctcgcttgatcttga

SEQ ID NO: 54150 - DNA, 28 bp, Homo sapiens
gaagggcaaaagctcgcttgatcttgat

SEQ ID NO: 54151 - DNA, 29 bp, Homo sapiens
gaagggcaaaagctcgcttgatcttgatt

SEQ ID NO: 54152 - DNA, 30 bp, Homo sapiens; identical to SEQ ID NO: 5941

SEQ ID NO: 54153 - DNA, 19 bp, Homo sapiens
aagggcaaaagctcgcttg

SEQ ID NO: 54154 - DNA, 20 bp, Homo sapiens
aagggcaaaagctcgcttga

SEQ ID NO: 54155 - DNA, 21 bp, Homo sapiens
aagggcaaaagctcgcttgat

SEQ ID NO: 54156 - DNA, 22 bp, Homo sapiens
aagggcaaaagctcgcttgatc

SEQ ID NO: 54157 - DNA, 23 bp, Homo sapiens
aagggcaaaagctcgcttgatct

SEQ ID NO: 54158 - DNA, 24 bp, Homo sapiens
aagggcaaaagctcgcttgatctt

SEQ ID NO: 54159 - DNA, 25 bp, Homo sapiens
aagggcaaaagctcgcttgatcttg

SEQ ID NO: 54160 - DNA, 26 bp, Homo sapiens
aagggcaaaagctcgcttgatcttga

SEQ ID NO: 54161 - DNA, 28 bp, Homo sapiens
aagggcaaaagctcgcttgatcttgatt

SEQ ID NO: 54162 - DNA, 30 bp, Homo sapiens
aagggcaaaagctcgcttgatcttgatttt

SEQ ID NO: 54163 - DNA, 17 bp, Homo sapiens
agggcaaaagctcgctt

SEQ ID NO: 54164 - DNA, 18 bp, Homo sapiens
agggcaaaagctcgcttg

SEQ ID NO: 54165 - DNA, 19 bp, Homo sapiens
agggcaaaagctcgcttga

SEQ ID NO: 54166 - DNA, 20 bp, Homo sapiens
agggcaaaagctcgcttgat

SEQ ID NO: 54167 - DNA, 21 bp, Homo sapiens
agggcaaaagctcgcttgatc

SEQ ID NO: 54168 - DNA, 22 bp, Homo sapiens
agggcaaaagctcgcttgatct

SEQ ID NO: 54169 - DNA, 23 bp, Homo sapiens
agggcaaaagctcgcttgatctt

SEQ ID NO: 54170 - DNA, 24 bp, Homo sapiens
agggcaaaagctcgcttgatcttg

SEQ ID NO: 54171 - DNA, 25 bp, Homo sapiens
agggcaaaagctcgcttgatcttga

SEQ ID NO: 54172 - DNA, 26 bp, Homo sapiens
agggcaaaagctcgcttgatcttgat

SEQ ID NO: 54173 - DNA, 27 bp, Homo sapiens
agggcaaaagctcgcttgatcttgatt

SEQ ID NO: 54174 - DNA, 28 bp, Homo sapiens
agggcaaaagctcgcttgatcttgattt

SEQ ID NO: 54175 - DNA, 29 bp, Homo sapiens
agggcaaaagctcgcttgatcttgatttt

SEQ ID NO: 54176 - DNA, 30 bp, Homo sapiens; identical to SEQ ID NO: 30842

SEQ ID NO: 54177 - DNA, 16 bp, Homo sapiens
gggcaaaagctcgctt

SEQ ID NO: 54178 - DNA, 17 bp, Homo sapiens
gggcaaaagctcgcttg

SEQ ID NO: 54179 - DNA, 19 bp, Homo sapiens
gggcaaaagctcgcttgat

SEQ ID NO: 54180 - DNA, 20 bp, Homo sapiens
gggcaaaagctcgcttgatc

SEQ ID NO: 54181 - DNA, 21 bp, Homo sapiens
gggcaaaagctcgcttgatct

SEQ ID NO: 54182 - DNA, 22 bp, Homo sapiens
gggcaaaagctcgcttgatctt

SEQ ID NO: 54183 - DNA, 23 bp, Homo sapiens
gggcaaaagctcgcttgatcttg

SEQ ID NO: 54184 - DNA, 24 bp, Homo sapiens
gggcaaaagctcgcttgatcttga

SEQ ID NO: 54185 - DNA, 25 bp, Homo sapiens
gggcaaaagctcgcttgatcttgat

SEQ ID NO: 54186 - DNA, 26 bp, Homo sapiens
gggcaaaagctcgcttgatcttgatt

SEQ ID NO: 54187 - DNA, 27 bp, Homo sapiens
gggcaaaagctcgcttgatcttgattt

SEQ ID NO: 54188 - DNA, 28 bp, Homo sapiens
gggcaaaagctcgcttgatcttgatttt

SEQ ID NO: 54189 - DNA, 29 bp, Homo sapiens
gggcaaaagctcgcttgatcttgattttc

SEQ ID NO: 54190 - DNA, 30 bp, Homo sapiens
gggcaaaagctcgcttgatcttgattttca

SEQ ID NO: 54191 - DNA, 16 bp, Homo sapiens
ggcaaaagctcgcttg

SEQ ID NO: 54192 - DNA, 18 bp, Homo sapiens
ggcaaaagctcgcttgat

SEQ ID NO: 54193 - DNA, 19 bp, Homo sapiens
ggcaaaagctcgcttgatc

SEQ ID NO: 54194 - DNA, 20 bp, Homo sapiens
ggcaaaagctcgcttgatct

SEQ ID NO: 54195 - DNA, 21 bp, Homo sapiens
ggcaaaagctcgcttgatctt

SEQ ID NO: 54196 - DNA, 22 bp, Homo sapiens
ggcaaaagctcgcttgatcttg

SEQ ID NO: 54197 - DNA, 23 bp, Homo sapiens
ggcaaaagctcgcttgatcttga

SEQ ID NO: 54198 - DNA, 24 bp, Homo sapiens
ggcaaaagctcgcttgatcttgat

SEQ ID NO: 54199 - DNA, 25 bp, Homo sapiens
ggcaaaagctcgcttgatcttgatt

SEQ ID NO: 54200 - DNA, 26 bp, Homo sapiens
ggcaaaagctcgcttgatcttgattt

SEQ ID NO: 54201 - DNA, 27 bp, Homo sapiens
ggcaaaagctcgcttgatcttgatttt

SEQ ID NO: 54202 - DNA, 28 bp, Homo sapiens
ggcaaaagctcgcttgatcttgattttc

SEQ ID NO: 54203 - DNA, 30 bp, Homo sapiens
ggcaaaagctcgcttgatcttgattttcag

SEQ ID NO: 54204 - DNA, 17 bp, Homo sapiens
gcaaaagctcgcttgat

SEQ ID NO: 54205 - DNA, 18 bp, Homo sapiens
gcaaaagctcgcttgatc

SEQ ID NO: 54206 - DNA, 19 bp, Homo sapiens
gcaaaagctcgcttgatct

SEQ ID NO: 54207 - DNA, 20 bp, Homo sapiens
gcaaaagctcgcttgatctt

SEQ ID NO: 54208 - DNA, 21 bp, Homo sapiens
gcaaaagctcgcttgatcttg

SEQ ID NO: 54209 - DNA, 22 bp, Homo sapiens
gcaaaagctcgcttgatcttga

SEQ ID NO: 54210 - DNA, 23 bp, Homo sapiens
gcaaaagctcgcttgatcttgat

SEQ ID NO: 54211 - DNA, 24 bp, Homo sapiens
gcaaaagctcgcttgatcttgatt

SEQ ID NO: 54212 - DNA, 25 bp, Homo sapiens
gcaaaagctcgcttgatcttgattt

SEQ ID NO: 54213 - DNA, 26 bp, Homo sapiens
gcaaaagctcgcttgatcttgatttt

SEQ ID NO: 54214 - DNA, 27 bp, Homo sapiens
gcaaaagctcgcttgatcttgattttc

SEQ ID NO: 54215 - DNA, 28 bp, Homo sapiens
gcaaaagctcgcttgatcttgattttca

SEQ ID NO: 54216 - DNA, 29 bp, Homo sapiens
gcaaaagctcgcttgatcttgattttcag

SEQ ID NO: 54217 - DNA, 30 bp, Homo sapiens
gcaaaagctcgcttgatcttgattttcagt

SEQ ID NO: 54218 - DNA, 20 bp, Homo sapiens
caaaagctcgcttgatcttg

SEQ ID NO: 54219 - DNA, 21 bp, Homo sapiens
caaaagctcgcttgatcttga

SEQ ID NO: 54220 - DNA, 26 bp, Homo sapiens
caaaagctcgcttgatcttgattttc

SEQ ID NO: 54221 - DNA, 18 bp, Homo sapiens
aaagctcgcttgatcttg

SEQ ID NO: 54222 - DNA, 19 bp, Homo sapiens
aaagctcgcttgatcttga

SEQ ID NO: 54223 - DNA, 17 bp, Homo sapiens
aagctcgcttgatcttg

SEQ ID NO: 54224 - DNA, 20 bp, Homo sapiens
aagctcgcttgatcttgatt

SEQ ID NO: 54225 - DNA, 21 bp, Homo sapiens
aagctcgcttgatcttgattt

SEQ ID NO: 54226 - DNA, 22 bp, Homo sapiens
aagctcgcttgatcttgatttt

SEQ ID NO: 54227 - DNA, 23 bp, Homo sapiens
aagctcgcttgatcttgattttc

SEQ ID NO: 54228 - DNA, 16 bp, Homo sapiens
agctcgcttgatcttg

SEQ ID NO: 54229 - DNA, 19 bp, Homo sapiens
agctcgcttgatcttgatt

SEQ ID NO: 54230 - DNA, 21 bp, Homo sapiens
agctcgcttgatcttgatttt

SEQ ID NO: 54231 - DNA, 22 bp, Homo sapiens
agctcgcttgatcttgattttc

SEQ ID NO: 54232 - DNA, 28 bp, Homo sapiens
agctcgcttgatcttgattttcagtacg

SEQ ID NO: 54233 - DNA, 29 bp, Homo sapiens
agctcgcttgatcttgattttcagtacga

SEQ ID NO: 54234 - DNA, 16 bp, Homo sapiens
gctcgcttgatcttga

SEQ ID NO: 54235 - DNA, 17 bp, Homo sapiens
gctcgcttgatcttgat

SEQ ID NO: 54236 - DNA, 18 bp, Homo sapiens
gctcgcttgatcttgatt

SEQ ID NO: 54237 - DNA, 19 bp, Homo sapiens
gctcgcttgatcttgattt

SEQ ID NO: 54238 - DNA, 20 bp, Homo sapiens
gctcgcttgatcttgatttt

SEQ ID NO: 54239 - DNA, 21 bp, Homo sapiens
gctcgcttgatcttgattttc

SEQ ID NO: 54240 - DNA, 22 bp, Homo sapiens
gctcgcttgatcttgattttca

SEQ ID NO: 54241 - DNA, 23 bp, Homo sapiens
gctcgcttgatcttgattttcag

SEQ ID NO: 54242 - DNA, 24 bp, Homo sapiens
gctcgcttgatcttgattttcagt

SEQ ID NO: 54243 - DNA, 25 bp, Homo sapiens
gctcgcttgatcttgattttcagta

SEQ ID NO: 54244 - DNA, 26 bp, Homo sapiens
gctcgcttgatcttgattttcagtac

SEQ ID NO: 54245 - DNA, 27 bp, Homo sapiens
gctcgcttgatcttgattttcagtacg

SEQ ID NO: 54246 - DNA, 28 bp, Homo sapiens
gctcgcttgatcttgattttcagtacga

SEQ ID NO: 54247 - DNA, 29 bp, Homo sapiens
gctcgcttgatcttgattttcagtacgaa

SEQ ID NO: 54248 - DNA, 17 bp, Homo sapiens
ctcgcttgatcttgatt

SEQ ID NO: 54249 - DNA, 18 bp, Homo sapiens
ctcgcttgatcttgattt

SEQ ID NO: 54250 - DNA, 19 bp, Homo sapiens
ctcgcttgatcttgatttt

SEQ ID NO: 54251 - DNA, 20 bp, Homo sapiens
ctcgcttgatcttgattttc

SEQ ID NO: 54252 - DNA, 21 bp, Homo sapiens
ctcgcttgatcttgattttca

SEQ ID NO: 54253 - DNA, 22 bp, Homo sapiens
ctcgcttgatcttgattttcag

SEQ ID NO: 54254 - DNA, 24 bp, Homo sapiens
ctcgcttgatcttgattttcagta

SEQ ID NO: 54255 - DNA, 25 bp, Homo sapiens
ctcgcttgatcttgattttcagtac

SEQ ID NO: 54256 - DNA, 26 bp, Homo sapiens
ctcgcttgatcttgattttcagtacg

SEQ ID NO: 54257 - DNA, 27 bp, Homo sapiens
ctcgcttgatcttgattttcagtacga

SEQ ID NO: 54258 - DNA, 28 bp, Homo sapiens
ctcgcttgatcttgattttcagtacgaa

SEQ ID NO: 54259 - DNA, 29 bp, Homo sapiens
ctcgcttgatcttgattttcagtacgaat

SEQ ID NO: 54260 - DNA, 19 bp, Homo sapiens
tcgcttgatcttgattttc

SEQ ID NO: 54261 - DNA, 20 bp, Homo sapiens
tcgcttgatcttgattttca

SEQ ID NO: 54262 - DNA, 25 bp, Homo sapiens
tcgcttgatcttgattttcagtacg

SEQ ID NO: 54263 - DNA, 28 bp, Homo sapiens
tcgcttgatcttgattttcagtacgaat

SEQ ID NO: 54264 - DNA, 16 bp, Homo sapiens
cgcttgatcttgattt

SEQ ID NO: 54265 - DNA, 17 bp, Homo sapiens
cgcttgatcttgatttt

SEQ ID NO: 54266 - DNA, 18 bp, Homo sapiens
cgcttgatcttgattttc

SEQ ID NO: 54267 - DNA, 19 bp, Homo sapiens
cgcttgatcttgattttca

SEQ ID NO: 54268 - DNA, 20 bp, Homo sapiens
cgcttgatcttgattttcag

SEQ ID NO: 54269 - DNA, 22 bp, Homo sapiens
cgcttgatcttgattttcagta

SEQ ID NO: 54270 - DNA, 23 bp, Homo sapiens
cgcttgatcttgattttcagtac

SEQ ID NO: 54271 - DNA, 24 bp, Homo sapiens
cgcttgatcttgattttcagtacg

SEQ ID NO: 54272 - DNA, 25 bp, Homo sapiens
cgcttgatcttgattttcagtacga

SEQ ID NO: 54273 - DNA, 26 bp, Homo sapiens
cgcttgatcttgattttcagtacgaa

SEQ ID NO: 54274 - DNA, 28 bp, Homo sapiens
cgcttgatcttgattttcagtacgaata

SEQ ID NO: 54275 - DNA, 29 bp, Homo sapiens
cgcttgatcttgattttcagtacgaatac

SEQ ID NO: 54276 - DNA, 17 bp, Homo sapiens
gcttgatcttgattttc

SEQ ID NO: 54277 - DNA, 23 bp, Homo sapiens
gcttgatcttgattttcagtacg

SEQ ID NO: 54278 - DNA, 26 bp, Homo sapiens
gcttgatcttgattttcagtacgaat

SEQ ID NO: 54279 - DNA, 20 bp, Homo sapiens
cttgatcttgattttcagta

SEQ ID NO: 54280 - DNA, 22 bp, Homo sapiens
cttgatcttgattttcagtacg

SEQ ID NO: 54281 - DNA, 24 bp, Homo sapiens
cttgatcttgattttcagtacgaa

SEQ ID NO: 54282 - DNA, 19 bp, Homo sapiens
gatcttgattttcagtacg

SEQ ID NO: 54283 - DNA, 19 bp, Homo sapiens
tcttgattttcagtacgaa

SEQ ID NO: 54284 - DNA, 24 bp, Homo sapiens
tcttgattttcagtacgaatacag

SEQ ID NO: 54285 - DNA, 20 bp, Homo sapiens
ttcagtacgaatacagaccg

SEQ ID NO: 54286 - DNA, 17 bp, Homo sapiens
cagtacgaatacagacc

SEQ ID NO: 54287 - DNA, 17 bp, Homo sapiens
aatacagaccgtgaaag

SEQ ID NO: 54288 - DNA, 19 bp, Homo sapiens
aatacagaccgtgaaagcg

SEQ ID NO: 54289 - DNA, 20 bp, Homo sapiens
aatacagaccgtgaaagcgg

SEQ ID NO: 54290 - DNA, 29 bp, Homo sapiens
aatacagaccgtgaaagcggggcctcacg

SEQ ID NO: 54291 - DNA, 17 bp, Homo sapiens
tacagaccgtgaaagcg

SEQ ID NO: 54292 - DNA, 18 bp, Homo sapiens
tacagaccgtgaaagcgg

SEQ ID NO: 54293 - DNA, 19 bp, Homo sapiens
tacagaccgtgaaagcggg

SEQ ID NO: 54294 - DNA, 20 bp, Homo sapiens
tacagaccgtgaaagcgggg

SEQ ID NO: 54295 - DNA, 19 bp, Homo sapiens
agaccgtgaaagcggggcc

SEQ ID NO: 54296 - DNA, 21 bp, Homo sapiens
agaccgtgaaagcggggcctc

SEQ ID NO: 54297 - DNA, 23 bp, Homo sapiens
gtgaaagcggggcctcacgatcc

SEQ ID NO: 54298 - DNA, 24 bp, Homo sapiens
cggggcctcacgatccttctgacc

SEQ ID NO: 54299 - DNA, 22 bp, Homo sapiens
ggggcctcacgatccttctgac

SEQ ID NO: 54300 - DNA, 23 bp, Homo sapiens
ggggcctcacgatccttctgacc

SEQ ID NO: 54301 - DNA, 24 bp, Homo sapiens
ggggcctcacgatccttctgacct

SEQ ID NO: 54302 - DNA, 25 bp, Homo sapiens
ggggcctcacgatccttctgacctt

SEQ ID NO: 54303 - DNA, 28 bp, Homo sapiens
ggggcctcacgatccttctgaccttttg

SEQ ID NO: 54304 - DNA, 21 bp, Homo sapiens
gggcctcacgatccttctgac

SEQ ID NO: 54305 - DNA, 22 bp, Homo sapiens
gggcctcacgatccttctgacc

SEQ ID NO: 54306 - DNA, 23 bp, Homo sapiens
gggcctcacgatccttctgacct

SEQ ID NO: 54307 - DNA, 24 bp, Homo sapiens
gggcctcacgatccttctgacctt

SEQ ID NO: 54308 - DNA, 26 bp, Homo sapiens
gggcctcacgatccttctgacctttt

SEQ ID NO: 54309 - DNA, 27 bp, Homo sapiens
gggcctcacgatccttctgaccttttg

SEQ ID NO: 54310 - DNA, 21 bp, Homo sapiens
ggcctcacgatccttctgacc

SEQ ID NO: 54311 - DNA, 22 bp, Homo sapiens
ggcctcacgatccttctgacct

SEQ ID NO: 54312 - DNA, 23 bp, Homo sapiens
ggcctcacgatccttctgacctt

SEQ ID NO: 54313 - DNA, 25 bp, Homo sapiens
ggcctcacgatccttctgacctttt

SEQ ID NO: 54314 - DNA, 26 bp, Homo sapiens
ggcctcacgatccttctgaccttttg

SEQ ID NO: 54315 - DNA, 21 bp, Homo sapiens
gcctcacgatccttctgacct

SEQ ID NO: 54316 - DNA, 22 bp, Homo sapiens
gcctcacgatccttctgacctt

SEQ ID NO: 54317 - DNA, 25 bp, Homo sapiens
gcctcacgatccttctgaccttttg

SEQ ID NO: 54318 - DNA, 17 bp, Homo sapiens
cctcacgatccttctga

SEQ ID NO: 54319 - DNA, 19 bp, Homo sapiens
cctcacgatccttctgacc

SEQ ID NO: 54320 - DNA, 20 bp, Homo sapiens
cctcacgatccttctgacct

SEQ ID NO: 54321 - DNA, 21 bp, Homo sapiens
cctcacgatccttctgacctt

SEQ ID NO: 54322 - DNA, 23 bp, Homo sapiens
cctcacgatccttctgacctttt

SEQ ID NO: 54323 - DNA, 24 bp, Homo sapiens
cctcacgatccttctgaccttttg

SEQ ID NO: 54324 - DNA, 16 bp, Homo sapiens
ctcacgatccttctga

SEQ ID NO: 54325 - DNA, 18 bp, Homo sapiens
ctcacgatccttctgacc

SEQ ID NO: 54326 - DNA, 22 bp, Homo sapiens
tcacgatccttctgaccttttg

SEQ ID NO: 54327 - DNA, 16 bp, Homo sapiens
cacgatccttctgacc

SEQ ID NO: 54328 - DNA, 18 bp, Homo sapiens
cacgatccttctgacctt

SEQ ID NO: 54329 - DNA, 20 bp, Homo sapiens
cacgatccttctgacctttt

SEQ ID NO: 54330 - DNA, 21 bp, Homo sapiens
cacgatccttctgaccttttg

SEQ ID NO: 54331 - DNA, 22 bp, Homo sapiens
cacgatccttctgaccttttgg

SEQ ID NO: 54332 - DNA, 19 bp, Homo sapiens
acgatccttctgacctttt

SEQ ID NO: 54333 - DNA, 20 bp, Homo sapiens
acgatccttctgaccttttg

SEQ ID NO: 54334 - DNA, 18 bp, Homo sapiens
cgatccttctgacctttt

SEQ ID NO: 54335 - DNA, 19 bp, Homo sapiens
cgatccttctgaccttttg

SEQ ID NO: 54336 - DNA, 26 bp, Homo sapiens
cgatccttctgaccttttgggtttta

SEQ ID NO: 54337 - DNA, 18 bp, Homo sapiens
gatccttctgaccttttg

SEQ ID NO: 54338 - DNA, 20 bp, Homo sapiens
gatccttctgaccttttggg

SEQ ID NO: 54339 - DNA, 21 bp, Homo sapiens
gatccttctgaccttttgggt

SEQ ID NO: 54340 - DNA, 17 bp, Homo sapiens
atccttctgaccttttg

SEQ ID NO: 54341 - DNA, 18 bp, Homo sapiens
atccttctgaccttttgg

SEQ ID NO: 54342 - DNA, 19 bp, Homo sapiens
atccttctgaccttttggg

SEQ ID NO: 54343 - DNA, 16 bp, Homo sapiens
tccttctgaccttttg

SEQ ID NO: 54344 - DNA, 17 bp, Homo sapiens
tccttctgaccttttgg

SEQ ID NO: 54345 - DNA, 18 bp, Homo sapiens
tccttctgaccttttggg

SEQ ID NO: 54346 - DNA, 16 bp, Homo sapiens
ccttctgaccttttgg

SEQ ID NO: 54347 - DNA, 17 bp, Homo sapiens
ccttctgaccttttggg

SEQ ID NO: 54348 - DNA, 20 bp, Homo sapiens
ccttctgaccttttgggttt

SEQ ID NO: 54349 - DNA, 16 bp, Homo sapiens
cttctgaccttttggg

SEQ ID NO: 54350 - DNA, 19 bp, Homo sapiens
cttctgaccttttgggttt

SEQ ID NO: 54351 - DNA, 20 bp, Homo sapiens
cttctgaccttttgggtttt

SEQ ID NO: 54352 - DNA, 16 bp, Homo sapiens
ttctgaccttttgggt

SEQ ID NO: 54353 - DNA, 18 bp, Homo sapiens
ttctgaccttttgggttt

SEQ ID NO: 54354 - DNA, 19 bp, Homo sapiens
ttctgaccttttgggtttt

SEQ ID NO: 54355 - DNA, 20 bp, Homo sapiens
ttctgaccttttgggtttta

SEQ ID NO: 54356 - DNA, 19 bp, Homo sapiens
gaccttttgggttttaagc

SEQ ID NO: 54357 - DNA, 21 bp, Homo sapiens
gaccttttgggttttaagcag

SEQ ID NO: 54358 - DNA, 20 bp, Homo sapiens
accttttgggttttaagcag

SEQ ID NO: 54359 - DNA, 21 bp, Homo sapiens
accttttgggttttaagcagg

SEQ ID NO: 54360 - DNA, 19 bp, Homo sapiens
ttgggttttaagcaggagg

SEQ ID NO: 54361 - DNA, 20 bp, Homo sapiens
ttgggttttaagcaggaggt

SEQ ID NO: 54362 - DNA, 22 bp, Homo sapiens
ttgggttttaagcaggaggtgt

SEQ ID NO: 54363 - DNA, 21 bp, Homo sapiens
gggttttaagcaggaggtgtc

SEQ ID NO: 54364 - DNA, 22 bp, Homo sapiens
gggttttaagcaggaggtgtca

SEQ ID NO: 54365 - DNA, 19 bp, Homo sapiens
taagcaggaggtgtcagaa

SEQ ID NO: 54366 - DNA, 18 bp, Homo sapiens
caggaggtgtcagaaaag

SEQ ID NO: 54367 - DNA, 20 bp, Homo sapiens
caggaggtgtcagaaaagtt

SEQ ID NO: 54368 - DNA, 19 bp, Homo sapiens
aggaggtgtcagaaaagtt

SEQ ID NO: 54369 - DNA, 16 bp, Homo sapiens
gaggtgtcagaaaagt

SEQ ID NO: 54370 - DNA, 17 bp, Homo sapiens
gaggtgtcagaaaagtt

SEQ ID NO: 54371 - DNA, 16 bp, Homo sapiens
aggtgtcagaaaagtt

SEQ ID NO: 54372 - DNA, 20 bp, Homo sapiens
tgtcagaaaagttaccacag

SEQ ID NO: 54373 - DNA, 22 bp, Homo sapiens
tgtcagaaaagttaccacaggg

SEQ ID NO: 54374 - DNA, 21 bp, Homo sapiens
gtcagaaaagttaccacaggg

SEQ ID NO: 54375 - DNA, 17 bp, Homo sapiens
cagaaaagttaccacag

SEQ ID NO: 54376 - DNA, 19 bp, Homo sapiens
cagaaaagttaccacaggg

SEQ ID NO: 54377 - DNA, 20 bp, Homo sapiens
cagaaaagttaccacaggga

SEQ ID NO: 54378 - DNA, 21 bp, Homo sapiens
cagaaaagttaccacagggat

SEQ ID NO: 54379 - DNA, 18 bp, Homo sapiens
gaaaagttaccacaggga

SEQ ID NO: 54380 - DNA, 23 bp, Homo sapiens
ttaccacagggataactggcttg

SEQ ID NO: 54381 - DNA, 21 bp, Homo sapiens
acagggataactggcttgtgg

SEQ ID NO: 54382 - DNA, 19 bp, Homo sapiens
cagggataactggcttgtg

SEQ ID NO: 54383 - DNA, 20 bp, Homo sapiens
cagggataactggcttgtgg

SEQ ID NO: 54384 - DNA, 22 bp, Homo sapiens
cagggataactggcttgtggcg

SEQ ID NO: 54385 - DNA, 18 bp, Homo sapiens
agggataactggcttgtg

SEQ ID NO: 54386 - DNA, 19 bp, Homo sapiens
agggataactggcttgtgg

SEQ ID NO: 54387 - DNA, 20 bp, Homo sapiens
agggataactggcttgtggc

SEQ ID NO: 54388 - DNA, 21 bp, Homo sapiens
agggataactggcttgtggcg

SEQ ID NO: 54389 - DNA, 22 bp, Homo sapiens
agggataactggcttgtggcgg

SEQ ID NO: 54390 - DNA, 23 bp, Homo sapiens
agggataactggcttgtggcggc

SEQ ID NO: 54391 - DNA, 17 bp, Homo sapiens
gggataactggcttgtg

SEQ ID NO: 54392 - DNA, 18 bp, Homo sapiens
gggataactggcttgtgg

SEQ ID NO: 54393 - DNA, 19 bp, Homo sapiens
gggataactggcttgtggc

SEQ ID NO: 54394 - DNA, 20 bp, Homo sapiens
gggataactggcttgtggcg

SEQ ID NO: 54395 - DNA, 21 bp, Homo sapiens
gggataactggcttgtggcgg

SEQ ID NO: 54396 - DNA, 22 bp, Homo sapiens
gggataactggcttgtggcggc

SEQ ID NO: 54397 - DNA, 17 bp, Homo sapiens
ggataactggcttgtgg

SEQ ID NO: 54398 - DNA, 17 bp, Homo sapiens
cggccaagcgttcatag

SEQ ID NO: 54399 - DNA, 19 bp, Homo sapiens
cggccaagcgttcatagcg

SEQ ID NO: 54400 - DNA, 30 bp, Homo sapiens
gccaagcgttcatagcgacgtcgctttttg

SEQ ID NO: 54401 - DNA, 27 bp, Homo sapiens
aagcgttcatagcgacgtcgctttttg

SEQ ID NO: 54402 - DNA, 30 bp, Homo sapiens
aagcgttcatagcgacgtcgctttttgatc

SEQ ID NO: 54403 - DNA, 20 bp, Homo sapiens
gcgttcatagcgacgtcgct

SEQ ID NO: 54404 - DNA, 21 bp, Homo sapiens
gcgttcatagcgacgtcgctt

SEQ ID NO: 54405 - DNA, 22 bp, Homo sapiens
gcgttcatagcgacgtcgcttt

SEQ ID NO: 54406 - DNA, 23 bp, Homo sapiens
gcgttcatagcgacgtcgctttt

SEQ ID NO: 54407 - DNA, 25 bp, Homo sapiens
gcgttcatagcgacgtcgctttttg

SEQ ID NO: 54408 - DNA, 26 bp, Homo sapiens
gcgttcatagcgacgtcgctttttga

SEQ ID NO: 54409 - DNA, 16 bp, Homo sapiens
cgttcatagcgacgtc

SEQ ID NO: 54410 - DNA, 17 bp, Homo sapiens
cgttcatagcgacgtcg

SEQ ID NO: 54411 - DNA, 18 bp, Homo sapiens
cgttcatagcgacgtcgc

SEQ ID NO: 54412 - DNA, 19 bp, Homo sapiens
cgttcatagcgacgtcgct

SEQ ID NO: 54413 - DNA, 24 bp, Homo sapiens
cgttcatagcgacgtcgctttttg

SEQ ID NO: 54414 - DNA, 16 bp, Homo sapiens
gttcatagcgacgtcg

SEQ ID NO: 54415 - DNA, 18 bp, Homo sapiens
gttcatagcgacgtcgct

SEQ ID NO: 54416 - DNA, 20 bp, Homo sapiens
gttcatagcgacgtcgcttt

SEQ ID NO: 54417 - DNA, 21 bp, Homo sapiens
gttcatagcgacgtcgctttt

SEQ ID NO: 54418 - DNA, 23 bp, Homo sapiens
gttcatagcgacgtcgctttttg

SEQ ID NO: 54419 - DNA, 17 bp, Homo sapiens
ttcatagcgacgtcgct

SEQ ID NO: 54420 - DNA, 22 bp, Homo sapiens
ttcatagcgacgtcgctttttg

SEQ ID NO: 54421 - DNA, 25 bp, Homo sapiens
ttcatagcgacgtcgctttttgatc

SEQ ID NO: 54422 - DNA, 18 bp, Homo sapiens
tcatagcgacgtcgcttt

SEQ ID NO: 54423 - DNA, 19 bp, Homo sapiens
tcatagcgacgtcgctttt

SEQ ID NO: 54424 - DNA, 20 bp, Homo sapiens
tcatagcgacgtcgcttttt

SEQ ID NO: 54425 - DNA, 21 bp, Homo sapiens
tcatagcgacgtcgctttttg

SEQ ID NO: 54426 - DNA, 22 bp, Homo sapiens
tcatagcgacgtcgctttttga

SEQ ID NO: 54427 - DNA, 24 bp, Homo sapiens
tcatagcgacgtcgctttttgatc

SEQ ID NO: 54428 - DNA, 23 bp, Homo sapiens
catagcgacgtcgctttttgatc

SEQ ID NO: 54429 - DNA, 16 bp, Homo sapiens
atagcgacgtcgcttt

SEQ ID NO: 54430 - DNA, 17 bp, Homo sapiens
atagcgacgtcgctttt

SEQ ID NO: 54431 - DNA, 18 bp, Homo sapiens
atagcgacgtcgcttttt

SEQ ID NO: 54432 - DNA, 19 bp, Homo sapiens
atagcgacgtcgctttttg

SEQ ID NO: 54433 - DNA, 20 bp, Homo sapiens
atagcgacgtcgctttttga

SEQ ID NO: 54434 - DNA, 21 bp, Homo sapiens
atagcgacgtcgctttttgat

SEQ ID NO: 54435 - DNA, 22 bp, Homo sapiens
atagcgacgtcgctttttgatc

SEQ ID NO: 54436 - DNA, 23 bp, Homo sapiens
atagcgacgtcgctttttgatcc

SEQ ID NO: 54437 - DNA, 24 bp, Homo sapiens
atagcgacgtcgctttttgatcct

SEQ ID NO: 54438 - DNA, 25 bp, Homo sapiens
atagcgacgtcgctttttgatcctt

SEQ ID NO: 54439 - DNA, 26 bp, Homo sapiens
atagcgacgtcgctttttgatccttc

SEQ ID NO: 54440 - DNA, 27 bp, Homo sapiens
atagcgacgtcgctttttgatccttcg

SEQ ID NO: 54441 - DNA, 29 bp, Homo sapiens
atagcgacgtcgctttttgatccttcgat

SEQ ID NO: 54442 - DNA, 30 bp, Homo sapiens
atagcgacgtcgctttttgatccttcgatg

SEQ ID NO: 54443 - DNA, 18 bp, Homo sapiens
tagcgacgtcgctttttg

SEQ ID NO: 54444 - DNA, 19 bp, Homo sapiens
tagcgacgtcgctttttga

SEQ ID NO: 54445 - DNA, 20 bp, Homo sapiens
tagcgacgtcgctttttgat

SEQ ID NO: 54446 - DNA, 21 bp, Homo sapiens
tagcgacgtcgctttttgatc

SEQ ID NO: 54447 - DNA, 22 bp, Homo sapiens
tagcgacgtcgctttttgatcc

SEQ ID NO: 54448 - DNA, 23 bp, Homo sapiens
tagcgacgtcgctttttgatcct

SEQ ID NO: 54449 - DNA, 24 bp, Homo sapiens
tagcgacgtcgctttttgatcctt

SEQ ID NO: 54450 - DNA, 25 bp, Homo sapiens
tagcgacgtcgctttttgatccttc

SEQ ID NO: 54451 - DNA, 26 bp, Homo sapiens
tagcgacgtcgctttttgatccttcg

SEQ ID NO: 54452 - DNA, 27 bp, Homo sapiens
tagcgacgtcgctttttgatccttcga

SEQ ID NO: 54453 - DNA, 29 bp, Homo sapiens
tagcgacgtcgctttttgatccttcgatg

SEQ ID NO: 54454 - DNA, 16 bp, Homo sapiens
agcgacgtcgcttttt

SEQ ID NO: 54455 - DNA, 17 bp, Homo sapiens
agcgacgtcgctttttg

SEQ ID NO: 54456 - DNA, 19 bp, Homo sapiens
agcgacgtcgctttttgat

SEQ ID NO: 54457 - DNA, 20 bp, Homo sapiens
agcgacgtcgctttttgatc

SEQ ID NO: 54458 - DNA, 21 bp, Homo sapiens
agcgacgtcgctttttgatcc

SEQ ID NO: 54459 - DNA, 22 bp, Homo sapiens
agcgacgtcgctttttgatcct

SEQ ID NO: 54460 - DNA, 23 bp, Homo sapiens
agcgacgtcgctttttgatcctt

SEQ ID NO: 54461 - DNA, 24 bp, Homo sapiens
agcgacgtcgctttttgatccttc

SEQ ID NO: 54462 - DNA, 25 bp, Homo sapiens
agcgacgtcgctttttgatccttcg

SEQ ID NO: 54463 - DNA, 26 bp, Homo sapiens
agcgacgtcgctttttgatccttcga

SEQ ID NO: 54464 - DNA, 30 bp, Homo sapiens
agcgacgtcgctttttgatccttcgatgtc

SEQ ID NO: 54465 - DNA, 16 bp, Homo sapiens
gcgacgtcgctttttg

SEQ ID NO: 54466 - DNA, 19 bp, Homo sapiens
gcgacgtcgctttttgatc

SEQ ID NO: 54467 - DNA, 20 bp, Homo sapiens
gcgacgtcgctttttgatcc

SEQ ID NO: 54468 - DNA, 21 bp, Homo sapiens
gcgacgtcgctttttgatcct

SEQ ID NO: 54469 - DNA, 22 bp, Homo sapiens
gcgacgtcgctttttgatcctt

SEQ ID NO: 54470 - DNA, 23 bp, Homo sapiens
gcgacgtcgctttttgatccttc

SEQ ID NO: 54471 - DNA, 24 bp, Homo sapiens
gcgacgtcgctttttgatccttcg

SEQ ID NO: 54472 - DNA, 25 bp, Homo sapiens
gcgacgtcgctttttgatccttcga

SEQ ID NO: 54473 - DNA, 16 bp, Homo sapiens
cgacgtcgctttttga

SEQ ID NO: 54474 - DNA, 18 bp, Homo sapiens
cgacgtcgctttttgatc

SEQ ID NO: 54475 - DNA, 19 bp, Homo sapiens
cgacgtcgctttttgatcc

SEQ ID NO: 54476 - DNA, 20 bp, Homo sapiens
cgacgtcgctttttgatcct

SEQ ID NO: 54477 - DNA, 21 bp, Homo sapiens
cgacgtcgctttttgatcctt

SEQ ID NO: 54478 - DNA, 22 bp, Homo sapiens
cgacgtcgctttttgatccttc

SEQ ID NO: 54479 - DNA, 23 bp, Homo sapiens
cgacgtcgctttttgatccttcg

SEQ ID NO: 54480 - DNA, 24 bp, Homo sapiens
cgacgtcgctttttgatccttcga

SEQ ID NO: 54481 - DNA, 17 bp, Homo sapiens
gacgtcgctttttgatc

SEQ ID NO: 54482 - DNA, 18 bp, Homo sapiens
gacgtcgctttttgatcc

SEQ ID NO: 54483 - DNA, 19 bp, Homo sapiens
gacgtcgctttttgatcct

SEQ ID NO: 54484 - DNA, 20 bp, Homo sapiens
gacgtcgctttttgatcctt

SEQ ID NO: 54485 - DNA, 21 bp, Homo sapiens
gacgtcgctttttgatccttc

SEQ ID NO: 54486 - DNA, 22 bp, Homo sapiens
gacgtcgctttttgatccttcg

SEQ ID NO: 54487 - DNA, 25 bp, Homo sapiens
gacgtcgctttttgatccttcgatg

SEQ ID NO: 54488 - DNA, 16 bp, Homo sapiens
acgtcgctttttgatc

SEQ ID NO: 54489 - DNA, 21 bp, Homo sapiens
acgtcgctttttgatccttcg

SEQ ID NO: 54490 - DNA, 28 bp, Homo sapiens
acgtcgctttttgatccttcgatgtcgg

SEQ ID NO: 54491 - DNA, 20 bp, Homo sapiens
cgtcgctttttgatccttcg

SEQ ID NO: 54492 - DNA, 21 bp, Homo sapiens
cgtcgctttttgatccttcga

SEQ ID NO: 54493 - DNA, 23 bp, Homo sapiens
cgtcgctttttgatccttcgatg

SEQ ID NO: 54494 - DNA, 26 bp, Homo sapiens
cgtcgctttttgatccttcgatgtcg

SEQ ID NO: 54495 - DNA, 27 bp, Homo sapiens
cgtcgctttttgatccttcgatgtcgg

SEQ ID NO: 54496 - DNA, 18 bp, Homo sapiens
gtcgctttttgatccttc

SEQ ID NO: 54497 - DNA, 19 bp, Homo sapiens
gtcgctttttgatccttcg

SEQ ID NO: 54498 - DNA, 21 bp, Homo sapiens
gtcgctttttgatccttcgat

SEQ ID NO: 54499 - DNA, 22 bp, Homo sapiens
gtcgctttttgatccttcgatg

SEQ ID NO: 54500 - DNA, 30 bp, Homo sapiens
gtcgctttttgatccttcgatgtcggctct

SEQ ID NO: 54501 - DNA, 18 bp, Homo sapiens
tcgctttttgatccttcg

SEQ ID NO: 54502 - DNA, 19 bp, Homo sapiens
tcgctttttgatccttcga

SEQ ID NO: 54503 - DNA, 20 bp, Homo sapiens
tcgctttttgatccttcgat

SEQ ID NO: 54504 - DNA, 21 bp, Homo sapiens
tcgctttttgatccttcgatg

SEQ ID NO: 54505 - DNA, 22 bp, Homo sapiens
tcgctttttgatccttcgatgt

SEQ ID NO: 54506 - DNA, 24 bp, Homo sapiens
tcgctttttgatccttcgatgtcg

SEQ ID NO: 54507 - DNA, 25 bp, Homo sapiens
tcgctttttgatccttcgatgtcgg

SEQ ID NO: 54508 - DNA, 27 bp, Homo sapiens
tcgctttttgatccttcgatgtcggct

SEQ ID NO: 54509 - DNA, 28 bp, Homo sapiens
tcgctttttgatccttcgatgtcggctc

SEQ ID NO: 54510 - DNA, 29 bp, Homo sapiens
tcgctttttgatccttcgatgtcggctct

SEQ ID NO: 54511 - DNA, 30 bp, Homo sapiens
tcgctttttgatccttcgatgtcggctctt

SEQ ID NO: 54512 - DNA, 19 bp, Homo sapiens
cgctttttgatccttcgat

SEQ ID NO: 54513 - DNA, 20 bp, Homo sapiens
cgctttttgatccttcgatg

SEQ ID NO: 54514 - DNA, 21 bp, Homo sapiens
cgctttttgatccttcgatgt

SEQ ID NO: 54515 - DNA, 23 bp, Homo sapiens
cgctttttgatccttcgatgtcg

SEQ ID NO: 54516 - DNA, 24 bp, Homo sapiens
cgctttttgatccttcgatgtcgg

SEQ ID NO: 54517 - DNA, 27 bp, Homo sapiens
cgctttttgatccttcgatgtcggctc

SEQ ID NO: 54518 - DNA, 16 bp, Homo sapiens
gctttttgatccttcg

SEQ ID NO: 54519 - DNA, 18 bp, Homo sapiens
gctttttgatccttcgat

SEQ ID NO: 54520 - DNA, 19 bp, Homo sapiens
gctttttgatccttcgatg

SEQ ID NO: 54521 - DNA, 20 bp, Homo sapiens
gctttttgatccttcgatgt

SEQ ID NO: 54522 - DNA, 21 bp, Homo sapiens
gctttttgatccttcgatgtc

SEQ ID NO: 54523 - DNA, 22 bp, Homo sapiens
gctttttgatccttcgatgtcg

SEQ ID NO: 54524 - DNA, 23 bp, Homo sapiens
gctttttgatccttcgatgtcgg

SEQ ID NO: 54525 - DNA, 24 bp, Homo sapiens
gctttttgatccttcgatgtcggc

SEQ ID NO: 54526 - DNA, 25 bp, Homo sapiens
gctttttgatccttcgatgtcggct

SEQ ID NO: 54527 - DNA, 26 bp, Homo sapiens
gctttttgatccttcgatgtcggctc

SEQ ID NO: 54528 - DNA, 27 bp, Homo sapiens
gctttttgatccttcgatgtcggctct

SEQ ID NO: 54529 - DNA, 28 bp, Homo sapiens
gctttttgatccttcgatgtcggctctt

SEQ ID NO: 54530 - DNA, 29 bp, Homo sapiens
gctttttgatccttcgatgtcggctcttc

SEQ ID NO: 54531 - DNA, 30 bp, Homo sapiens; identical to SEQ ID NO: 6029

SEQ ID NO: 54532 - DNA, 16 bp, Homo sapiens
ctttttgatccttcga

SEQ ID NO: 54533 - DNA, 18 bp, Homo sapiens
ctttttgatccttcgatg

SEQ ID NO: 54534 - DNA, 19 bp, Homo sapiens
ctttttgatccttcgatgt

SEQ ID NO: 54535 - DNA, 20 bp, Homo sapiens
ctttttgatccttcgatgtc

SEQ ID NO: 54536 - DNA, 21 bp, Homo sapiens
ctttttgatccttcgatgtcg

SEQ ID NO: 54537 - DNA, 22 bp, Homo sapiens
ctttttgatccttcgatgtcgg

SEQ ID NO: 54538 - DNA, 23 bp, Homo sapiens
ctttttgatccttcgatgtcggc

SEQ ID NO: 54539 - DNA, 24 bp, Homo sapiens
ctttttgatccttcgatgtcggct

SEQ ID NO: 54540 - DNA, 25 bp, Homo sapiens
ctttttgatccttcgatgtcggctc

SEQ ID NO: 54541 - DNA, 26 bp, Homo sapiens
ctttttgatccttcgatgtcggctct

SEQ ID NO: 54542 - DNA, 27 bp, Homo sapiens
ctttttgatccttcgatgtcggctctt

SEQ ID NO: 54543 - DNA, 28 bp, Homo sapiens
ctttttgatccttcgatgtcggctcttc

SEQ ID NO: 54544 - DNA, 29 bp, Homo sapiens
ctttttgatccttcgatgtcggctcttcc

SEQ ID NO: 54545 - DNA, 30 bp, Homo sapiens; identical to SEQ ID NO: 6031

SEQ ID NO: 54546 - DNA, 16 bp, Homo sapiens
tttttgatccttcgat

SEQ ID NO: 54547 - DNA, 17 bp, Homo sapiens
tttttgatccttcgatg

SEQ ID NO: 54548 - DNA, 18 bp, Homo sapiens
tttttgatccttcgatgt

SEQ ID NO: 54549 - DNA, 19 bp, Homo sapiens
tttttgatccttcgatgtc

SEQ ID NO: 54550 - DNA, 20 bp, Homo sapiens
tttttgatccttcgatgtcg

SEQ ID NO: 54551 - DNA, 21 bp, Homo sapiens
tttttgatccttcgatgtcgg

SEQ ID NO: 54552 - DNA, 22 bp, Homo sapiens
tttttgatccttcgatgtcggc

SEQ ID NO: 54553 - DNA, 23 bp, Homo sapiens
tttttgatccttcgatgtcggct

SEQ ID NO: 54554 - DNA, 24 bp, Homo sapiens
tttttgatccttcgatgtcggctc

SEQ ID NO: 54555 - DNA, 25 bp, Homo sapiens
tttttgatccttcgatgtcggctct

SEQ ID NO: 54556 - DNA, 26 bp, Homo sapiens
tttttgatccttcgatgtcggctctt

SEQ ID NO: 54557 - DNA, 27 bp, Homo sapiens
tttttgatccttcgatgtcggctcttc

SEQ ID NO: 54558 - DNA, 28 bp, Homo sapiens
tttttgatccttcgatgtcggctcttcc

SEQ ID NO: 54559 - DNA, 16 bp, Homo sapiens
ttttgatccttcgatg

SEQ ID NO: 54560 - DNA, 17 bp, Homo sapiens
ttttgatccttcgatgt

SEQ ID NO: 54561 - DNA, 18 bp, Homo sapiens
ttttgatccttcgatgtc

SEQ ID NO: 54562 - DNA, 19 bp, Homo sapiens
ttttgatccttcgatgtcg

SEQ ID NO: 54563 - DNA, 20 bp, Homo sapiens
ttttgatccttcgatgtcgg

SEQ ID NO: 54564 - DNA, 21 bp, Homo sapiens
ttttgatccttcgatgtcggc

SEQ ID NO: 54565 - DNA, 22 bp, Homo sapiens
ttttgatccttcgatgtcggct

SEQ ID NO: 54566 - DNA, 23 bp, Homo sapiens
ttttgatccttcgatgtcggctc

SEQ ID NO: 54567 - DNA, 24 bp, Homo sapiens
ttttgatccttcgatgtcggctct

SEQ ID NO: 54568 - DNA, 25 bp, Homo sapiens
ttttgatccttcgatgtcggctctt

SEQ ID NO: 54569 - DNA, 26 bp, Homo sapiens
ttttgatccttcgatgtcggctcttc

SEQ ID NO: 54570 - DNA, 27 bp, Homo sapiens
ttttgatccttcgatgtcggctcttcc

SEQ ID NO: 54571 - DNA, 28 bp, Homo sapiens
ttttgatccttcgatgtcggctcttcct

SEQ ID NO: 54572 - DNA, 18 bp, Homo sapiens
tttgatccttcgatgtcg

SEQ ID NO: 54573 - DNA, 19 bp, Homo sapiens
tttgatccttcgatgtcgg

SEQ ID NO: 54574 - DNA, 21 bp, Homo sapiens
tttgatccttcgatgtcggct

SEQ ID NO: 54575 - DNA, 22 bp, Homo sapiens
tttgatccttcgatgtcggctc

SEQ ID NO: 54576 - DNA, 23 bp, Homo sapiens
tttgatccttcgatgtcggctct

SEQ ID NO: 54577 - DNA, 24 bp, Homo sapiens
tttgatccttcgatgtcggctctt

SEQ ID NO: 54578 - DNA, 25 bp, Homo sapiens
tttgatccttcgatgtcggctcttc

SEQ ID NO: 54579 - DNA, 26 bp, Homo sapiens
tttgatccttcgatgtcggctcttcc

SEQ ID NO: 54580 - DNA, 27 bp, Homo sapiens
tttgatccttcgatgtcggctcttcct

SEQ ID NO: 54581 - DNA, 18 bp, Homo sapiens
ttgatccttcgatgtcgg

SEQ ID NO: 54582 - DNA, 19 bp, Homo sapiens
ttgatccttcgatgtcggc

SEQ ID NO: 54583 - DNA, 20 bp, Homo sapiens
ttgatccttcgatgtcggct

SEQ ID NO: 54584 - DNA, 21 bp, Homo sapiens
ttgatccttcgatgtcggctc

SEQ ID NO: 54585 - DNA, 22 bp, Homo sapiens
ttgatccttcgatgtcggctct

SEQ ID NO: 54586 - DNA, 23 bp, Homo sapiens
ttgatccttcgatgtcggctctt

SEQ ID NO: 54587 - DNA, 24 bp, Homo sapiens
ttgatccttcgatgtcggctcttc

SEQ ID NO: 54588 - DNA, 25 bp, Homo sapiens
ttgatccttcgatgtcggctcttcc

SEQ ID NO: 54589 - DNA, 26 bp, Homo sapiens
ttgatccttcgatgtcggctcttcct

SEQ ID NO: 54590 - DNA, 29 bp, Homo sapiens
ttgatccttcgatgtcggctcttcctatc

SEQ ID NO: 54591 - DNA, 17 bp, Homo sapiens
tgatccttcgatgtcgg

SEQ ID NO: 54592 - DNA, 19 bp, Homo sapiens
tgatccttcgatgtcggct

SEQ ID NO: 54593 - DNA, 20 bp, Homo sapiens
tgatccttcgatgtcggctc

SEQ ID NO: 54594 - DNA, 21 bp, Homo sapiens
tgatccttcgatgtcggctct

SEQ ID NO: 54595 - DNA, 22 bp, Homo sapiens
tgatccttcgatgtcggctctt

SEQ ID NO: 54596 - DNA, 23 bp, Homo sapiens
tgatccttcgatgtcggctcttc

SEQ ID NO: 54597 - DNA, 24 bp, Homo sapiens
tgatccttcgatgtcggctcttcc

SEQ ID NO: 54598 - DNA, 25 bp, Homo sapiens
tgatccttcgatgtcggctcttcct

SEQ ID NO: 54599 - DNA, 28 bp, Homo sapiens
tgatccttcgatgtcggctcttcctatc

SEQ ID NO: 54600 - DNA, 16 bp, Homo sapiens
gatccttcgatgtcgg

SEQ ID NO: 54601 - DNA, 18 bp, Homo sapiens
gatccttcgatgtcggct

SEQ ID NO: 54602 - DNA, 19 bp, Homo sapiens
gatccttcgatgtcggctc

SEQ ID NO: 54603 - DNA, 20 bp, Homo sapiens
gatccttcgatgtcggctct

SEQ ID NO: 54604 - DNA, 21 bp, Homo sapiens
gatccttcgatgtcggctctt

SEQ ID NO: 54605 - DNA, 22 bp, Homo sapiens
gatccttcgatgtcggctcttc

SEQ ID NO: 54606 - DNA, 23 bp, Homo sapiens
gatccttcgatgtcggctcttcc

SEQ ID NO: 54607 - DNA, 24 bp, Homo sapiens
gatccttcgatgtcggctcttcct

SEQ ID NO: 54608 - DNA, 25 bp, Homo sapiens
gatccttcgatgtcggctcttccta

SEQ ID NO: 54609 - DNA, 27 bp, Homo sapiens
gatccttcgatgtcggctcttcctatc

SEQ ID NO: 54610 - DNA, 17 bp, Homo sapiens
atccttcgatgtcggct

SEQ ID NO: 54611 - DNA, 20 bp, Homo sapiens
atccttcgatgtcggctctt

SEQ ID NO: 54612 - DNA, 22 bp, Homo sapiens
atccttcgatgtcggctcttcc

SEQ ID NO: 54613 - DNA, 23 bp, Homo sapiens
atccttcgatgtcggctcttcct

SEQ ID NO: 54614 - DNA, 24 bp, Homo sapiens
atccttcgatgtcggctcttccta

SEQ ID NO: 54615 - DNA, 26 bp, Homo sapiens
atccttcgatgtcggctcttcctatc

SEQ ID NO: 54616 - DNA, 17 bp, Homo sapiens
tccttcgatgtcggctc

SEQ ID NO: 54617 - DNA, 18 bp, Homo sapiens
tccttcgatgtcggctct

SEQ ID NO: 54618 - DNA, 19 bp, Homo sapiens
tccttcgatgtcggctctt

SEQ ID NO: 54619 - DNA, 20 bp, Homo sapiens
tccttcgatgtcggctcttc

SEQ ID NO: 54620 - DNA, 21 bp, Homo sapiens
tccttcgatgtcggctcttcc

SEQ ID NO: 54621 - DNA, 22 bp, Homo sapiens
tccttcgatgtcggctcttcct

SEQ ID NO: 54622 - DNA, 23 bp, Homo sapiens
tccttcgatgtcggctcttccta

SEQ ID NO: 54623 - DNA, 24 bp, Homo sapiens
tccttcgatgtcggctcttcctat

SEQ ID NO: 54624 - DNA, 25 bp, Homo sapiens
tccttcgatgtcggctcttcctatc

SEQ ID NO: 54625 - DNA, 26 bp, Homo sapiens
tccttcgatgtcggctcttcctatca

SEQ ID NO: 54626 - DNA, 29 bp, Homo sapiens
tccttcgatgtcggctcttcctatcattg

SEQ ID NO: 54627 - DNA, 30 bp, Homo sapiens
tccttcgatgtcggctcttcctatcattgt

SEQ ID NO: 54628 - DNA, 17 bp, Homo sapiens
ccttcgatgtcggctct

SEQ ID NO: 54629 - DNA, 18 bp, Homo sapiens
ccttcgatgtcggctctt

SEQ ID NO: 54630 - DNA, 19 bp, Homo sapiens
ccttcgatgtcggctcttc

SEQ ID NO: 54631 - DNA, 20 bp, Homo sapiens
ccttcgatgtcggctcttcc

SEQ ID NO: 54632 - DNA, 21 bp, Homo sapiens
ccttcgatgtcggctcttcct

SEQ ID NO: 54633 - DNA, 22 bp, Homo sapiens
ccttcgatgtcggctcttccta

SEQ ID NO: 54634 - DNA, 23 bp, Homo sapiens
ccttcgatgtcggctcttcctat

SEQ ID NO: 54635 - DNA, 24 bp, Homo sapiens
ccttcgatgtcggctcttcctatc

SEQ ID NO: 54636 - DNA, 25 bp, Homo sapiens
ccttcgatgtcggctcttcctatca

SEQ ID NO: 54637 - DNA, 18 bp, Homo sapiens
cttcgatgtcggctcttc

SEQ ID NO: 54638 - DNA, 19 bp, Homo sapiens
cttcgatgtcggctcttcc

SEQ ID NO: 54639 - DNA, 20 bp, Homo sapiens
cttcgatgtcggctcttcct

SEQ ID NO: 54640 - DNA, 21 bp, Homo sapiens
cttcgatgtcggctcttccta

SEQ ID NO: 54641 - DNA, 22 bp, Homo sapiens
cttcgatgtcggctcttcctat

SEQ ID NO: 54642 - DNA, 23 bp, Homo sapiens
cttcgatgtcggctcttcctatc

SEQ ID NO: 54643 - DNA, 24 bp, Homo sapiens
cttcgatgtcggctcttcctatca

SEQ ID NO: 54644 - DNA, 16 bp, Homo sapiens
ttcgatgtcggctctt

SEQ ID NO: 54645 - DNA, 17 bp, Homo sapiens
ttcgatgtcggctcttc

SEQ ID NO: 54646 - DNA, 18 bp, Homo sapiens
ttcgatgtcggctcttcc

SEQ ID NO: 54647 - DNA, 19 bp, Homo sapiens
ttcgatgtcggctcttcct

SEQ ID NO: 54648 - DNA, 20 bp, Homo sapiens
ttcgatgtcggctcttccta

SEQ ID NO: 54649 - DNA, 21 bp, Homo sapiens
ttcgatgtcggctcttcctat

SEQ ID NO: 54650 - DNA, 22 bp, Homo sapiens
ttcgatgtcggctcttcctatc

SEQ ID NO: 54651 - DNA, 23 bp, Homo sapiens
ttcgatgtcggctcttcctatca

SEQ ID NO: 54652 - DNA, 26 bp, Homo sapiens
ttcgatgtcggctcttcctatcattg

SEQ ID NO: 54653 - DNA, 28 bp, Homo sapiens
ttcgatgtcggctcttcctatcattgtg

SEQ ID NO: 54654 - DNA, 29 bp, Homo sapiens
ttcgatgtcggctcttcctatcattgtga

SEQ ID NO: 54655 - DNA, 16 bp, Homo sapiens
tcgatgtcggctcttc

SEQ ID NO: 54656 - DNA, 17 bp, Homo sapiens
tcgatgtcggctcttcc

SEQ ID NO: 54657 - DNA, 18 bp, Homo sapiens
tcgatgtcggctcttcct

SEQ ID NO: 54658 - DNA, 19 bp, Homo sapiens
tcgatgtcggctcttccta

SEQ ID NO: 54659 - DNA, 20 bp, Homo sapiens
tcgatgtcggctcttcctat

SEQ ID NO: 54660 - DNA, 21 bp, Homo sapiens
tcgatgtcggctcttcctatc

SEQ ID NO: 54661 - DNA, 22 bp, Homo sapiens
tcgatgtcggctcttcctatca

SEQ ID NO: 54662 - DNA, 25 bp, Homo sapiens
tcgatgtcggctcttcctatcattg

SEQ ID NO: 54663 - DNA, 30 bp, Homo sapiens
tcgatgtcggctcttcctatcattgtgaag

SEQ ID NO: 54664 - DNA, 17 bp, Homo sapiens
cgatgtcggctcttcct

SEQ ID NO: 54665 - DNA, 19 bp, Homo sapiens
cgatgtcggctcttcctat

SEQ ID NO: 54666 - DNA, 20 bp, Homo sapiens
cgatgtcggctcttcctatc

SEQ ID NO: 54667 - DNA, 21 bp, Homo sapiens
cgatgtcggctcttcctatca

SEQ ID NO: 54668 - DNA, 22 bp, Homo sapiens
cgatgtcggctcttcctatcat

SEQ ID NO: 54669 - DNA, 24 bp, Homo sapiens
cgatgtcggctcttcctatcattg

SEQ ID NO: 54670 - DNA, 16 bp, Homo sapiens
gatgtcggctcttcct

SEQ ID NO: 54671 - DNA, 18 bp, Homo sapiens
gatgtcggctcttcctat

SEQ ID NO: 54672 - DNA, 19 bp, Homo sapiens
gatgtcggctcttcctatc

SEQ ID NO: 54673 - DNA, 20 bp, Homo sapiens
gatgtcggctcttcctatca

SEQ ID NO: 54674 - DNA, 21 bp, Homo sapiens
gatgtcggctcttcctatcat

SEQ ID NO: 54675 - DNA, 29 bp, Homo sapiens
gatgtcggctcttcctatcattgtgaagc

SEQ ID NO: 54676 - DNA, 17 bp, Homo sapiens
atgtcggctcttcctat

SEQ ID NO: 54677 - DNA, 18 bp, Homo sapiens
atgtcggctcttcctatc

SEQ ID NO: 54678 - DNA, 19 bp, Homo sapiens
atgtcggctcttcctatca

SEQ ID NO: 54679 - DNA, 20 bp, Homo sapiens
atgtcggctcttcctatcat

SEQ ID NO: 54680 - DNA, 21 bp, Homo sapiens
atgtcggctcttcctatcatt

SEQ ID NO: 54681 - DNA, 22 bp, Homo sapiens
atgtcggctcttcctatcattg

SEQ ID NO: 54682 - DNA, 24 bp, Homo sapiens
atgtcggctcttcctatcattgtg

SEQ ID NO: 54683 - DNA, 25 bp, Homo sapiens
atgtcggctcttcctatcattgtga

SEQ ID NO: 54684 - DNA, 30 bp, Homo sapiens; identical to SEQ ID NO: 6111

SEQ ID NO: 54685 - DNA, 21 bp, Homo sapiens
tgtcggctcttcctatcattg

SEQ ID NO: 54686 - DNA, 18 bp, Homo sapiens
gtcggctcttcctatcat

SEQ ID NO: 54687 - DNA, 19 bp, Homo sapiens
gtcggctcttcctatcatt

SEQ ID NO: 54688 - DNA, 20 bp, Homo sapiens
gtcggctcttcctatcattg

SEQ ID NO: 54689 - DNA, 22 bp, Homo sapiens
gtcggctcttcctatcattgtg

SEQ ID NO: 54690 - DNA, 30 bp, Homo sapiens
ttctgcttcacaatgataggaagagccgac

SEQ ID NO: 54691 - DNA, 19 bp, Homo sapiens
tcggctcttcctatcattg

SEQ ID NO: 54692 - DNA, 28 bp, Homo sapiens
tcggctcttcctatcattgtgaagcaga

SEQ ID NO: 54693 - DNA, 18 bp, Homo sapiens
cggctcttcctatcattg

SEQ ID NO: 54694 - DNA, 20 bp, Homo sapiens
cggctcttcctatcattgtg

SEQ ID NO: 54695 - DNA, 24 bp, Homo sapiens
cggctcttcctatcattgtgaagc

SEQ ID NO: 54696 - DNA, 23 bp, Homo sapiens
ggctcttcctatcattgtgaagc

SEQ ID NO: 54697 - DNA, 17 bp, Homo sapiens
ctcttcctatcattgtg

SEQ ID NO: 54698 - DNA, 21 bp, Homo sapiens
ctcttcctatcattgtgaagc

SEQ ID NO: 54699 - DNA, 30 bp, Homo sapiens
ctcttcctatcattgtgaagcagaattcac

SEQ ID NO: 54700 - DNA, 30 bp, Homo sapiens
tatcattgtgaagcagaattcaccaagcgt

SEQ ID NO: 54701 - DNA, 30 bp, Homo sapiens
atcattgtgaagcagaattcaccaagcgtt

SEQ ID NO: 54702 - DNA, 30 bp, Homo sapiens
tcattgtgaagcagaattcaccaagcgttg

SEQ ID NO: 54703 - DNA, 30 bp, Homo sapiens
cattgtgaagcagaattcaccaagcgttgg

SEQ ID NO: 54704 - DNA, 28 bp, Homo sapiens
attgtgaagcagaattcaccaagcgttg

SEQ ID NO: 54705 - DNA, 29 bp, Homo sapiens
attgtgaagcagaattcaccaagcgttgg

SEQ ID NO: 54706 - DNA, 19 bp, Homo sapiens
ttgtgaagcagaattcacc

SEQ ID NO: 54707 - DNA, 23 bp, Homo sapiens
ttgtgaagcagaattcaccaagc

SEQ ID NO: 54708 - DNA, 28 bp, Homo sapiens
ttgtgaagcagaattcaccaagcgttgg

SEQ ID NO: 54709 - DNA, 30 bp, Homo sapiens; identical to SEQ ID NO: 27087

SEQ ID NO: 54710 - DNA, 30 bp, Homo sapiens
tgtgaagcagaattcaccaagcgttggatt

SEQ ID NO: 54711 - DNA, 30 bp, Homo sapiens; identical to SEQ ID NO: 30884

SEQ ID NO: 54712 - DNA, 19 bp, Homo sapiens
tgaagcagaattcaccaag

SEQ ID NO: 54713 - DNA, 27 bp, Homo sapiens
tgaagcagaattcaccaagcgttggat

SEQ ID NO: 54714 - DNA, 30 bp, Homo sapiens
tgaagcagaattcaccaagcgttggattgt

SEQ ID NO: 54715 - DNA, 29 bp, Homo sapiens
gaagcagaattcaccaagcgttggattgt

SEQ ID NO: 54716 - DNA, 30 bp, Homo sapiens
gaagcagaattcaccaagcgttggattgtt

SEQ ID NO: 54717 - DNA, 23 bp, Homo sapiens
aagcagaattcaccaagcgttgg

SEQ ID NO: 54718 - DNA, 28 bp, Homo sapiens
aagcagaattcaccaagcgttggattgt

SEQ ID NO: 54719 - DNA, 29 bp, Homo sapiens
aagcagaattcaccaagcgttggattgtt

SEQ ID NO: 54720 - DNA, 30 bp, Homo sapiens; identical to SEQ ID NO: 6120

SEQ ID NO: 54721 - DNA, 22 bp, Homo sapiens
agcagaattcaccaagcgttgg

SEQ ID NO: 54722 - DNA, 26 bp, Homo sapiens
agcagaattcaccaagcgttggattg

SEQ ID NO: 54723 - DNA, 27 bp, Homo sapiens
agcagaattcaccaagcgttggattgt

SEQ ID NO: 54724 - DNA, 28 bp, Homo sapiens
agcagaattcaccaagcgttggattgtt

SEQ ID NO: 54725 - DNA, 29 bp, Homo sapiens
agcagaattcaccaagcgttggattgttc

SEQ ID NO: 54726 - DNA, 16 bp, Homo sapiens
gcagaattcaccaagc

SEQ ID NO: 54727 - DNA, 18 bp, Homo sapiens
gcagaattcaccaagcgt

SEQ ID NO: 54728 - DNA, 19 bp, Homo sapiens
gcagaattcaccaagcgtt

SEQ ID NO: 54729 - DNA, 20 bp, Homo sapiens
gcagaattcaccaagcgttg

SEQ ID NO: 54730 - DNA, 21 bp, Homo sapiens
gcagaattcaccaagcgttgg

SEQ ID NO: 54731 - DNA, 22 bp, Homo sapiens
gcagaattcaccaagcgttgga

SEQ ID NO: 54732 - DNA, 23 bp, Homo sapiens
gcagaattcaccaagcgttggat

SEQ ID NO: 54733 - DNA, 24 bp, Homo sapiens
gcagaattcaccaagcgttggatt

SEQ ID NO: 54734 - DNA, 25 bp, Homo sapiens
gcagaattcaccaagcgttggattg

SEQ ID NO: 54735 - DNA, 26 bp, Homo sapiens
gcagaattcaccaagcgttggattgt

SEQ ID NO: 54736 - DNA, 27 bp, Homo sapiens
gcagaattcaccaagcgttggattgtt

SEQ ID NO: 54737 - DNA, 28 bp, Homo sapiens
gcagaattcaccaagcgttggattgttc

SEQ ID NO: 54738 - DNA, 29 bp, Homo sapiens
gcagaattcaccaagcgttggattgttca

SEQ ID NO: 54739 - DNA, 30 bp, Homo sapiens; identical to SEQ ID NO: 30887

SEQ ID NO: 54740 - DNA, 16 bp, Homo sapiens
cagaattcaccaagcg

SEQ ID NO: 54741 - DNA, 17 bp, Homo sapiens
cagaattcaccaagcgt

SEQ ID NO: 54742 - DNA, 19 bp, Homo sapiens
cagaattcaccaagcgttg

SEQ ID NO: 54743 - DNA, 20 bp, Homo sapiens
cagaattcaccaagcgttgg

SEQ ID NO: 54744 - DNA, 21 bp, Homo sapiens
cagaattcaccaagcgttgga

SEQ ID NO: 54745 - DNA, 22 bp, Homo sapiens
cagaattcaccaagcgttggat

SEQ ID NO: 54746 - DNA, 24 bp, Homo sapiens
cagaattcaccaagcgttggattg

SEQ ID NO: 54747 - DNA, 25 bp, Homo sapiens
cagaattcaccaagcgttggattgt

SEQ ID NO: 54748 - DNA, 26 bp, Homo sapiens
cagaattcaccaagcgttggattgtt

SEQ ID NO: 54749 - DNA, 27 bp, Homo sapiens
cagaattcaccaagcgttggattgttc

SEQ ID NO: 54750 - DNA, 28 bp, Homo sapiens
cagaattcaccaagcgttggattgttca

SEQ ID NO: 54751 - DNA, 30 bp, Homo sapiens; identical to SEQ ID NO: 6130

SEQ ID NO: 54752 - DNA, 18 bp, Homo sapiens
agaattcaccaagcgttg

SEQ ID NO: 54753 - DNA, 19 bp, Homo sapiens
agaattcaccaagcgttgg

SEQ ID NO: 54754 - DNA, 20 bp, Homo sapiens
agaattcaccaagcgttgga

SEQ ID NO: 54755 - DNA, 21 bp, Homo sapiens
agaattcaccaagcgttggat

SEQ ID NO: 54756 - DNA, 22 bp, Homo sapiens
agaattcaccaagcgttggatt

SEQ ID NO: 54757 - DNA, 23 bp, Homo sapiens
agaattcaccaagcgttggattg

SEQ ID NO: 54758 - DNA, 24 bp, Homo sapiens
agaattcaccaagcgttggattgt

SEQ ID NO: 54759 - DNA, 25 bp, Homo sapiens
agaattcaccaagcgttggattgtt

SEQ ID NO: 54760 - DNA, 26 bp, Homo sapiens
agaattcaccaagcgttggattgttc

SEQ ID NO: 54761 - DNA, 27 bp, Homo sapiens
agaattcaccaagcgttggattgttca

SEQ ID NO: 54762 - DNA, 28 bp, Homo sapiens
agaattcaccaagcgttggattgttcac

SEQ ID NO: 54763 - DNA, 29 bp, Homo sapiens
agaattcaccaagcgttggattgttcacc

SEQ ID NO: 54764 - DNA, 30 bp, Homo sapiens; identical to SEQ ID NO: 6134

SEQ ID NO: 54765 - DNA, 16 bp, Homo sapiens
gaattcaccaagcgtt

SEQ ID NO: 54766 - DNA, 17 bp, Homo sapiens
gaattcaccaagcgttg

SEQ ID NO: 54767 - DNA, 18 bp, Homo sapiens
gaattcaccaagcgttgg

SEQ ID NO: 54768 - DNA, 19 bp, Homo sapiens
gaattcaccaagcgttgga

SEQ ID NO: 54769 - DNA, 20 bp, Homo sapiens
gaattcaccaagcgttggat

SEQ ID NO: 54770 - DNA, 21 bp, Homo sapiens
gaattcaccaagcgttggatt

SEQ ID NO: 54771 - DNA, 22 bp, Homo sapiens
gaattcaccaagcgttggattg

SEQ ID NO: 54772 - DNA, 23 bp, Homo sapiens
gaattcaccaagcgttggattgt

SEQ ID NO: 54773 - DNA, 24 bp, Homo sapiens
gaattcaccaagcgttggattgtt

SEQ ID NO: 54774 - DNA, 25 bp, Homo sapiens
gaattcaccaagcgttggattgttc

SEQ ID NO: 54775 - DNA, 26 bp, Homo sapiens
gaattcaccaagcgttggattgttca

SEQ ID NO: 54776 - DNA, 27 bp, Homo sapiens
gaattcaccaagcgttggattgttcac

SEQ ID NO: 54777 - DNA, 28 bp, Homo sapiens
gaattcaccaagcgttggattgttcacc

SEQ ID NO: 54778 - DNA, 29 bp, Homo sapiens
gaattcaccaagcgttggattgttcaccc

SEQ ID NO: 54779 - DNA, 16 bp, Homo sapiens
aattcaccaagcgttg

SEQ ID NO: 54780 - DNA, 17 bp, Homo sapiens
aattcaccaagcgttgg

SEQ ID NO: 54781 - DNA, 18 bp, Homo sapiens
aattcaccaagcgttgga

SEQ ID NO: 54782 - DNA, 19 bp, Homo sapiens
aattcaccaagcgttggat

SEQ ID NO: 54783 - DNA, 20 bp, Homo sapiens
aattcaccaagcgttggatt

SEQ ID NO: 54784 - DNA, 21 bp, Homo sapiens
aattcaccaagcgttggattg

SEQ ID NO: 54785 - DNA, 22 bp, Homo sapiens
aattcaccaagcgttggattgt

SEQ ID NO: 54786 - DNA, 23 bp, Homo sapiens
aattcaccaagcgttggattgtt

SEQ ID NO: 54787 - DNA, 24 bp, Homo sapiens
aattcaccaagcgttggattgttc

SEQ ID NO: 54788 - DNA, 25 bp, Homo sapiens
aattcaccaagcgttggattgttca

SEQ ID NO: 54789 - DNA, 26 bp, Homo sapiens
aattcaccaagcgttggattgttcac

SEQ ID NO: 54790 - DNA, 27 bp, Homo sapiens
aattcaccaagcgttggattgttcacc

SEQ ID NO: 54791 - DNA, 28 bp, Homo sapiens
aattcaccaagcgttggattgttcaccc

SEQ ID NO: 54792 - DNA, 29 bp, Homo sapiens
aattcaccaagcgttggattgttcaccca

SEQ ID NO: 54793 - DNA, 30 bp, Homo sapiens; identical to SEQ ID NO: 6150

SEQ ID NO: 54794 - DNA, 16 bp, Homo sapiens
attcaccaagcgttgg

SEQ ID NO: 54795 - DNA, 17 bp, Homo sapiens
attcaccaagcgttgga

SEQ ID NO: 54796 - DNA, 18 bp, Homo sapiens
attcaccaagcgttggat

SEQ ID NO: 54797 - DNA, 19 bp, Homo sapiens
attcaccaagcgttggatt

SEQ ID NO: 54798 - DNA, 20 bp, Homo sapiens
attcaccaagcgttggattg

SEQ ID NO: 54799 - DNA, 21 bp, Homo sapiens
attcaccaagcgttggattgt

SEQ ID NO: 54800 - DNA, 22 bp, Homo sapiens
attcaccaagcgttggattgtt

SEQ ID NO: 54801 - DNA, 23 bp, Homo sapiens
attcaccaagcgttggattgttc

SEQ ID NO: 54802 - DNA, 24 bp, Homo sapiens
attcaccaagcgttggattgttca

SEQ ID NO: 54803 - DNA, 25 bp, Homo sapiens
attcaccaagcgttggattgttcac

SEQ ID NO: 54804 - DNA, 26 bp, Homo sapiens
attcaccaagcgttggattgttcacc

SEQ ID NO: 54805 - DNA, 27 bp, Homo sapiens
attcaccaagcgttggattgttcaccc

SEQ ID NO: 54806 - DNA, 28 bp, Homo sapiens
attcaccaagcgttggattgttcaccca

SEQ ID NO: 54807 - DNA, 29 bp, Homo sapiens
attcaccaagcgttggattgttcacccac

SEQ ID NO: 54808 - DNA, 30 bp, Homo sapiens; identical to SEQ ID NO: 6157

SEQ ID NO: 54809 - DNA, 16 bp, Homo sapiens
ttcaccaagcgttgga

SEQ ID NO: 54810 - DNA, 17 bp, Homo sapiens
ttcaccaagcgttggat

SEQ ID NO: 54811 - DNA, 18 bp, Homo sapiens
ttcaccaagcgttggatt

SEQ ID NO: 54812 - DNA, 19 bp, Homo sapiens
ttcaccaagcgttggattg

SEQ ID NO: 54813 - DNA, 20 bp, Homo sapiens
ttcaccaagcgttggattgt

SEQ ID NO: 54814 - DNA, 21 bp, Homo sapiens
ttcaccaagcgttggattgtt

SEQ ID NO: 54815 - DNA, 22 bp, Homo sapiens
ttcaccaagcgttggattgttc

SEQ ID NO: 54816 - DNA, 23 bp, Homo sapiens
ttcaccaagcgttggattgttca

SEQ ID NO: 54817 - DNA, 24 bp, Homo sapiens
ttcaccaagcgttggattgttcac

SEQ ID NO: 54818 - DNA, 25 bp, Homo sapiens
ttcaccaagcgttggattgttcacc

SEQ ID NO: 54819 - DNA, 26 bp, Homo sapiens
ttcaccaagcgttggattgttcaccc

SEQ ID NO: 54820 - DNA, 27 bp, Homo sapiens
ttcaccaagcgttggattgttcaccca

SEQ ID NO: 54821 - DNA, 28 bp, Homo sapiens
ttcaccaagcgttggattgttcacccac

SEQ ID NO: 54822 - DNA, 29 bp, Homo sapiens
ttcaccaagcgttggattgttcacccact

SEQ ID NO: 54823 - DNA, 16 bp, Homo sapiens
tcaccaagcgttggat

SEQ ID NO: 54824 - DNA, 17 bp, Homo sapiens
tcaccaagcgttggatt

SEQ ID NO: 54825 - DNA, 18 bp, Homo sapiens
tcaccaagcgttggattg

SEQ ID NO: 54826 - DNA, 19 bp, Homo sapiens
tcaccaagcgttggattgt

SEQ ID NO: 54827 - DNA, 20 bp, Homo sapiens
tcaccaagcgttggattgtt

SEQ ID NO: 54828 - DNA, 21 bp, Homo sapiens
tcaccaagcgttggattgttc

SEQ ID NO: 54829 - DNA, 22 bp, Homo sapiens
tcaccaagcgttggattgttca

SEQ ID NO: 54830 - DNA, 23 bp, Homo sapiens
tcaccaagcgttggattgttcac

SEQ ID NO: 54831 - DNA, 24 bp, Homo sapiens
tcaccaagcgttggattgttcacc

SEQ ID NO: 54832 - DNA, 25 bp, Homo sapiens
tcaccaagcgttggattgttcaccc

SEQ ID NO: 54833 - DNA, 26 bp, Homo sapiens
tcaccaagcgttggattgttcaccca

SEQ ID NO: 54834 - DNA, 27 bp, Homo sapiens
tcaccaagcgttggattgttcacccac

SEQ ID NO: 54835 - DNA, 28 bp, Homo sapiens
tcaccaagcgttggattgttcacccact

SEQ ID NO: 54836 - DNA, 29 bp, Homo sapiens
tcaccaagcgttggattgttcacccacta

SEQ ID NO: 54837 - DNA, 17 bp, Homo sapiens
caccaagcgttggattg

SEQ ID NO: 54838 - DNA, 18 bp, Homo sapiens
caccaagcgttggattgt

SEQ ID NO: 54839 - DNA, 19 bp, Homo sapiens
caccaagcgttggattgtt

SEQ ID NO: 54840 - DNA, 20 bp, Homo sapiens
caccaagcgttggattgttc

SEQ ID NO: 54841 - DNA, 21 bp, Homo sapiens
caccaagcgttggattgttca

SEQ ID NO: 54842 - DNA, 22 bp, Homo sapiens
caccaagcgttggattgttcac

SEQ ID NO: 54843 - DNA, 23 bp, Homo sapiens
caccaagcgttggattgttcacc

SEQ ID NO: 54844 - DNA, 24 bp, Homo sapiens
caccaagcgttggattgttcaccc

SEQ ID NO: 54845 - DNA, 25 bp, Homo sapiens
caccaagcgttggattgttcaccca

SEQ ID NO: 54846 - DNA, 26 bp, Homo sapiens
caccaagcgttggattgttcacccac

SEQ ID NO: 54847 - DNA, 27 bp, Homo sapiens
caccaagcgttggattgttcacccact

SEQ ID NO: 54848 - DNA, 28 bp, Homo sapiens
caccaagcgttggattgttcacccacta

SEQ ID NO: 54849 - DNA, 29 bp, Homo sapiens
caccaagcgttggattgttcacccactaa

SEQ ID NO: 54850 - DNA, 16 bp, Homo sapiens
accaagcgttggattg

SEQ ID NO: 54851 - DNA, 17 bp, Homo sapiens
accaagcgttggattgt

SEQ ID NO: 54852 - DNA, 18 bp, Homo sapiens
accaagcgttggattgtt

SEQ ID NO: 54853 - DNA, 19 bp, Homo sapiens
accaagcgttggattgttc

SEQ ID NO: 54854 - DNA, 20 bp, Homo sapiens
accaagcgttggattgttca

SEQ ID NO: 54855 - DNA, 21 bp, Homo sapiens
accaagcgttggattgttcac

SEQ ID NO: 54856 - DNA, 22 bp, Homo sapiens
accaagcgttggattgttcacc

SEQ ID NO: 54857 - DNA, 23 bp, Homo sapiens
accaagcgttggattgttcaccc

SEQ ID NO: 54858 - DNA, 24 bp, Homo sapiens
accaagcgttggattgttcaccca

SEQ ID NO: 54859 - DNA, 25 bp, Homo sapiens
accaagcgttggattgttcacccac

SEQ ID NO: 54860 - DNA, 26 bp, Homo sapiens
accaagcgttggattgttcacccact

SEQ ID NO: 54861 - DNA, 27 bp, Homo sapiens
accaagcgttggattgttcacccacta

SEQ ID NO: 54862 - DNA, 16 bp, Homo sapiens
ccaagcgttggattgt

SEQ ID NO: 54863 - DNA, 17 bp, Homo sapiens
ccaagcgttggattgtt

SEQ ID NO: 54864 - DNA, 18 bp, Homo sapiens
ccaagcgttggattgttc

SEQ ID NO: 54865 - DNA, 19 bp, Homo sapiens
ccaagcgttggattgttca

SEQ ID NO: 54866 - DNA, 20 bp, Homo sapiens
ccaagcgttggattgttcac

SEQ ID NO: 54867 - DNA, 21 bp, Homo sapiens
ccaagcgttggattgttcacc

SEQ ID NO: 54868 - DNA, 22 bp, Homo sapiens
ccaagcgttggattgttcaccc

SEQ ID NO: 54869 - DNA, 23 bp, Homo sapiens
ccaagcgttggattgttcaccca

SEQ ID NO: 54870 - DNA, 24 bp, Homo sapiens
ccaagcgttggattgttcacccac

SEQ ID NO: 54871 - DNA, 25 bp, Homo sapiens
ccaagcgttggattgttcacccact

SEQ ID NO: 54872 - DNA, 26 bp, Homo sapiens
ccaagcgttggattgttcacccacta

SEQ ID NO: 54873 - DNA, 27 bp, Homo sapiens
ccaagcgttggattgttcacccactaa

SEQ ID NO: 54874 - DNA, 28 bp, Homo sapiens
ccaagcgttggattgttcacccactaat

SEQ ID NO: 54875 - DNA, 29 bp, Homo sapiens
ccaagcgttggattgttcacccactaata

SEQ ID NO: 54876 - DNA, 30 bp, Homo sapiens; identical to SEQ ID NO: 6197

SEQ ID NO: 54877 - DNA, 16 bp, Homo sapiens
caagcgttggattgtt

SEQ ID NO: 54878 - DNA, 17 bp, Homo sapiens
caagcgttggattgttc

SEQ ID NO: 54879 - DNA, 18 bp, Homo sapiens
caagcgttggattgttca

SEQ ID NO: 54880 - DNA, 19 bp, Homo sapiens
caagcgttggattgttcac

SEQ ID NO: 54881 - DNA, 20 bp, Homo sapiens
caagcgttggattgttcacc

SEQ ID NO: 54882 - DNA, 21 bp, Homo sapiens
caagcgttggattgttcaccc

SEQ ID NO: 54883 - DNA, 22 bp, Homo sapiens
caagcgttggattgttcaccca

SEQ ID NO: 54884 - DNA, 23 bp, Homo sapiens
caagcgttggattgttcacccac

SEQ ID NO: 54885 - DNA, 24 bp, Homo sapiens
caagcgttggattgttcacccact

SEQ ID NO: 54886 - DNA, 25 bp, Homo sapiens
caagcgttggattgttcacccacta

SEQ ID NO: 54887 - DNA, 26 bp, Homo sapiens
caagcgttggattgttcacccactaa

SEQ ID NO: 54888 - DNA, 27 bp, Homo sapiens
caagcgttggattgttcacccactaat

SEQ ID NO: 54889 - DNA, 28 bp, Homo sapiens
caagcgttggattgttcacccactaata

SEQ ID NO: 54890 - DNA, 30 bp, Homo sapiens; identical to SEQ ID NO: 6205

SEQ ID NO: 54891 - DNA, 16 bp, Homo sapiens
aagcgttggattgttc

SEQ ID NO: 54892 - DNA, 17 bp, Homo sapiens
aagcgttggattgttca

SEQ ID NO: 54893 - DNA, 18 bp, Homo sapiens
aagcgttggattgttcac

SEQ ID NO: 54894 - DNA, 19 bp, Homo sapiens
aagcgttggattgttcacc

SEQ ID NO: 54895 - DNA, 20 bp, Homo sapiens
aagcgttggattgttcaccc

SEQ ID NO: 54896 - DNA, 21 bp, Homo sapiens
aagcgttggattgttcaccca

SEQ ID NO: 54897 - DNA, 22 bp, Homo sapiens
aagcgttggattgttcacccac

SEQ ID NO: 54898 - DNA, 23 bp, Homo sapiens
aagcgttggattgttcacccact

SEQ ID NO: 54899 - DNA, 24 bp, Homo sapiens
aagcgttggattgttcacccacta

SEQ ID NO: 54900 - DNA, 25 bp, Homo sapiens
aagcgttggattgttcacccactaa

SEQ ID NO: 54901 - DNA, 26 bp, Homo sapiens
aagcgttggattgttcacccactaat

SEQ ID NO: 54902 - DNA, 27 bp, Homo sapiens
aagcgttggattgttcacccactaata

SEQ ID NO: 54903 - DNA, 28 bp, Homo sapiens
aagcgttggattgttcacccactaatag

SEQ ID NO: 54904 - DNA, 29 bp, Homo sapiens
aagcgttggattgttcacccactaatagg

SEQ ID NO: 54905 - DNA, 30 bp, Homo sapiens; identical to SEQ ID NO: 6219

SEQ ID NO: 54906 - DNA, 16 bp, Homo sapiens
agcgttggattgttca

SEQ ID NO: 54907 - DNA, 17 bp, Homo sapiens
agcgttggattgttcac

SEQ ID NO: 54908 - DNA, 18 bp, Homo sapiens
agcgttggattgttcacc

SEQ ID NO: 54909 - DNA, 19 bp, Homo sapiens
agcgttggattgttcaccc

SEQ ID NO: 54910 - DNA, 20 bp, Homo sapiens
agcgttggattgttcaccca

SEQ ID NO: 54911 - DNA, 21 bp, Homo sapiens
agcgttggattgttcacccac

SEQ ID NO: 54912 - DNA, 22 bp, Homo sapiens
agcgttggattgttcacccact

SEQ ID NO: 54913 - DNA, 23 bp, Homo sapiens
agcgttggattgttcacccacta

SEQ ID NO: 54914 - DNA, 24 bp, Homo sapiens
agcgttggattgttcacccactaa

SEQ ID NO: 54915 - DNA, 25 bp, Homo sapiens
agcgttggattgttcacccactaat

SEQ ID NO: 54916 - DNA, 26 bp, Homo sapiens
agcgttggattgttcacccactaata

SEQ ID NO: 54917 - DNA, 27 bp, Homo sapiens
agcgttggattgttcacccactaatag

SEQ ID NO: 54918 - DNA, 28 bp, Homo sapiens
agcgttggattgttcacccactaatagg

SEQ ID NO: 54919 - DNA, 29 bp, Homo sapiens
agcgttggattgttcacccactaataggg

SEQ ID NO: 54920 - DNA, 16 bp, Homo sapiens
gcgttggattgttcac

SEQ ID NO: 54921 - DNA, 17 bp, Homo sapiens
gcgttggattgttcacc

SEQ ID NO: 54922 - DNA, 18 bp, Homo sapiens
gcgttggattgttcaccc

SEQ ID NO: 54923 - DNA, 19 bp, Homo sapiens
gcgttggattgttcaccca

SEQ ID NO: 54924 - DNA, 20 bp, Homo sapiens
gcgttggattgttcacccac

SEQ ID NO: 54925 - DNA, 21 bp, Homo sapiens
gcgttggattgttcacccact

SEQ ID NO: 54926 - DNA, 22 bp, Homo sapiens
gcgttggattgttcacccacta

SEQ ID NO: 54927 - DNA, 23 bp, Homo sapiens
gcgttggattgttcacccactaa

SEQ ID NO: 54928 - DNA, 24 bp, Homo sapiens
gcgttggattgttcacccactaat

SEQ ID NO: 54929 - DNA, 25 bp, Homo sapiens
gcgttggattgttcacccactaata

SEQ ID NO: 54930 - DNA, 26 bp, Homo sapiens
gcgttggattgttcacccactaatag

SEQ ID NO: 54931 - DNA, 27 bp, Homo sapiens
gcgttggattgttcacccactaatagg

SEQ ID NO: 54932 - DNA, 28 bp, Homo sapiens
gcgttggattgttcacccactaataggg

SEQ ID NO: 54933 - DNA, 29 bp, Homo sapiens
gcgttggattgttcacccactaataggga

SEQ ID NO: 54934 - DNA, 16 bp, Homo sapiens
cgttggattgttcacc

SEQ ID NO: 54935 - DNA, 17 bp, Homo sapiens
cgttggattgttcaccc

SEQ ID NO: 54936 - DNA, 18 bp, Homo sapiens
cgttggattgttcaccca

SEQ ID NO: 54937 - DNA, 19 bp, Homo sapiens
cgttggattgttcacccac

SEQ ID NO: 54938 - DNA, 20 bp, Homo sapiens
cgttggattgttcacccact

SEQ ID NO: 54939 - DNA, 21 bp, Homo sapiens
cgttggattgttcacccacta

SEQ ID NO: 54940 - DNA, 22 bp, Homo sapiens
cgttggattgttcacccactaa

SEQ ID NO: 54941 - DNA, 23 bp, Homo sapiens
cgttggattgttcacccactaat

SEQ ID NO: 54942 - DNA, 24 bp, Homo sapiens
cgttggattgttcacccactaata

SEQ ID NO: 54943 - DNA, 25 bp, Homo sapiens
cgttggattgttcacccactaatag

SEQ ID NO: 54944 - DNA, 26 bp, Homo sapiens
cgttggattgttcacccactaatagg

SEQ ID NO: 54945 - DNA, 27 bp, Homo sapiens
cgttggattgttcacccactaataggg

SEQ ID NO: 54946 - DNA, 28 bp, Homo sapiens
cgttggattgttcacccactaataggga

SEQ ID NO: 54947 - DNA, 29 bp, Homo sapiens
cgttggattgttcacccactaatagggaa

SEQ ID NO: 54948 - DNA, 16 bp, Homo sapiens
gttggattgttcaccc

SEQ ID NO: 54949 - DNA, 19 bp, Homo sapiens
gttggattgttcacccact

SEQ ID NO: 54950 - DNA, 18 bp, Homo sapiens
ttggattgttcacccact

SEQ ID NO: 54951 - DNA, 21 bp, Homo sapiens
ttggattgttcacccactaat

SEQ ID NO: 54952 - DNA, 17 bp, Homo sapiens
tggattgttcacccact

SEQ ID NO: 54953 - DNA, 19 bp, Homo sapiens
tggattgttcacccactaa

SEQ ID NO: 54954 - DNA, 20 bp, Homo sapiens
tggattgttcacccactaat

SEQ ID NO: 54955 - DNA, 21 bp, Homo sapiens
tggattgttcacccactaata

SEQ ID NO: 54956 - DNA, 16 bp, Homo sapiens
ggattgttcacccact

SEQ ID NO: 54957 - DNA, 18 bp, Homo sapiens
ggattgttcacccactaa

SEQ ID NO: 54958 - DNA, 19 bp, Homo sapiens
ggattgttcacccactaat

SEQ ID NO: 54959 - DNA, 30 bp, Homo sapiens
gttcacccactaatagggaacgtgagctgg

SEQ ID NO: 54960 - DNA, 19 bp, Homo sapiens
actaatagggaacgtgagc

SEQ ID NO: 54961 - DNA, 20 bp, Homo sapiens
actaatagggaacgtgagct

SEQ ID NO: 54962 - DNA, 21 bp, Homo sapiens
actaatagggaacgtgagctg

SEQ ID NO: 54963 - DNA, 22 bp, Homo sapiens
actaatagggaacgtgagctgg

SEQ ID NO: 54964 - DNA, 23 bp, Homo sapiens
actaatagggaacgtgagctggg

SEQ ID NO: 54965 - DNA, 24 bp, Homo sapiens
actaatagggaacgtgagctgggt

SEQ ID NO: 54966 - DNA, 17 bp, Homo sapiens
ctaatagggaacgtgag

SEQ ID NO: 54967 - DNA, 18 bp, Homo sapiens
ctaatagggaacgtgagc

SEQ ID NO: 54968 - DNA, 19 bp, Homo sapiens
ctaatagggaacgtgagct

SEQ ID NO: 54969 - DNA, 20 bp, Homo sapiens
ctaatagggaacgtgagctg

SEQ ID NO: 54970 - DNA, 21 bp, Homo sapiens
ctaatagggaacgtgagctgg

SEQ ID NO: 54971 - DNA, 22 bp, Homo sapiens
ctaatagggaacgtgagctggg

SEQ ID NO: 54972 - DNA, 23 bp, Homo sapiens
ctaatagggaacgtgagctgggt

SEQ ID NO: 54973 - DNA, 24 bp, Homo sapiens
ctaatagggaacgtgagctgggtt

SEQ ID NO: 54974 - DNA, 19 bp, Homo sapiens
taatagggaacgtgagctg

SEQ ID NO: 54975 - DNA, 20 bp, Homo sapiens
taatagggaacgtgagctgg

SEQ ID NO: 54976 - DNA, 21 bp, Homo sapiens
taatagggaacgtgagctggg

SEQ ID NO: 54977 - DNA, 22 bp, Homo sapiens
taatagggaacgtgagctgggt

SEQ ID NO: 54978 - DNA, 17 bp, Homo sapiens
aatagggaacgtgagct

SEQ ID NO: 54979 - DNA, 18 bp, Homo sapiens
aatagggaacgtgagctg

SEQ ID NO: 54980 - DNA, 19 bp, Homo sapiens
aatagggaacgtgagctgg

SEQ ID NO: 54981 - DNA, 20 bp, Homo sapiens
aatagggaacgtgagctggg

SEQ ID NO: 54982 - DNA, 21 bp, Homo sapiens
aatagggaacgtgagctgggt

SEQ ID NO: 54983 - DNA, 22 bp, Homo sapiens
aatagggaacgtgagctgggtt

SEQ ID NO: 54984 - DNA, 24 bp, Homo sapiens
aatagggaacgtgagctgggttta

SEQ ID NO: 54985 - DNA, 18 bp, Homo sapiens
atagggaacgtgagctgg

SEQ ID NO: 54986 - DNA, 19 bp, Homo sapiens
atagggaacgtgagctggg

SEQ ID NO: 54987 - DNA, 20 bp, Homo sapiens
atagggaacgtgagctgggt

SEQ ID NO: 54988 - DNA, 21 bp, Homo sapiens
atagggaacgtgagctgggtt

SEQ ID NO: 54989 - DNA, 25 bp, Homo sapiens
atagggaacgtgagctgggtttaga

SEQ ID NO: 54990 - DNA, 18 bp, Homo sapiens
tagggaacgtgagctggg

SEQ ID NO: 54991 - DNA, 19 bp, Homo sapiens
tagggaacgtgagctgggt

SEQ ID NO: 54992 - DNA, 23 bp, Homo sapiens
tagggaacgtgagctgggtttag

SEQ ID NO: 54993 - DNA, 24 bp, Homo sapiens
tagggaacgtgagctgggtttaga

SEQ ID NO: 54994 - DNA, 16 bp, Homo sapiens
agggaacgtgagctgg

SEQ ID NO: 54995 - DNA, 17 bp, Homo sapiens
agggaacgtgagctggg

SEQ ID NO: 54996 - DNA, 18 bp, Homo sapiens
agggaacgtgagctgggt

SEQ ID NO: 54997 - DNA, 19 bp, Homo sapiens
agggaacgtgagctgggtt

SEQ ID NO: 54998 - DNA, 20 bp, Homo sapiens
agggaacgtgagctgggttt

SEQ ID NO: 54999 - DNA, 21 bp, Homo sapiens
agggaacgtgagctgggttta

SEQ ID NO: 55000 - DNA, 22 bp, Homo sapiens
agggaacgtgagctgggtttag

SEQ ID NO: 55001 - DNA, 23 bp, Homo sapiens
agggaacgtgagctgggtttaga

SEQ ID NO: 55002 - DNA, 25 bp, Homo sapiens
agggaacgtgagctgggtttagacc

SEQ ID NO: 55003 - DNA, 16 bp, Homo sapiens
gggaacgtgagctggg

SEQ ID NO: 55004 - DNA, 19 bp, Homo sapiens
gggaacgtgagctgggttt

SEQ ID NO: 55005 - DNA, 20 bp, Homo sapiens
gggaacgtgagctgggttta

SEQ ID NO: 55006 - DNA, 21 bp, Homo sapiens
gggaacgtgagctgggtttag

SEQ ID NO: 55007 - DNA, 22 bp, Homo sapiens
gggaacgtgagctgggtttaga

SEQ ID NO: 55008 - DNA, 18 bp, Homo sapiens
ggaacgtgagctgggttt

SEQ ID NO: 55009 - DNA, 19 bp, Homo sapiens
ggaacgtgagctgggttta

SEQ ID NO: 55010 - DNA, 20 bp, Homo sapiens
ggaacgtgagctgggtttag

SEQ ID NO: 55011 - DNA, 21 bp, Homo sapiens
ggaacgtgagctgggtttaga

SEQ ID NO: 55012 - DNA, 16 bp, Homo sapiens
gaacgtgagctgggtt

SEQ ID NO: 55013 - DNA, 17 bp, Homo sapiens
gaacgtgagctgggttt

SEQ ID NO: 55014 - DNA, 18 bp, Homo sapiens
gaacgtgagctgggttta

SEQ ID NO: 55015 - DNA, 19 bp, Homo sapiens
gaacgtgagctgggtttag

SEQ ID NO: 55016 - DNA, 20 bp, Homo sapiens
gaacgtgagctgggtttaga

SEQ ID NO: 55017 - DNA, 21 bp, Homo sapiens
gaacgtgagctgggtttagac

SEQ ID NO: 55018 - DNA, 22 bp, Homo sapiens
gaacgtgagctgggtttagacc

SEQ ID NO: 55019 - DNA, 18 bp, Homo sapiens
aacgtgagctgggtttag

SEQ ID NO: 55020 - DNA, 19 bp, Homo sapiens
aacgtgagctgggtttaga

SEQ ID NO: 55021 - DNA, 25 bp, Homo sapiens
cgtgagctgggtttagaccgtcgtg

SEQ ID NO: 55022 - DNA, 24 bp, Homo sapiens
gtgagctgggtttagaccgtcgtg

SEQ ID NO: 55023 - DNA, 23 bp, Homo sapiens
tgagctgggtttagaccgtcgtg

SEQ ID NO: 55024 - DNA, 25 bp, Homo sapiens
tgagctgggtttagaccgtcgtgag

SEQ ID NO: 55025 - DNA, 29 bp, Homo sapiens
tgagctgggtttagaccgtcgtgagacag

SEQ ID NO: 55026 - DNA, 22 bp, Homo sapiens
gagctgggtttagaccgtcgtg

SEQ ID NO: 55027 - DNA, 20 bp, Homo sapiens
agctgggtttagaccgtcgt

SEQ ID NO: 55028 - DNA, 21 bp, Homo sapiens
agctgggtttagaccgtcgtg

SEQ ID NO: 55029 - DNA, 23 bp, Homo sapiens
agctgggtttagaccgtcgtgag

SEQ ID NO: 55030 - DNA, 24 bp, Homo sapiens
agctgggtttagaccgtcgtgaga

SEQ ID NO: 55031 - DNA, 27 bp, Homo sapiens
agctgggtttagaccgtcgtgagacag

SEQ ID NO: 55032 - DNA, 17 bp, Homo sapiens
ctgggtttagaccgtcg

SEQ ID NO: 55033 - DNA, 18 bp, Homo sapiens
ctgggtttagaccgtcgt

SEQ ID NO: 55034 - DNA, 19 bp, Homo sapiens
ctgggtttagaccgtcgtg

SEQ ID NO: 55035 - DNA, 20 bp, Homo sapiens
ctgggtttagaccgtcgtga

SEQ ID NO: 55036 - DNA, 21 bp, Homo sapiens
ctgggtttagaccgtcgtgag

SEQ ID NO: 55037 - DNA, 22 bp, Homo sapiens
ctgggtttagaccgtcgtgaga

SEQ ID NO: 55038 - DNA, 24 bp, Homo sapiens
ctgggtttagaccgtcgtgagaca

SEQ ID NO: 55039 - DNA, 25 bp, Homo sapiens
ctgggtttagaccgtcgtgagacag

SEQ ID NO: 55040 - DNA, 26 bp, Homo sapiens
ctgggtttagaccgtcgtgagacagg

SEQ ID NO: 55041 - DNA, 18 bp, Homo sapiens
tgggtttagaccgtcgtg

SEQ ID NO: 55042 - DNA, 19 bp, Homo sapiens
tgggtttagaccgtcgtga

SEQ ID NO: 55043 - DNA, 20 bp, Homo sapiens
tgggtttagaccgtcgtgag

SEQ ID NO: 55044 - DNA, 23 bp, Homo sapiens
tgggtttagaccgtcgtgagaca

SEQ ID NO: 55045 - DNA, 24 bp, Homo sapiens
tgggtttagaccgtcgtgagacag

SEQ ID NO: 55046 - DNA, 25 bp, Homo sapiens
tgggtttagaccgtcgtgagacagg

SEQ ID NO: 55047 - DNA, 16 bp, Homo sapiens
gggtttagaccgtcgt

SEQ ID NO: 55048 - DNA, 17 bp, Homo sapiens
gggtttagaccgtcgtg

SEQ ID NO: 55049 - DNA, 18 bp, Homo sapiens
gggtttagaccgtcgtga

SEQ ID NO: 55050 - DNA, 19 bp, Homo sapiens
gggtttagaccgtcgtgag

SEQ ID NO: 55051 - DNA, 20 bp, Homo sapiens
gggtttagaccgtcgtgaga

SEQ ID NO: 55052 - DNA, 22 bp, Homo sapiens
gggtttagaccgtcgtgagaca

SEQ ID NO: 55053 - DNA, 23 bp, Homo sapiens
gggtttagaccgtcgtgagacag

SEQ ID NO: 55054 - DNA, 24 bp, Homo sapiens
gggtttagaccgtcgtgagacagg

SEQ ID NO: 55055 - DNA, 25 bp, Homo sapiens
gggtttagaccgtcgtgagacaggt

SEQ ID NO: 55056 - DNA, 28 bp, Homo sapiens
gggtttagaccgtcgtgagacaggttag

SEQ ID NO: 55057 - DNA, 16 bp, Homo sapiens
ggtttagaccgtcgtg

SEQ ID NO: 55058 - DNA, 17 bp, Homo sapiens
ggtttagaccgtcgtga

SEQ ID NO: 55059 - DNA, 18 bp, Homo sapiens
ggtttagaccgtcgtgag

SEQ ID NO: 55060 - DNA, 19 bp, Homo sapiens
ggtttagaccgtcgtgaga

SEQ ID NO: 55061 - DNA, 21 bp, Homo sapiens
ggtttagaccgtcgtgagaca

SEQ ID NO: 55062 - DNA, 22 bp, Homo sapiens
ggtttagaccgtcgtgagacag

SEQ ID NO: 55063 - DNA, 23 bp, Homo sapiens
ggtttagaccgtcgtgagacagg

SEQ ID NO: 55064 - DNA, 24 bp, Homo sapiens
ggtttagaccgtcgtgagacaggt

SEQ ID NO: 55065 - DNA, 27 bp, Homo sapiens
ggtttagaccgtcgtgagacaggttag

SEQ ID NO: 55066 - DNA, 16 bp, Homo sapiens
gtttagaccgtcgtga

SEQ ID NO: 55067 - DNA, 17 bp, Homo sapiens
gtttagaccgtcgtgag

SEQ ID NO: 55068 - DNA, 18 bp, Homo sapiens
gtttagaccgtcgtgaga

SEQ ID NO: 55069 - DNA, 20 bp, Homo sapiens
gtttagaccgtcgtgagaca

SEQ ID NO: 55070 - DNA, 21 bp, Homo sapiens
gtttagaccgtcgtgagacag

SEQ ID NO: 55071 - DNA, 22 bp, Homo sapiens
gtttagaccgtcgtgagacagg

SEQ ID NO: 55072 - DNA, 23 bp, Homo sapiens
gtttagaccgtcgtgagacaggt

SEQ ID NO: 55073 - DNA, 24 bp, Homo sapiens
gtttagaccgtcgtgagacaggtt

SEQ ID NO: 55074 - DNA, 16 bp, Homo sapiens
tttagaccgtcgtgag

SEQ ID NO: 55075 - DNA, 17 bp, Homo sapiens
tttagaccgtcgtgaga

SEQ ID NO: 55076 - DNA, 18 bp, Homo sapiens
tttagaccgtcgtgagac

SEQ ID NO: 55077 - DNA, 19 bp, Homo sapiens
tttagaccgtcgtgagaca

SEQ ID NO: 55078 - DNA, 20 bp, Homo sapiens
tttagaccgtcgtgagacag

SEQ ID NO: 55079 - DNA, 21 bp, Homo sapiens
tttagaccgtcgtgagacagg

SEQ ID NO: 55080 - DNA, 22 bp, Homo sapiens
tttagaccgtcgtgagacaggt

SEQ ID NO: 55081 - DNA, 25 bp, Homo sapiens
tttagaccgtcgtgagacaggttag

SEQ ID NO: 55082 - DNA, 16 bp, Homo sapiens
ttagaccgtcgtgaga

SEQ ID NO: 55083 - DNA, 18 bp, Homo sapiens
ttagaccgtcgtgagaca

SEQ ID NO: 55084 - DNA, 19 bp, Homo sapiens
ttagaccgtcgtgagacag

SEQ ID NO: 55085 - DNA, 20 bp, Homo sapiens
ttagaccgtcgtgagacagg

SEQ ID NO: 55086 - DNA, 21 bp, Homo sapiens
ttagaccgtcgtgagacaggt

SEQ ID NO: 55087 - DNA, 24 bp, Homo sapiens
ttagaccgtcgtgagacaggttag

SEQ ID NO: 55088 - DNA, 16 bp, Homo sapiens
tagaccgtcgtgagac

SEQ ID NO: 55089 - DNA, 17 bp, Homo sapiens
tagaccgtcgtgagaca

SEQ ID NO: 55090 - DNA, 18 bp, Homo sapiens
tagaccgtcgtgagacag

SEQ ID NO: 55091 - DNA, 19 bp, Homo sapiens
tagaccgtcgtgagacagg

SEQ ID NO: 55092 - DNA, 20 bp, Homo sapiens
tagaccgtcgtgagacaggt

SEQ ID NO: 55093 - DNA, 22 bp, Homo sapiens
tagaccgtcgtgagacaggtta

SEQ ID NO: 55094 - DNA, 23 bp, Homo sapiens
tagaccgtcgtgagacaggttag

SEQ ID NO: 55095 - DNA, 24 bp, Homo sapiens
tagaccgtcgtgagacaggttagt

SEQ ID NO: 55096 - DNA, 30 bp, Homo sapiens
tagaccgtcgtgagacaggttagttttacc

SEQ ID NO: 55097 - DNA, 16 bp, Homo sapiens
agaccgtcgtgagaca

SEQ ID NO: 55098 - DNA, 17 bp, Homo sapiens
agaccgtcgtgagacag

SEQ ID NO: 55099 - DNA, 18 bp, Homo sapiens
agaccgtcgtgagacagg

SEQ ID NO: 55100 - DNA, 16 bp, Homo sapiens
accgtcgtgagacagg

SEQ ID NO: 55101 - DNA, 20 bp, Homo sapiens
accgtcgtgagacaggttag

SEQ ID NO: 55102 - DNA, 19 bp, Homo sapiens
ccgtcgtgagacaggttag

SEQ ID NO: 55103 - DNA, 21 bp, Homo sapiens
ccgtcgtgagacaggttagtt

SEQ ID NO: 55104 - DNA, 22 bp, Homo sapiens
ccgtcgtgagacaggttagttt

SEQ ID NO: 55105 - DNA, 23 bp, Homo sapiens
ccgtcgtgagacaggttagtttt

SEQ ID NO: 55106 - DNA, 16 bp, Homo sapiens
gtcgtgagacaggtta

SEQ ID NO: 55107 - DNA, 17 bp, Homo sapiens
gtcgtgagacaggttag

SEQ ID NO: 55108 - DNA, 20 bp, Homo sapiens
gtcgtgagacaggttagttt

SEQ ID NO: 55109 - DNA, 21 bp, Homo sapiens
gtcgtgagacaggttagtttt

SEQ ID NO: 55110 - DNA, 16 bp, Homo sapiens
tcgtgagacaggttag

SEQ ID NO: 55111 - DNA, 22 bp, Homo sapiens
tagttttaccctactgatgatg

SEQ ID NO: 55112 - DNA, 16 bp, Homo sapiens
ttttaccctactgatg

SEQ ID NO: 55113 - DNA, 19 bp, Homo sapiens
tttaccctactgatgatgt

SEQ ID NO: 55114 - DNA, 22 bp, Homo sapiens
tttaccctactgatgatgtgtt

SEQ ID NO: 55115 - DNA, 21 bp, Homo sapiens
ttaccctactgatgatgtgtt

SEQ ID NO: 55116 - DNA, 17 bp, Homo sapiens
taccctactgatgatgt

SEQ ID NO: 55117 - DNA, 20 bp, Homo sapiens
taccctactgatgatgtgtt

SEQ ID NO: 55118 - DNA, 21 bp, Homo sapiens
taccctactgatgatgtgttg

SEQ ID NO: 55119 - DNA, 29 bp, Homo sapiens
taccctactgatgatgtgttgttgccatg

SEQ ID NO: 55120 - DNA, 19 bp, Homo sapiens
accctactgatgatgtgtt

SEQ ID NO: 55121 - DNA, 20 bp, Homo sapiens
accctactgatgatgtgttg

SEQ ID NO: 55122 - DNA, 19 bp, Homo sapiens
ccctactgatgatgtgttg

SEQ ID NO: 55123 - DNA, 22 bp, Homo sapiens
ccctactgatgatgtgttgttg

SEQ ID NO: 55124 - DNA, 25 bp, Homo sapiens
ccctactgatgatgtgttgttgcca

SEQ ID NO: 55125 - DNA, 27 bp, Homo sapiens
ccctactgatgatgtgttgttgccatg

SEQ ID NO: 55126 - DNA, 28 bp, Homo sapiens
ccctactgatgatgtgttgttgccatgg

SEQ ID NO: 55127 - DNA, 21 bp, Homo sapiens
cctactgatgatgtgttgttg

SEQ ID NO: 55128 - DNA, 23 bp, Homo sapiens
cctactgatgatgtgttgttgcc

SEQ ID NO: 55129 - DNA, 24 bp, Homo sapiens
cctactgatgatgtgttgttgcca

SEQ ID NO: 55130 - DNA, 26 bp, Homo sapiens
cctactgatgatgtgttgttgccatg

SEQ ID NO: 55131 - DNA, 19 bp, Homo sapiens
ctactgatgatgtgttgtt

SEQ ID NO: 55132 - DNA, 20 bp, Homo sapiens
ctactgatgatgtgttgttg

SEQ ID NO: 55133 - DNA, 21 bp, Homo sapiens
ctactgatgatgtgttgttgc

SEQ ID NO: 55134 - DNA, 22 bp, Homo sapiens
ctactgatgatgtgttgttgcc

SEQ ID NO: 55135 - DNA, 23 bp, Homo sapiens
ctactgatgatgtgttgttgcca

SEQ ID NO: 55136 - DNA, 25 bp, Homo sapiens
ctactgatgatgtgttgttgccatg

SEQ ID NO: 55137 - DNA, 26 bp, Homo sapiens
ctactgatgatgtgttgttgccatgg

SEQ ID NO: 55138 - DNA, 16 bp, Homo sapiens
tactgatgatgtgttg

SEQ ID NO: 55139 - DNA, 22 bp, Homo sapiens
tactgatgatgtgttgttgcca

SEQ ID NO: 55140 - DNA, 23 bp, Homo sapiens
tactgatgatgtgttgttgccat

SEQ ID NO: 55141 - DNA, 24 bp, Homo sapiens
tactgatgatgtgttgttgccatg

SEQ ID NO: 55142 - DNA, 25 bp, Homo sapiens
tactgatgatgtgttgttgccatgg

SEQ ID NO: 55143 - DNA, 20 bp, Homo sapiens
actgatgatgtgttgttgcc

SEQ ID NO: 55144 - DNA, 23 bp, Homo sapiens
actgatgatgtgttgttgccatg

SEQ ID NO: 55145 - DNA, 17 bp, Homo sapiens
ctgatgatgtgttgttg

SEQ ID NO: 55146 - DNA, 19 bp, Homo sapiens
ctgatgatgtgttgttgcc

SEQ ID NO: 55147 - DNA, 20 bp, Homo sapiens
ctgatgatgtgttgttgcca

SEQ ID NO: 55148 - DNA, 21 bp, Homo sapiens
ctgatgatgtgttgttgccat

SEQ ID NO: 55149 - DNA, 22 bp, Homo sapiens
ctgatgatgtgttgttgccatg

SEQ ID NO: 55150 - DNA, 23 bp, Homo sapiens
ctgatgatgtgttgttgccatgg

SEQ ID NO: 55151 - DNA, 24 bp, Homo sapiens
ctgatgatgtgttgttgccatggt

SEQ ID NO: 55152 - DNA, 25 bp, Homo sapiens
ctgatgatgtgttgttgccatggta

SEQ ID NO: 55153 - DNA, 16 bp, Homo sapiens
tgatgatgtgttgttg

SEQ ID NO: 55154 - DNA, 18 bp, Homo sapiens
tgatgatgtgttgttgcc

SEQ ID NO: 55155 - DNA, 19 bp, Homo sapiens
tgatgatgtgttgttgcca

SEQ ID NO: 55156 - DNA, 20 bp, Homo sapiens
tgatgatgtgttgttgccat

SEQ ID NO: 55157 - DNA, 21 bp, Homo sapiens
tgatgatgtgttgttgccatg

SEQ ID NO: 55158 - DNA, 22 bp, Homo sapiens
tgatgatgtgttgttgccatgg

SEQ ID NO: 55159 - DNA, 23 bp, Homo sapiens
tgatgatgtgttgttgccatggt

SEQ ID NO: 55160 - DNA, 17 bp, Homo sapiens
gatgatgtgttgttgcc

SEQ ID NO: 55161 - DNA, 18 bp, Homo sapiens
gatgatgtgttgttgcca

SEQ ID NO: 55162 - DNA, 19 bp, Homo sapiens
gatgatgtgttgttgccat

SEQ ID NO: 55163 - DNA, 20 bp, Homo sapiens
gatgatgtgttgttgccatg

SEQ ID NO: 55164 - DNA, 21 bp, Homo sapiens
gatgatgtgttgttgccatgg

SEQ ID NO: 55165 - DNA, 22 bp, Homo sapiens
gatgatgtgttgttgccatggt

SEQ ID NO: 55166 - DNA, 19 bp, Homo sapiens
atgatgtgttgttgccatg

SEQ ID NO: 55167 - DNA, 20 bp, Homo sapiens
atgatgtgttgttgccatgg

SEQ ID NO: 55168 - DNA, 21 bp, Homo sapiens
atgatgtgttgttgccatggt

SEQ ID NO: 55169 - DNA, 18 bp, Homo sapiens
tgatgtgttgttgccatg

SEQ ID NO: 55170 - DNA, 19 bp, Homo sapiens
tgatgtgttgttgccatgg

SEQ ID NO: 55171 - DNA, 20 bp, Homo sapiens
tgatgtgttgttgccatggt

SEQ ID NO: 55172 - DNA, 21 bp, Homo sapiens
tgatgtgttgttgccatggta

SEQ ID NO: 55173 - DNA, 17 bp, Homo sapiens
gatgtgttgttgccatg

SEQ ID NO: 55174 - DNA, 18 bp, Homo sapiens
gatgtgttgttgccatgg

SEQ ID NO: 55175 - DNA, 19 bp, Homo sapiens
gatgtgttgttgccatggt

SEQ ID NO: 55176 - DNA, 20 bp, Homo sapiens
gatgtgttgttgccatggta

SEQ ID NO: 55177 - DNA, 22 bp, Homo sapiens
gatgtgttgttgccatggtaat

SEQ ID NO: 55178 - DNA, 23 bp, Homo sapiens
gatgtgttgttgccatggtaatc

SEQ ID NO: 55179 - DNA, 18 bp, Homo sapiens
atgtgttgttgccatggt

SEQ ID NO: 55180 - DNA, 21 bp, Homo sapiens
atgtgttgttgccatggtaat

SEQ ID NO: 55181 - DNA, 22 bp, Homo sapiens
atgtgttgttgccatggtaatc

SEQ ID NO: 55182 - DNA, 30 bp, Homo sapiens
atgtgttgttgccatggtaatcctgctcag

SEQ ID NO: 55183 - DNA, 16 bp, Homo sapiens
gtgttgttgccatggt

SEQ ID NO: 55184 - DNA, 19 bp, Homo sapiens
gtgttgttgccatggtaat

SEQ ID NO: 55185 - DNA, 22 bp, Homo sapiens
gtgttgttgccatggtaatcct

SEQ ID NO: 55186 - DNA, 29 bp, Homo sapiens
gtgttgttgccatggtaatcctgctcagt

SEQ ID NO: 55187 - DNA, 19 bp, Homo sapiens
tgttgttgccatggtaatc

SEQ ID NO: 55188 - DNA, 20 bp, Homo sapiens
tgttgttgccatggtaatcc

SEQ ID NO: 55189 - DNA, 21 bp, Homo sapiens
tgttgttgccatggtaatcct

SEQ ID NO: 55190 - DNA, 22 bp, Homo sapiens
tgttgttgccatggtaatcctg

SEQ ID NO: 55191 - DNA, 23 bp, Homo sapiens
tgttgttgccatggtaatcctgc

SEQ ID NO: 55192 - DNA, 24 bp, Homo sapiens
tgttgttgccatggtaatcctgct

SEQ ID NO: 55193 - DNA, 25 bp, Homo sapiens
tgttgttgccatggtaatcctgctc

SEQ ID NO: 55194 - DNA, 17 bp, Homo sapiens
gttgttgccatggtaat

SEQ ID NO: 55195 - DNA, 20 bp, Homo sapiens
gttgttgccatggtaatcct

SEQ ID NO: 55196 - DNA, 17 bp, Homo sapiens
ttgttgccatggtaatc

SEQ ID NO: 55197 - DNA, 18 bp, Homo sapiens
ttgttgccatggtaatcc

SEQ ID NO: 55198 - DNA, 19 bp, Homo sapiens
ttgttgccatggtaatcct

SEQ ID NO: 55199 - DNA, 20 bp, Homo sapiens
ttgttgccatggtaatcctg

SEQ ID NO: 55200 - DNA, 21 bp, Homo sapiens
ttgttgccatggtaatcctgc

SEQ ID NO: 55201 - DNA, 22 bp, Homo sapiens
ttgttgccatggtaatcctgct

SEQ ID NO: 55202 - DNA, 24 bp, Homo sapiens
ttgttgccatggtaatcctgctca

SEQ ID NO: 55203 - DNA, 20 bp, Homo sapiens
gttgccatggtaatcctgct

SEQ ID NO: 55204 - DNA, 21 bp, Homo sapiens
gttgccatggtaatcctgctc

SEQ ID NO: 55205 - DNA, 23 bp, Homo sapiens
gttgccatggtaatcctgctcag

SEQ ID NO: 55206 - DNA, 16 bp, Homo sapiens
ttgccatggtaatcct

SEQ ID NO: 55207 - DNA, 19 bp, Homo sapiens
ttgccatggtaatcctgct

SEQ ID NO: 55208 - DNA, 21 bp, Homo sapiens
ttgccatggtaatcctgctca

SEQ ID NO: 55209 - DNA, 22 bp, Homo sapiens
ttgccatggtaatcctgctcag

SEQ ID NO: 55210 - DNA, 23 bp, Homo sapiens
ttgccatggtaatcctgctcagt

SEQ ID NO: 55211 - DNA, 20 bp, Homo sapiens
gccatggtaatcctgctcag

SEQ ID NO: 55212 - DNA, 21 bp, Homo sapiens
gccatggtaatcctgctcagt

SEQ ID NO: 55213 - DNA, 19 bp, Homo sapiens
ccatggtaatcctgctcag

SEQ ID NO: 55214 - DNA, 20 bp, Homo sapiens
ccatggtaatcctgctcagt

SEQ ID NO: 55215 - DNA, 23 bp, Homo sapiens
ccatggtaatcctgctcagtacg

SEQ ID NO: 55216 - DNA, 17 bp, Homo sapiens
atggtaatcctgctcag

SEQ ID NO: 55217 - DNA, 16 bp, Homo sapiens
ggtaatcctgctcagt

SEQ ID NO: 55218 - DNA, 18 bp, Homo sapiens
gtaatcctgctcagtacg

SEQ ID NO: 55219 - DNA, 20 bp, Homo sapiens
gtaatcctgctcagtacgag

SEQ ID NO: 55220 - DNA, 17 bp, Homo sapiens
taatcctgctcagtacg

SEQ ID NO: 55221 - DNA, 19 bp, Homo sapiens
taatcctgctcagtacgag

SEQ ID NO: 55222 - DNA, 21 bp, Homo sapiens
taatcctgctcagtacgagag

SEQ ID NO: 55223 - DNA, 18 bp, Homo sapiens
aatcctgctcagtacgag

SEQ ID NO: 55224 - DNA, 20 bp, Homo sapiens
aatcctgctcagtacgagag

SEQ ID NO: 55225 - DNA, 22 bp, Homo sapiens
cctgctcagtacgagaggaacc

SEQ ID NO: 55226 - DNA, 17 bp, Homo sapiens
ctgctcagtacgagagg

SEQ ID NO: 55227 - DNA, 18 bp, Homo sapiens
ctgctcagtacgagagga

SEQ ID NO: 55228 - DNA, 20 bp, Homo sapiens
ctgctcagtacgagaggaac

SEQ ID NO: 55229 - DNA, 21 bp, Homo sapiens
ctgctcagtacgagaggaacc

SEQ ID NO: 55230 - DNA, 22 bp, Homo sapiens
ctgctcagtacgagaggaaccg

SEQ ID NO: 55231 - DNA, 23 bp, Homo sapiens
ctgctcagtacgagaggaaccgc

SEQ ID NO: 55232 - DNA, 24 bp, Homo sapiens
ctgctcagtacgagaggaaccgca

SEQ ID NO: 55233 - DNA, 21 bp, Homo sapiens
ctcagtacgagaggaaccgca

SEQ ID NO: 55234 - DNA, 22 bp, Homo sapiens
ctcagtacgagaggaaccgcag

SEQ ID NO: 55235 - DNA, 22 bp, Homo sapiens
cgagaggaaccgcaggttcaga

SEQ ID NO: 55236 - DNA, 24 bp, Homo sapiens
cgagaggaaccgcaggttcagaca

SEQ ID NO: 55237 - DNA, 22 bp, Homo sapiens
aaccgcaggttcagacatttgg

SEQ ID NO: 55238 - DNA, 20 bp, Homo sapiens
ccgcaggttcagacatttgg

SEQ ID NO: 55239 - DNA, 16 bp, Homo sapiens
gcaggttcagacattt

SEQ ID NO: 55240 - DNA, 17 bp, Homo sapiens
gcaggttcagacatttg

SEQ ID NO: 55241 - DNA, 18 bp, Homo sapiens
gcaggttcagacatttgg

SEQ ID NO: 55242 - DNA, 19 bp, Homo sapiens
gcaggttcagacatttggt

SEQ ID NO: 55243 - DNA, 20 bp, Homo sapiens
gcaggttcagacatttggtg

SEQ ID NO: 55244 - DNA, 21 bp, Homo sapiens
gcaggttcagacatttggtgt

SEQ ID NO: 55245 - DNA, 22 bp, Homo sapiens
gcaggttcagacatttggtgta

SEQ ID NO: 55246 - DNA, 24 bp, Homo sapiens
gcaggttcagacatttggtgtatg

SEQ ID NO: 55247 - DNA, 25 bp, Homo sapiens
gcaggttcagacatttggtgtatgt

SEQ ID NO: 55248 - DNA, 30 bp, Homo sapiens
gcaggttcagacatttggtgtatgtgcttg

SEQ ID NO: 55249 - DNA, 17 bp, Homo sapiens
caggttcagacatttgg

SEQ ID NO: 55250 - DNA, 19 bp, Homo sapiens
caggttcagacatttggtg

SEQ ID NO: 55251 - DNA, 16 bp, Homo sapiens
ggttcagacatttggt

SEQ ID NO: 55252 - DNA, 17 bp, Homo sapiens
ggttcagacatttggtg

SEQ ID NO: 55253 - DNA, 18 bp, Homo sapiens
ggttcagacatttggtgt

SEQ ID NO: 55254 - DNA, 19 bp, Homo sapiens
ggttcagacatttggtgta

SEQ ID NO: 55255 - DNA, 20 bp, Homo sapiens
ggttcagacatttggtgtat

SEQ ID NO: 55256 - DNA, 22 bp, Homo sapiens
ggttcagacatttggtgtatgt

SEQ ID NO: 55257 - DNA, 30 bp, Homo sapiens
ggttcagacatttggtgtatgtgcttggct

SEQ ID NO: 55258 - DNA, 21 bp, Homo sapiens
gttcagacatttggtgtatgt

SEQ ID NO: 55259 - DNA, 22 bp, Homo sapiens
gttcagacatttggtgtatgtg

SEQ ID NO: 55260 - DNA, 26 bp, Homo sapiens
gttcagacatttggtgtatgtgcttg

SEQ ID NO: 55261 - DNA, 30 bp, Homo sapiens
gttcagacatttggtgtatgtgcttggctg

SEQ ID NO: 55262 - DNA, 21 bp, Homo sapiens
gacatttggtgtatgtgcttg

SEQ ID NO: 55263 - DNA, 24 bp, Homo sapiens
gacatttggtgtatgtgcttggct

SEQ ID NO: 55264 - DNA, 25 bp, Homo sapiens
gacatttggtgtatgtgcttggctg

SEQ ID NO: 55265 - DNA, 26 bp, Homo sapiens
gacatttggtgtatgtgcttggctga

SEQ ID NO: 55266 - DNA, 27 bp, Homo sapiens
gacatttggtgtatgtgcttggctgag

SEQ ID NO: 55267 - DNA, 28 bp, Homo sapiens
gacatttggtgtatgtgcttggctgagg

SEQ ID NO: 55268 - DNA, 29 bp, Homo sapiens
gacatttggtgtatgtgcttggctgagga

SEQ ID NO: 55269 - DNA, 25 bp, Homo sapiens
catttggtgtatgtgcttggctgag

SEQ ID NO: 55270 - DNA, 24 bp, Homo sapiens
atttggtgtatgtgcttggctgag

SEQ ID NO: 55271 - DNA, 22 bp, Homo sapiens
tttggtgtatgtgcttggctga

SEQ ID NO: 55272 - DNA, 23 bp, Homo sapiens
tttggtgtatgtgcttggctgag

SEQ ID NO: 55273 - DNA, 24 bp, Homo sapiens
tttggtgtatgtgcttggctgagg

SEQ ID NO: 55274 - DNA, 25 bp, Homo sapiens
tttggtgtatgtgcttggctgagga

SEQ ID NO: 55275 - DNA, 18 bp, Homo sapiens
ttggtgtatgtgcttggc

SEQ ID NO: 55276 - DNA, 19 bp, Homo sapiens
ttggtgtatgtgcttggct

SEQ ID NO: 55277 - DNA, 20 bp, Homo sapiens
ttggtgtatgtgcttggctg

SEQ ID NO: 55278 - DNA, 21 bp, Homo sapiens
ttggtgtatgtgcttggctga

SEQ ID NO: 55279 - DNA, 22 bp, Homo sapiens
ttggtgtatgtgcttggctgag

SEQ ID NO: 55280 - DNA, 23 bp, Homo sapiens
ttggtgtatgtgcttggctgagg

SEQ ID NO: 55281 - DNA, 21 bp, Homo sapiens
tggtgtatgtgcttggctgag

SEQ ID NO: 55282 - DNA, 18 bp, Homo sapiens
ggtgtatgtgcttggctg

SEQ ID NO: 55283 - DNA, 20 bp, Homo sapiens
ggtgtatgtgcttggctgag

SEQ ID NO: 55284 - DNA, 21 bp, Homo sapiens
ggtgtatgtgcttggctgagg

SEQ ID NO: 55285 - DNA, 22 bp, Homo sapiens
ggtgtatgtgcttggctgagga

SEQ ID NO: 55286 - DNA, 23 bp, Homo sapiens
ggtgtatgtgcttggctgaggag

SEQ ID NO: 55287 - DNA, 24 bp, Homo sapiens
ggtgtatgtgcttggctgaggagc

SEQ ID NO: 55288 - DNA, 30 bp, Homo sapiens
ggtgtatgtgcttggctgaggagccaatgg

SEQ ID NO: 55289 - DNA, 17 bp, Homo sapiens
gtgtatgtgcttggctg

SEQ ID NO: 55290 - DNA, 18 bp, Homo sapiens
gtgtatgtgcttggctga

SEQ ID NO: 55291 - DNA, 19 bp, Homo sapiens
gtgtatgtgcttggctgag

SEQ ID NO: 55292 - DNA, 20 bp, Homo sapiens
gtgtatgtgcttggctgagg

SEQ ID NO: 55293 - DNA, 21 bp, Homo sapiens
gtgtatgtgcttggctgagga

SEQ ID NO: 55294 - DNA, 22 bp, Homo sapiens
gtgtatgtgcttggctgaggag

SEQ ID NO: 55295 - DNA, 24 bp, Homo sapiens
gtgtatgtgcttggctgaggagcc

SEQ ID NO: 55296 - DNA, 18 bp, Homo sapiens
tgtatgtgcttggctgag

SEQ ID NO: 55297 - DNA, 19 bp, Homo sapiens
tgtatgtgcttggctgagg

SEQ ID NO: 55298 - DNA, 20 bp, Homo sapiens
tgtatgtgcttggctgagga

SEQ ID NO: 55299 - DNA, 21 bp, Homo sapiens
tgtatgtgcttggctgaggag

SEQ ID NO: 55300 - DNA, 16 bp, Homo sapiens
gtatgtgcttggctga

SEQ ID NO: 55301 - DNA, 17 bp, Homo sapiens
gtatgtgcttggctgag

SEQ ID NO: 55302 - DNA, 18 bp, Homo sapiens
gtatgtgcttggctgagg

SEQ ID NO: 55303 - DNA, 19 bp, Homo sapiens
gtatgtgcttggctgagga

SEQ ID NO: 55304 - DNA, 20 bp, Homo sapiens
gtatgtgcttggctgaggag

SEQ ID NO: 55305 - DNA, 22 bp, Homo sapiens
gtatgtgcttggctgaggagcc

SEQ ID NO: 55306 - DNA, 23 bp, Homo sapiens
gtatgtgcttggctgaggagcca

SEQ ID NO: 55307 - DNA, 25 bp, Homo sapiens
gtatgtgcttggctgaggagccaat

SEQ ID NO: 55308 - DNA, 16 bp, Homo sapiens
tatgtgcttggctgag

SEQ ID NO: 55309 - DNA, 17 bp, Homo sapiens
tatgtgcttggctgagg

SEQ ID NO: 55310 - DNA, 18 bp, Homo sapiens
tatgtgcttggctgagga

SEQ ID NO: 55311 - DNA, 19 bp, Homo sapiens
tatgtgcttggctgaggag

SEQ ID NO: 55312 - DNA, 21 bp, Homo sapiens
tatgtgcttggctgaggagcc

SEQ ID NO: 55313 - DNA, 22 bp, Homo sapiens
tatgtgcttggctgaggagcca

SEQ ID NO: 55314 - DNA, 16 bp, Homo sapiens
atgtgcttggctgagg

SEQ ID NO: 55315 - DNA, 17 bp, Homo sapiens
atgtgcttggctgagga

SEQ ID NO: 55316 - DNA, 18 bp, Homo sapiens
atgtgcttggctgaggag

SEQ ID NO: 55317 - DNA, 19 bp, Homo sapiens
atgtgcttggctgaggagc

SEQ ID NO: 55318 - DNA, 20 bp, Homo sapiens
atgtgcttggctgaggagcc

SEQ ID NO: 55319 - DNA, 21 bp, Homo sapiens
atgtgcttggctgaggagcca

SEQ ID NO: 55320 - DNA, 23 bp, Homo sapiens
atgtgcttggctgaggagccaat

SEQ ID NO: 55321 - DNA, 29 bp, Homo sapiens
atgtgcttggctgaggagccaatggggcg

SEQ ID NO: 55322 - DNA, 16 bp, Homo sapiens
tgtgcttggctgagga

SEQ ID NO: 55323 - DNA, 17 bp, Homo sapiens
tgtgcttggctgaggag

SEQ ID NO: 55324 - DNA, 19 bp, Homo sapiens
tgtgcttggctgaggagcc

SEQ ID NO: 55325 - DNA, 20 bp, Homo sapiens
tgtgcttggctgaggagcca

SEQ ID NO: 55326 - DNA, 24 bp, Homo sapiens
tgtgcttggctgaggagccaatgg

SEQ ID NO: 55327 - DNA, 29 bp, Homo sapiens
tgtgcttggctgaggagccaatggggcga

SEQ ID NO: 55328 - DNA, 17 bp, Homo sapiens
gtgcttggctgaggagc

SEQ ID NO: 55329 - DNA, 18 bp, Homo sapiens
gtgcttggctgaggagcc

SEQ ID NO: 55330 - DNA, 19 bp, Homo sapiens
gtgcttggctgaggagcca

SEQ ID NO: 55331 - DNA, 21 bp, Homo sapiens
gtgcttggctgaggagccaat

SEQ ID NO: 55332 - DNA, 21 bp, Homo sapiens
gcttggctgaggagccaatgg

SEQ ID NO: 55333 - DNA, 22 bp, Homo sapiens
gcttggctgaggagccaatggg

SEQ ID NO: 55334 - DNA, 24 bp, Homo sapiens
gcttggctgaggagccaatggggc

SEQ ID NO: 55335 - DNA, 26 bp, Homo sapiens
gcttggctgaggagccaatggggcga

SEQ ID NO: 55336 - DNA, 21 bp, Homo sapiens
cttggctgaggagccaatggg

SEQ ID NO: 55337 - DNA, 25 bp, Homo sapiens
cttggctgaggagccaatggggcga

SEQ ID NO: 55338 - DNA, 16 bp, Homo sapiens
ttggctgaggagccaa

SEQ ID NO: 55339 - DNA, 17 bp, Homo sapiens
ttggctgaggagccaat

SEQ ID NO: 55340 - DNA, 22 bp, Homo sapiens
ttggctgaggagccaatggggc

SEQ ID NO: 55341 - DNA, 23 bp, Homo sapiens
ttggctgaggagccaatggggcg

SEQ ID NO: 55342 - DNA, 16 bp, Homo sapiens
tggctgaggagccaat

SEQ ID NO: 55343 - DNA, 17 bp, Homo sapiens
tggctgaggagccaatg

SEQ ID NO: 55344 - DNA, 18 bp, Homo sapiens
tggctgaggagccaatgg

SEQ ID NO: 55345 - DNA, 19 bp, Homo sapiens
tggctgaggagccaatggg

SEQ ID NO: 55346 - DNA, 20 bp, Homo sapiens
tggctgaggagccaatgggg

SEQ ID NO: 55347 - DNA, 21 bp, Homo sapiens
tggctgaggagccaatggggc

SEQ ID NO: 55348 - DNA, 22 bp, Homo sapiens
tggctgaggagccaatggggcg

SEQ ID NO: 55349 - DNA, 23 bp, Homo sapiens
tggctgaggagccaatggggcga

SEQ ID NO: 55350 - DNA, 24 bp, Homo sapiens
tggctgaggagccaatggggcgaa

SEQ ID NO: 55351 - DNA, 25 bp, Homo sapiens
tggctgaggagccaatggggcgaag

SEQ ID NO: 55352 - DNA, 26 bp, Homo sapiens
tggctgaggagccaatggggcgaagc

SEQ ID NO: 55353 - DNA, 27 bp, Homo sapiens
tggctgaggagccaatggggcgaagct

SEQ ID NO: 55354 - DNA, 16 bp, Homo sapiens
ggctgaggagccaatg

SEQ ID NO: 55355 - DNA, 17 bp, Homo sapiens
ggctgaggagccaatgg

SEQ ID NO: 55356 - DNA, 18 bp, Homo sapiens
ggctgaggagccaatggg

SEQ ID NO: 55357 - DNA, 19 bp, Homo sapiens
ggctgaggagccaatgggg

SEQ ID NO: 55358 - DNA, 20 bp, Homo sapiens
ggctgaggagccaatggggc

SEQ ID NO: 55359 - DNA, 21 bp, Homo sapiens
ggctgaggagccaatggggcg

SEQ ID NO: 55360 - DNA, 22 bp, Homo sapiens
ggctgaggagccaatggggcga

SEQ ID NO: 55361 - DNA, 23 bp, Homo sapiens
ggctgaggagccaatggggcgaa

SEQ ID NO: 55362 - DNA, 24 bp, Homo sapiens
ggctgaggagccaatggggcgaag

SEQ ID NO: 55363 - DNA, 25 bp, Homo sapiens
ggctgaggagccaatggggcgaagc

SEQ ID NO: 55364 - DNA, 26 bp, Homo sapiens
ggctgaggagccaatggggcgaagct

SEQ ID NO: 55365 - DNA, 27 bp, Homo sapiens
ggctgaggagccaatggggcgaagcta

SEQ ID NO: 55366 - DNA, 29 bp, Homo sapiens
ggctgaggagccaatggggcgaagctacc

SEQ ID NO: 55367 - DNA, 19 bp, Homo sapiens
gctgaggagccaatggggc

SEQ ID NO: 55368 - DNA, 20 bp, Homo sapiens
gctgaggagccaatggggcg

SEQ ID NO: 55369 - DNA, 28 bp, Homo sapiens
gctgaggagccaatggggcgaagctacc

SEQ ID NO: 55370 - DNA, 16 bp, Homo sapiens
ctgaggagccaatggg

SEQ ID NO: 55371 - DNA, 17 bp, Homo sapiens
ctgaggagccaatgggg

SEQ ID NO: 55372 - DNA, 21 bp, Homo sapiens
ctgaggagccaatggggcgaa

SEQ ID NO: 55373 - DNA, 22 bp, Homo sapiens
ctgaggagccaatggggcgaag

SEQ ID NO: 55374 - DNA, 23 bp, Homo sapiens
ctgaggagccaatggggcgaagc

SEQ ID NO: 55375 - DNA, 24 bp, Homo sapiens
ctgaggagccaatggggcgaagct

SEQ ID NO: 55376 - DNA, 22 bp, Homo sapiens
tgaggagccaatggggcgaagc

SEQ ID NO: 55377 - DNA, 23 bp, Homo sapiens
tgaggagccaatggggcgaagct

SEQ ID NO: 55378 - DNA, 20 bp, Homo sapiens
gaggagccaatggggcgaag

SEQ ID NO: 55379 - DNA, 21 bp, Homo sapiens
gaggagccaatggggcgaagc

SEQ ID NO: 55380 - DNA, 22 bp, Homo sapiens
gaggagccaatggggcgaagct

SEQ ID NO: 55381 - DNA, 25 bp, Homo sapiens
gaggagccaatggggcgaagctacc

SEQ ID NO: 55382 - DNA, 30 bp, Homo sapiens; identical to SEQ ID NO: 27536

SEQ ID NO: 55383 - DNA, 21 bp, Homo sapiens
aggagccaatggggcgaagct

SEQ ID NO: 55384 - DNA, 23 bp, Homo sapiens
tggggcgaagctaccatctgtgg

SEQ ID NO: 55385 - DNA, 20 bp, Homo sapiens
ggggcgaagctaccatctgt

SEQ ID NO: 55386 - DNA, 22 bp, Homo sapiens
ggggcgaagctaccatctgtgg

SEQ ID NO: 55387 - DNA, 23 bp, Homo sapiens
ggggcgaagctaccatctgtggg

SEQ ID NO: 55388 - DNA, 29 bp, Homo sapiens
ggggcgaagctaccatctgtgggattatg

SEQ ID NO: 55389 - DNA, 30 bp, Homo sapiens
ggggcgaagctaccatctgtgggattatga

SEQ ID NO: 55390 - DNA, 19 bp, Homo sapiens
gggcgaagctaccatctgt

SEQ ID NO: 55391 - DNA, 20 bp, Homo sapiens
gggcgaagctaccatctgtg

SEQ ID NO: 55392 - DNA, 21 bp, Homo sapiens
gggcgaagctaccatctgtgg

SEQ ID NO: 55393 - DNA, 30 bp, Homo sapiens
gggcgaagctaccatctgtgggattatgac

SEQ ID NO: 55394 - DNA, 18 bp, Homo sapiens
ggcgaagctaccatctgt

SEQ ID NO: 55395 - DNA, 19 bp, Homo sapiens
ggcgaagctaccatctgtg

SEQ ID NO: 55396 - DNA, 20 bp, Homo sapiens
ggcgaagctaccatctgtgg

SEQ ID NO: 55397 - DNA, 21 bp, Homo sapiens
ggcgaagctaccatctgtggg

SEQ ID NO: 55398 - DNA, 30 bp, Homo sapiens; identical to SEQ ID NO: 27553

SEQ ID NO: 55399 - DNA, 17 bp, Homo sapiens
gcgaagctaccatctgt

SEQ ID NO: 55400 - DNA, 18 bp, Homo sapiens
gcgaagctaccatctgtg

SEQ ID NO: 55401 - DNA, 19 bp, Homo sapiens
gcgaagctaccatctgtgg

SEQ ID NO: 55402 - DNA, 20 bp, Homo sapiens
gcgaagctaccatctgtggg

SEQ ID NO: 55403 - DNA, 21 bp, Homo sapiens
gcgaagctaccatctgtggga

SEQ ID NO: 55404 - DNA, 22 bp, Homo sapiens
gcgaagctaccatctgtgggat

SEQ ID NO: 55405 - DNA, 23 bp, Homo sapiens
gcgaagctaccatctgtgggatt

SEQ ID NO: 55406 - DNA, 26 bp, Homo sapiens
gcgaagctaccatctgtgggattatg

SEQ ID NO: 55407 - DNA, 27 bp, Homo sapiens
gcgaagctaccatctgtgggattatga

SEQ ID NO: 55408 - DNA, 30 bp, Homo sapiens
gcgaagctaccatctgtgggattatgactg

SEQ ID NO: 55409 - DNA, 17 bp, Homo sapiens
cgaagctaccatctgtg

SEQ ID NO: 55410 - DNA, 18 bp, Homo sapiens
cgaagctaccatctgtgg

SEQ ID NO: 55411 - DNA, 19 bp, Homo sapiens
cgaagctaccatctgtggg

SEQ ID NO: 55412 - DNA, 20 bp, Homo sapiens
cgaagctaccatctgtggga

SEQ ID NO: 55413 - DNA, 21 bp, Homo sapiens
cgaagctaccatctgtgggat

SEQ ID NO: 55414 - DNA, 22 bp, Homo sapiens
cgaagctaccatctgtgggatt

SEQ ID NO: 55415 - DNA, 25 bp, Homo sapiens
cgaagctaccatctgtgggattatg

SEQ ID NO: 55416 - DNA, 26 bp, Homo sapiens
cgaagctaccatctgtgggattatga

SEQ ID NO: 55417 - DNA, 29 bp, Homo sapiens
cgaagctaccatctgtgggattatgactg

SEQ ID NO: 55418 - DNA, 21 bp, Homo sapiens
gaagctaccatctgtgggatt

SEQ ID NO: 55419 - DNA, 29 bp, Homo sapiens
gaagctaccatctgtgggattatgactga

SEQ ID NO: 55420 - DNA, 16 bp, Homo sapiens
aagctaccatctgtgg

SEQ ID NO: 55421 - DNA, 17 bp, Homo sapiens
aagctaccatctgtggg

SEQ ID NO: 55422 - DNA, 20 bp, Homo sapiens
aagctaccatctgtgggatt

SEQ ID NO: 55423 - DNA, 23 bp, Homo sapiens
aagctaccatctgtgggattatg

SEQ ID NO: 55424 - DNA, 24 bp, Homo sapiens
aagctaccatctgtgggattatga

SEQ ID NO: 55425 - DNA, 27 bp, Homo sapiens
aagctaccatctgtgggattatgactg

SEQ ID NO: 55426 - DNA, 28 bp, Homo sapiens
aagctaccatctgtgggattatgactga

SEQ ID NO: 55427 - DNA, 30 bp, Homo sapiens
aagctaccatctgtgggattatgactgaac

SEQ ID NO: 55428 - DNA, 22 bp, Homo sapiens
agctaccatctgtgggattatg

SEQ ID NO: 55429 - DNA, 23 bp, Homo sapiens
agctaccatctgtgggattatga

SEQ ID NO: 55430 - DNA, 24 bp, Homo sapiens
agctaccatctgtgggattatgac

SEQ ID NO: 55431 - DNA, 26 bp, Homo sapiens
agctaccatctgtgggattatgactg

SEQ ID NO: 55432 - DNA, 27 bp, Homo sapiens
agctaccatctgtgggattatgactga

SEQ ID NO: 55433 - DNA, 28 bp, Homo sapiens
agctaccatctgtgggattatgactgaa

SEQ ID NO: 55434 - DNA, 30 bp, Homo sapiens
agctaccatctgtgggattatgactgaacg

SEQ ID NO: 55435 - DNA, 21 bp, Homo sapiens
gctaccatctgtgggattatg

SEQ ID NO: 55436 - DNA, 22 bp, Homo sapiens
gctaccatctgtgggattatga

SEQ ID NO: 55437 - DNA, 23 bp, Homo sapiens
gctaccatctgtgggattatgac

SEQ ID NO: 55438 - DNA, 25 bp, Homo sapiens
gctaccatctgtgggattatgactg

SEQ ID NO: 55439 - DNA, 26 bp, Homo sapiens
gctaccatctgtgggattatgactga

SEQ ID NO: 55440 - DNA, 27 bp, Homo sapiens
gctaccatctgtgggattatgactgaa

SEQ ID NO: 55441 - DNA, 28 bp, Homo sapiens
gctaccatctgtgggattatgactgaac

SEQ ID NO: 55442 - DNA, 29 bp, Homo sapiens
gctaccatctgtgggattatgactgaacg

SEQ ID NO: 55443 - DNA, 30 bp, Homo sapiens
gctaccatctgtgggattatgactgaacgc

SEQ ID NO: 55444 - DNA, 20 bp, Homo sapiens
ctaccatctgtgggattatg

SEQ ID NO: 55445 - DNA, 21 bp, Homo sapiens
ctaccatctgtgggattatga

SEQ ID NO: 55446 - DNA, 24 bp, Homo sapiens
ctaccatctgtgggattatgactg

SEQ ID NO: 55447 - DNA, 25 bp, Homo sapiens
ctaccatctgtgggattatgactga

SEQ ID NO: 55448 - DNA, 26 bp, Homo sapiens
ctaccatctgtgggattatgactgaa

SEQ ID NO: 55449 - DNA, 27 bp, Homo sapiens
ctaccatctgtgggattatgactgaac

SEQ ID NO: 55450 - DNA, 28 bp, Homo sapiens
ctaccatctgtgggattatgactgaacg

SEQ ID NO: 55451 - DNA, 29 bp, Homo sapiens
ctaccatctgtgggattatgactgaacgc

SEQ ID NO: 55452 - DNA, 30 bp, Homo sapiens; identical to SEQ ID NO: 6277

SEQ ID NO: 55453 - DNA, 20 bp, Homo sapiens
taccatctgtgggattatga

SEQ ID NO: 55454 - DNA, 21 bp, Homo sapiens
taccatctgtgggattatgac

SEQ ID NO: 55455 - DNA, 22 bp, Homo sapiens
taccatctgtgggattatgact

SEQ ID NO: 55456 - DNA, 23 bp, Homo sapiens
taccatctgtgggattatgactg

SEQ ID NO: 55457 - DNA, 24 bp, Homo sapiens
taccatctgtgggattatgactga

SEQ ID NO: 55458 - DNA, 26 bp, Homo sapiens
taccatctgtgggattatgactgaac

SEQ ID NO: 55459 - DNA, 27 bp, Homo sapiens
taccatctgtgggattatgactgaacg

SEQ ID NO: 55460 - DNA, 28 bp, Homo sapiens
taccatctgtgggattatgactgaacgc

SEQ ID NO: 55461 - DNA, 29 bp, Homo sapiens
taccatctgtgggattatgactgaacgcc

SEQ ID NO: 55462 - DNA, 30 bp, Homo sapiens; identical to SEQ ID NO: 6280

SEQ ID NO: 55463 - DNA, 18 bp, Homo sapiens
accatctgtgggattatg

SEQ ID NO: 55464 - DNA, 19 bp, Homo sapiens
accatctgtgggattatga

SEQ ID NO: 55465 - DNA, 20 bp, Homo sapiens
accatctgtgggattatgac

SEQ ID NO: 55466 - DNA, 21 bp, Homo sapiens
accatctgtgggattatgact

SEQ ID NO: 55467 - DNA, 22 bp, Homo sapiens
accatctgtgggattatgactg

SEQ ID NO: 55468 - DNA, 23 bp, Homo sapiens
accatctgtgggattatgactga

SEQ ID NO: 55469 - DNA, 24 bp, Homo sapiens
accatctgtgggattatgactgaa

SEQ ID NO: 55470 - DNA, 25 bp, Homo sapiens
accatctgtgggattatgactgaac

SEQ ID NO: 55471 - DNA, 26 bp, Homo sapiens
accatctgtgggattatgactgaacg

SEQ ID NO: 55472 - DNA, 27 bp, Homo sapiens
accatctgtgggattatgactgaacgc

SEQ ID NO: 55473 - DNA, 28 bp, Homo sapiens
accatctgtgggattatgactgaacgcc

SEQ ID NO: 55474 - DNA, 29 bp, Homo sapiens
accatctgtgggattatgactgaacgcct

SEQ ID NO: 55475 - DNA, 30 bp, Homo sapiens; identical to SEQ ID NO: 6288

SEQ ID NO: 55476 - DNA, 17 bp, Homo sapiens
ccatctgtgggattatg

SEQ ID NO: 55477 - DNA, 18 bp, Homo sapiens
ccatctgtgggattatga

SEQ ID NO: 55478 - DNA, 19 bp, Homo sapiens
ccatctgtgggattatgac

SEQ ID NO: 55479 - DNA, 20 bp, Homo sapiens
ccatctgtgggattatgact

SEQ ID NO: 55480 - DNA, 21 bp, Homo sapiens
ccatctgtgggattatgactg

SEQ ID NO: 55481 - DNA, 22 bp, Homo sapiens
ccatctgtgggattatgactga

SEQ ID NO: 55482 - DNA, 23 bp, Homo sapiens
ccatctgtgggattatgactgaa

SEQ ID NO: 55483 - DNA, 24 bp, Homo sapiens
ccatctgtgggattatgactgaac

SEQ ID NO: 55484 - DNA, 25 bp, Homo sapiens
ccatctgtgggattatgactgaacg

SEQ ID NO: 55485 - DNA, 26 bp, Homo sapiens
ccatctgtgggattatgactgaacgc

SEQ ID NO: 55486 - DNA, 27 bp, Homo sapiens
ccatctgtgggattatgactgaacgcc

SEQ ID NO: 55487 - DNA, 28 bp, Homo sapiens
ccatctgtgggattatgactgaacgcct

SEQ ID NO: 55488 - DNA, 29 bp, Homo sapiens
ccatctgtgggattatgactgaacgcctc

SEQ ID NO: 55489 - DNA, 30 bp, Homo sapiens; identical to SEQ ID NO: 27622

SEQ ID NO: 55490 - DNA, 17 bp, Homo sapiens
catctgtgggattatga

SEQ ID NO: 55491 - DNA, 18 bp, Homo sapiens
catctgtgggattatgac

SEQ ID NO: 55492 - DNA, 19 bp, Homo sapiens
catctgtgggattatgact

SEQ ID NO: 55493 - DNA, 20 bp, Homo sapiens
catctgtgggattatgactg

SEQ ID NO: 55494 - DNA, 21 bp, Homo sapiens
catctgtgggattatgactga

SEQ ID NO: 55495 - DNA, 22 bp, Homo sapiens
catctgtgggattatgactgaa

SEQ ID NO: 55496 - DNA, 23 bp, Homo sapiens
catctgtgggattatgactgaac

SEQ ID NO: 55497 - DNA, 24 bp, Homo sapiens
catctgtgggattatgactgaacg

SEQ ID NO: 55498 - DNA, 25 bp, Homo sapiens
catctgtgggattatgactgaacgc

SEQ ID NO: 55499 - DNA, 26 bp, Homo sapiens
catctgtgggattatgactgaacgcc

SEQ ID NO: 55500 - DNA, 27 bp, Homo sapiens
catctgtgggattatgactgaacgcct

SEQ ID NO: 55501 - DNA, 28 bp, Homo sapiens
catctgtgggattatgactgaacgcctc

SEQ ID NO: 55502 - DNA, 29 bp, Homo sapiens
catctgtgggattatgactgaacgcctct

SEQ ID NO: 55503 - DNA, 17 bp, Homo sapiens
atctgtgggattatgac

SEQ ID NO: 55504 - DNA, 18 bp, Homo sapiens
atctgtgggattatgact

SEQ ID NO: 55505 - DNA, 19 bp, Homo sapiens
atctgtgggattatgactg

SEQ ID NO: 55506 - DNA, 20 bp, Homo sapiens
atctgtgggattatgactga

SEQ ID NO: 55507 - DNA, 21 bp, Homo sapiens
atctgtgggattatgactgaa

SEQ ID NO: 55508 - DNA, 22 bp, Homo sapiens
atctgtgggattatgactgaac

SEQ ID NO: 55509 - DNA, 23 bp, Homo sapiens
atctgtgggattatgactgaacg

SEQ ID NO: 55510 - DNA, 24 bp, Homo sapiens
atctgtgggattatgactgaacgc

SEQ ID NO: 55511 - DNA, 25 bp, Homo sapiens
atctgtgggattatgactgaacgcc

SEQ ID NO: 55512 - DNA, 26 bp, Homo sapiens
atctgtgggattatgactgaacgcct

SEQ ID NO: 55513 - DNA, 27 bp, Homo sapiens
atctgtgggattatgactgaacgcctc

SEQ ID NO: 55514 - DNA, 28 bp, Homo sapiens
atctgtgggattatgactgaacgcctct

SEQ ID NO: 55515 - DNA, 29 bp, Homo sapiens
atctgtgggattatgactgaacgcctcta

SEQ ID NO: 55516 - DNA, 16 bp, Homo sapiens
tctgtgggattatgac

SEQ ID NO: 55517 - DNA, 17 bp, Homo sapiens
tctgtgggattatgact

SEQ ID NO: 55518 - DNA, 18 bp, Homo sapiens
tctgtgggattatgactg

SEQ ID NO: 55519 - DNA, 19 bp, Homo sapiens
tctgtgggattatgactga

SEQ ID NO: 55520 - DNA, 20 bp, Homo sapiens
tctgtgggattatgactgaa

SEQ ID NO: 55521 - DNA, 21 bp, Homo sapiens
tctgtgggattatgactgaac

SEQ ID NO: 55522 - DNA, 22 bp, Homo sapiens
tctgtgggattatgactgaacg

SEQ ID NO: 55523 - DNA, 23 bp, Homo sapiens
tctgtgggattatgactgaacgc

SEQ ID NO: 55524 - DNA, 24 bp, Homo sapiens
tctgtgggattatgactgaacgcc

SEQ ID NO: 55525 - DNA, 25 bp, Homo sapiens
tctgtgggattatgactgaacgcct

SEQ ID NO: 55526 - DNA, 26 bp, Homo sapiens
tctgtgggattatgactgaacgcctc

SEQ ID NO: 55527 - DNA, 27 bp, Homo sapiens
tctgtgggattatgactgaacgcctct

SEQ ID NO: 55528 - DNA, 28 bp, Homo sapiens
tctgtgggattatgactgaacgcctcta

SEQ ID NO: 55529 - DNA, 29 bp, Homo sapiens
tctgtgggattatgactgaacgcctctaa

SEQ ID NO: 55530 - DNA, 30 bp, Homo sapiens
tctgtgggattatgactgaacgcctctaag

SEQ ID NO: 55531 - DNA, 16 bp, Homo sapiens
ctgtgggattatgact

SEQ ID NO: 55532 - DNA, 17 bp, Homo sapiens
ctgtgggattatgactg

SEQ ID NO: 55533 - DNA, 18 bp, Homo sapiens
ctgtgggattatgactga

SEQ ID NO: 55534 - DNA, 19 bp, Homo sapiens
ctgtgggattatgactgaa

SEQ ID NO: 55535 - DNA, 20 bp, Homo sapiens
ctgtgggattatgactgaac

SEQ ID NO: 55536 - DNA, 21 bp, Homo sapiens
ctgtgggattatgactgaacg

SEQ ID NO: 55537 - DNA, 22 bp, Homo sapiens
ctgtgggattatgactgaacgc

SEQ ID NO: 55538 - DNA, 23 bp, Homo sapiens
ctgtgggattatgactgaacgcc

SEQ ID NO: 55539 - DNA, 24 bp, Homo sapiens
ctgtgggattatgactgaacgcct

SEQ ID NO: 55540 - DNA, 25 bp, Homo sapiens
ctgtgggattatgactgaacgcctc

SEQ ID NO: 55541 - DNA, 26 bp, Homo sapiens
ctgtgggattatgactgaacgcctct

SEQ ID NO: 55542 - DNA, 27 bp, Homo sapiens
ctgtgggattatgactgaacgcctcta

SEQ ID NO: 55543 - DNA, 28 bp, Homo sapiens
ctgtgggattatgactgaacgcctctaa

SEQ ID NO: 55544 - DNA, 29 bp, Homo sapiens
ctgtgggattatgactgaacgcctctaag

SEQ ID NO: 55545 - DNA, 30 bp, Homo sapiens
ctgtgggattatgactgaacgcctctaagt

SEQ ID NO: 55546 - DNA, 16 bp, Homo sapiens
tgtgggattatgactg

SEQ ID NO: 55547 - DNA, 17 bp, Homo sapiens
tgtgggattatgactga

SEQ ID NO: 55548 - DNA, 18 bp, Homo sapiens
tgtgggattatgactgaa

SEQ ID NO: 55549 - DNA, 19 bp, Homo sapiens
tgtgggattatgactgaac

SEQ ID NO: 55550 - DNA, 20 bp, Homo sapiens
tgtgggattatgactgaacg

SEQ ID NO: 55551 - DNA, 21 bp, Homo sapiens
tgtgggattatgactgaacgc

SEQ ID NO: 55552 - DNA, 22 bp, Homo sapiens
tgtgggattatgactgaacgcc

SEQ ID NO: 55553 - DNA, 23 bp, Homo sapiens
tgtgggattatgactgaacgcct

SEQ ID NO: 55554 - DNA, 24 bp, Homo sapiens
tgtgggattatgactgaacgcctc

SEQ ID NO: 55555 - DNA, 25 bp, Homo sapiens
tgtgggattatgactgaacgcctct

SEQ ID NO: 55556 - DNA, 16 bp, Homo sapiens
gtgggattatgactga

SEQ ID NO: 55557 - DNA, 17 bp, Homo sapiens
gtgggattatgactgaa

SEQ ID NO: 55558 - DNA, 18 bp, Homo sapiens
gtgggattatgactgaac

SEQ ID NO: 55559 - DNA, 19 bp, Homo sapiens
gtgggattatgactgaacg

SEQ ID NO: 55560 - DNA, 20 bp, Homo sapiens
gtgggattatgactgaacgc

SEQ ID NO: 55561 - DNA, 21 bp, Homo sapiens
gtgggattatgactgaacgcc

SEQ ID NO: 55562 - DNA, 22 bp, Homo sapiens
gtgggattatgactgaacgcct

SEQ ID NO: 55563 - DNA, 23 bp, Homo sapiens
gtgggattatgactgaacgcctc

SEQ ID NO: 55564 - DNA, 24 bp, Homo sapiens
gtgggattatgactgaacgcctct

SEQ ID NO: 55565 - DNA, 16 bp, Homo sapiens
tgggattatgactgaa

SEQ ID NO: 55566 - DNA, 17 bp, Homo sapiens
tgggattatgactgaac

SEQ ID NO: 55567 - DNA, 18 bp, Homo sapiens
tgggattatgactgaacg

SEQ ID NO: 55568 - DNA, 19 bp, Homo sapiens
tgggattatgactgaacgc

SEQ ID NO: 55569 - DNA, 20 bp, Homo sapiens
tgggattatgactgaacgcc

SEQ ID NO: 55570 - DNA, 21 bp, Homo sapiens
tgggattatgactgaacgcct

SEQ ID NO: 55571 - DNA, 22 bp, Homo sapiens
tgggattatgactgaacgcctc

SEQ ID NO: 55572 - DNA, 23 bp, Homo sapiens
tgggattatgactgaacgcctct

SEQ ID NO: 55573 - DNA, 24 bp, Homo sapiens
tgggattatgactgaacgcctcta

SEQ ID NO: 55574 - DNA, 25 bp, Homo sapiens
tgggattatgactgaacgcctctaa

SEQ ID NO: 55575 - DNA, 26 bp, Homo sapiens
tgggattatgactgaacgcctctaag

SEQ ID NO: 55576 - DNA, 16 bp, Homo sapiens
gggattatgactgaac

SEQ ID NO: 55577 - DNA, 17 bp, Homo sapiens
gggattatgactgaacg

SEQ ID NO: 55578 - DNA, 18 bp, Homo sapiens
gggattatgactgaacgc

SEQ ID NO: 55579 - DNA, 19 bp, Homo sapiens
gggattatgactgaacgcc

SEQ ID NO: 55580 - DNA, 20 bp, Homo sapiens
gggattatgactgaacgcct

SEQ ID NO: 55581 - DNA, 21 bp, Homo sapiens
gggattatgactgaacgcctc

SEQ ID NO: 55582 - DNA, 22 bp, Homo sapiens
gggattatgactgaacgcctct

SEQ ID NO: 55583 - DNA, 23 bp, Homo sapiens
gggattatgactgaacgcctcta

SEQ ID NO: 55584 - DNA, 24 bp, Homo sapiens
gggattatgactgaacgcctctaa

SEQ ID NO: 55585 - DNA, 25 bp, Homo sapiens
gggattatgactgaacgcctctaag

SEQ ID NO: 55586 - DNA, 26 bp, Homo sapiens
gggattatgactgaacgcctctaagt

SEQ ID NO: 55587 - DNA, 16 bp, Homo sapiens
ggattatgactgaacg

SEQ ID NO: 55588 - DNA, 17 bp, Homo sapiens
ggattatgactgaacgc

SEQ ID NO: 55589 - DNA, 18 bp, Homo sapiens
ggattatgactgaacgcc

SEQ ID NO: 55590 - DNA, 19 bp, Homo sapiens
ggattatgactgaacgcct

SEQ ID NO: 55591 - DNA, 20 bp, Homo sapiens
ggattatgactgaacgcctc

SEQ ID NO: 55592 - DNA, 21 bp, Homo sapiens
ggattatgactgaacgcctct

SEQ ID NO: 55593 - DNA, 22 bp, Homo sapiens
ggattatgactgaacgcctcta

SEQ ID NO: 55594 - DNA, 23 bp, Homo sapiens
ggattatgactgaacgcctctaa

SEQ ID NO: 55595 - DNA, 24 bp, Homo sapiens
ggattatgactgaacgcctctaag

SEQ ID NO: 55596 - DNA, 25 bp, Homo sapiens
ggattatgactgaacgcctctaagt

SEQ ID NO: 55597 - DNA, 16 bp, Homo sapiens
gattatgactgaacgc

SEQ ID NO: 55598 - DNA, 17 bp, Homo sapiens
gattatgactgaacgcc

SEQ ID NO: 55599 - DNA, 18 bp, Homo sapiens
gattatgactgaacgcct

SEQ ID NO: 55600 - DNA, 19 bp, Homo sapiens
gattatgactgaacgcctc

SEQ ID NO: 55601 - DNA, 20 bp, Homo sapiens
gattatgactgaacgcctct

SEQ ID NO: 55602 - DNA, 21 bp, Homo sapiens
gattatgactgaacgcctcta

SEQ ID NO: 55603 - DNA, 22 bp, Homo sapiens
gattatgactgaacgcctctaa

SEQ ID NO: 55604 - DNA, 23 bp, Homo sapiens
gattatgactgaacgcctctaag

SEQ ID NO: 55605 - DNA, 24 bp, Homo sapiens
gattatgactgaacgcctctaagt

SEQ ID NO: 55606 - DNA, 26 bp, Homo sapiens
gattatgactgaacgcctctaagtca

SEQ ID NO: 55607 - DNA, 27 bp, Homo sapiens
gattatgactgaacgcctctaagtcag

SEQ ID NO: 55608 - DNA, 17 bp, Homo sapiens
attatgactgaacgcct

SEQ ID NO: 55609 - DNA, 18 bp, Homo sapiens
attatgactgaacgcctc

SEQ ID NO: 55610 - DNA, 19 bp, Homo sapiens
attatgactgaacgcctct

SEQ ID NO: 55611 - DNA, 20 bp, Homo sapiens
attatgactgaacgcctcta

SEQ ID NO: 55612 - DNA, 21 bp, Homo sapiens
attatgactgaacgcctctaa

SEQ ID NO: 55613 - DNA, 22 bp, Homo sapiens
attatgactgaacgcctctaag

SEQ ID NO: 55614 - DNA, 23 bp, Homo sapiens
attatgactgaacgcctctaagt

SEQ ID NO: 55615 - DNA, 17 bp, Homo sapiens
ttatgactgaacgcctc

SEQ ID NO: 55616 - DNA, 18 bp, Homo sapiens
ttatgactgaacgcctct

SEQ ID NO: 55617 - DNA, 19 bp, Homo sapiens
ttatgactgaacgcctcta

SEQ ID NO: 55618 - DNA, 20 bp, Homo sapiens
ttatgactgaacgcctctaa

SEQ ID NO: 55619 - DNA, 21 bp, Homo sapiens
ttatgactgaacgcctctaag

SEQ ID NO: 55620 - DNA, 22 bp, Homo sapiens
ttatgactgaacgcctctaagt

SEQ ID NO: 55621 - DNA, 17 bp, Homo sapiens
tatgactgaacgcctct

SEQ ID NO: 55622 - DNA, 18 bp, Homo sapiens
tatgactgaacgcctcta

SEQ ID NO: 55623 - DNA, 19 bp, Homo sapiens
tatgactgaacgcctctaa

SEQ ID NO: 55624 - DNA, 20 bp, Homo sapiens
tatgactgaacgcctctaag

SEQ ID NO: 55625 - DNA, 21 bp, Homo sapiens
tatgactgaacgcctctaagt

SEQ ID NO: 55626 - DNA, 16 bp, Homo sapiens
atgactgaacgcctct

SEQ ID NO: 55627 - DNA, 17 bp, Homo sapiens
atgactgaacgcctcta

SEQ ID NO: 55628 - DNA, 18 bp, Homo sapiens
atgactgaacgcctctaa

SEQ ID NO: 55629 - DNA, 19 bp, Homo sapiens
atgactgaacgcctctaag

SEQ ID NO: 55630 - DNA, 20 bp, Homo sapiens
atgactgaacgcctctaagt

SEQ ID NO: 55631 - DNA, 21 bp, Homo sapiens
atgactgaacgcctctaagtc

SEQ ID NO: 55632 - DNA, 18 bp, Homo sapiens
tgactgaacgcctctaag

SEQ ID NO: 55633 - DNA, 19 bp, Homo sapiens
tgactgaacgcctctaagt

SEQ ID NO: 55634 - DNA, 20 bp, Homo sapiens
tgactgaacgcctctaagtc

SEQ ID NO: 55635 - DNA, 23 bp, Homo sapiens
tgactgaacgcctctaagtcaga

SEQ ID NO: 55636 - DNA, 17 bp, Homo sapiens
gactgaacgcctctaag

SEQ ID NO: 55637 - DNA, 18 bp, Homo sapiens
gactgaacgcctctaagt

SEQ ID NO: 55638 - DNA, 16 bp, Homo sapiens
actgaacgcctctaag

SEQ ID NO: 55639 - DNA, 17 bp, Homo sapiens
actgaacgcctctaagt

SEQ ID NO: 55640 - DNA, 18 bp, Homo sapiens
actgaacgcctctaagtc

SEQ ID NO: 55641 - DNA, 19 bp, Homo sapiens
actgaacgcctctaagtca

SEQ ID NO: 55642 - DNA, 20 bp, Homo sapiens
actgaacgcctctaagtcag

SEQ ID NO: 55643 - DNA, 21 bp, Homo sapiens
actgaacgcctctaagtcaga

SEQ ID NO: 55644 - DNA, 16 bp, Homo sapiens
ctgaacgcctctaagt

SEQ ID NO: 55645 - DNA, 17 bp, Homo sapiens
ctgaacgcctctaagtc

SEQ ID NO: 55646 - DNA, 18 bp, Homo sapiens
ctgaacgcctctaagtca

SEQ ID NO: 55647 - DNA, 19 bp, Homo sapiens
ctgaacgcctctaagtcag

SEQ ID NO: 55648 - DNA, 20 bp, Homo sapiens
ctgaacgcctctaagtcaga

SEQ ID NO: 55649 - DNA, 21 bp, Homo sapiens
ctgaacgcctctaagtcagaa

SEQ ID NO: 55650 - DNA, 23 bp, Homo sapiens
cgcctctaagtcagaatcccgcc

SEQ ID NO: 55651 - DNA, 24 bp, Homo sapiens
cctctaagtcagaatcccgcccag

SEQ ID NO: 55652 - DNA, 22 bp, Homo sapiens
tctaagtcagaatcccgcccag

SEQ ID NO: 55653 - DNA, 18 bp, Homo sapiens
ctaagtcagaatcccgcc

SEQ ID NO: 55654 - DNA, 19 bp, Homo sapiens
ctaagtcagaatcccgccc

SEQ ID NO: 55655 - DNA, 21 bp, Homo sapiens
ctaagtcagaatcccgcccag

SEQ ID NO: 55656 - DNA, 24 bp, Homo sapiens
ctaagtcagaatcccgcccaggcg

SEQ ID NO: 55657 - DNA, 29 bp, Homo sapiens
ctaagtcagaatcccgcccaggcggaacg

SEQ ID NO: 55658 - DNA, 19 bp, Homo sapiens
aagtcagaatcccgcccag

SEQ ID NO: 55659 - DNA, 20 bp, Homo sapiens
aagtcagaatcccgcccagg

SEQ ID NO: 55660 - DNA, 21 bp, Homo sapiens
aagtcagaatcccgcccaggc

SEQ ID NO: 55661 - DNA, 22 bp, Homo sapiens
aagtcagaatcccgcccaggcg

SEQ ID NO: 55662 - DNA, 18 bp, Homo sapiens
agtcagaatcccgcccag

SEQ ID NO: 55663 - DNA, 22 bp, Homo sapiens
agtcagaatcccgcccaggcgg

SEQ ID NO: 55664 - DNA, 17 bp, Homo sapiens
gtcagaatcccgcccag

SEQ ID NO: 55665 - DNA, 19 bp, Homo sapiens
gtcagaatcccgcccaggc

SEQ ID NO: 55666 - DNA, 16 bp, Homo sapiens
tcagaatcccgcccag

SEQ ID NO: 55667 - DNA, 20 bp, Homo sapiens
tcagaatcccgcccaggcgg

SEQ ID NO: 55668 - DNA, 21 bp, Homo sapiens
tcagaatcccgcccaggcgga

SEQ ID NO: 55669 - DNA, 19 bp, Homo sapiens
cagaatcccgcccaggcgg

SEQ ID NO: 55670 - DNA, 23 bp, Homo sapiens
cccgcccaggcggaacgatacgg

SEQ ID NO: 55671 - DNA, 24 bp, Homo sapiens
cccgcccaggcggaacgatacggc

SEQ ID NO: 55672 - DNA, 22 bp, Homo sapiens
ccgcccaggcggaacgatacgg

SEQ ID NO: 55673 - DNA, 23 bp, Homo sapiens
ccgcccaggcggaacgatacggc

SEQ ID NO: 55674 - DNA, 16 bp, Homo sapiens
cgcccaggcggaacga

SEQ ID NO: 55675 - DNA, 17 bp, Homo sapiens
cgcccaggcggaacgat

SEQ ID NO: 55676 - DNA, 21 bp, Homo sapiens
cgcccaggcggaacgatacgg

SEQ ID NO: 55677 - DNA, 22 bp, Homo sapiens
cgcccaggcggaacgatacggc

SEQ ID NO: 55678 - DNA, 20 bp, Homo sapiens
gcccaggcggaacgatacgg

SEQ ID NO: 55679 - DNA, 21 bp, Homo sapiens
gcccaggcggaacgatacggc

SEQ ID NO: 55680 - DNA, 19 bp, Homo sapiens
cccaggcggaacgatacgg

SEQ ID NO: 55681 - DNA, 17 bp, Homo sapiens
caggcggaacgatacgg

SEQ ID NO: 55682 - DNA, 18 bp, Homo sapiens
caggcggaacgatacggc

SEQ ID NO: 55683 - DNA, 16 bp, Homo sapiens
ggcggaacgatacggc

SEQ ID NO: 55684 - DNA, 20 bp, Homo sapiens
ggaacgatacggcagcgccg

SEQ ID NO: 55685 - DNA, 21 bp, Homo sapiens
ggaacgatacggcagcgccgc

SEQ ID NO: 55686 - DNA, 19 bp, Homo sapiens
gaacgatacggcagcgccg

SEQ ID NO: 55687 - DNA, 20 bp, Homo sapiens
gaacgatacggcagcgccgc

SEQ ID NO: 55688 - DNA, 28 bp, Homo sapiens
ccgaggctccgcggcgctgccgtatcgt

SEQ ID NO: 55689 - DNA, 20 bp, Homo sapiens
acggcagcgccgcggagcct

SEQ ID NO: 55690 - DNA, 23 bp, Homo sapiens
ccgaggctccgcggcgctgccgt

SEQ ID NO: 55691 - DNA, 23 bp, Homo sapiens
cggcagcgccgcggagcctcggt

SEQ ID NO: 55692 - DNA, 17 bp, Homo sapiens
ggcagcgccgcggagcc

SEQ ID NO: 55693 - DNA, 20 bp, Homo sapiens
ggcagcgccgcggagcctcg

SEQ ID NO: 55694 - DNA, 21 bp, Homo sapiens
ggcagcgccgcggagcctcgg

SEQ ID NO: 55695 - DNA, 22 bp, Homo sapiens
ggcagcgccgcggagcctcggt

SEQ ID NO: 55696 - DNA, 23 bp, Homo sapiens
ggcagcgccgcggagcctcggtt

SEQ ID NO: 55697 - DNA, 16 bp, Homo sapiens
gcagcgccgcggagcc

SEQ ID NO: 55698 - DNA, 17 bp, Homo sapiens
gcagcgccgcggagcct

SEQ ID NO: 55699 - DNA, 18 bp, Homo sapiens
gcagcgccgcggagcctc

SEQ ID NO: 55700 - DNA, 19 bp, Homo sapiens
gcagcgccgcggagcctcg

SEQ ID NO: 55701 - DNA, 20 bp, Homo sapiens
gcagcgccgcggagcctcgg

SEQ ID NO: 55702 - DNA, 21 bp, Homo sapiens
gcagcgccgcggagcctcggt

SEQ ID NO: 55703 - DNA, 22 bp, Homo sapiens
gcagcgccgcggagcctcggtt

SEQ ID NO: 55704 - DNA, 23 bp, Homo sapiens
gcagcgccgcggagcctcggttg

SEQ ID NO: 55705 - DNA, 24 bp, Homo sapiens
gcagcgccgcggagcctcggttgg

SEQ ID NO: 55706 - DNA, 25 bp, Homo sapiens
gcagcgccgcggagcctcggttggc

SEQ ID NO: 55707 - DNA, 26 bp, Homo sapiens
gcagcgccgcggagcctcggttggcc

SEQ ID NO: 55708 - DNA, 29 bp, Homo sapiens
gcagcgccgcggagcctcggttggcctcg

SEQ ID NO: 55709 - DNA, 30 bp, Homo sapiens
gcagcgccgcggagcctcggttggcctcgg

SEQ ID NO: 55710 - DNA, 17 bp, Homo sapiens
cagcgccgcggagcctc

SEQ ID NO: 55711 - DNA, 18 bp, Homo sapiens
cagcgccgcggagcctcg

SEQ ID NO: 55712 - DNA, 19 bp, Homo sapiens
cagcgccgcggagcctcgg

SEQ ID NO: 55713 - DNA, 20 bp, Homo sapiens
cagcgccgcggagcctcggt

SEQ ID NO: 55714 - DNA, 21 bp, Homo sapiens
cagcgccgcggagcctcggtt

SEQ ID NO: 55715 - DNA, 22 bp, Homo sapiens
cagcgccgcggagcctcggttg

SEQ ID NO: 55716 - DNA, 23 bp, Homo sapiens
cagcgccgcggagcctcggttgg

SEQ ID NO: 55717 - DNA, 24 bp, Homo sapiens
cagcgccgcggagcctcggttggc

SEQ ID NO: 55718 - DNA, 25 bp, Homo sapiens
cagcgccgcggagcctcggttggcc

SEQ ID NO: 55719 - DNA, 28 bp, Homo sapiens
cagcgccgcggagcctcggttggcctcg

SEQ ID NO: 55720 - DNA, 29 bp, Homo sapiens
cagcgccgcggagcctcggttggcctcgg

SEQ ID NO: 55721 - DNA, 18 bp, Homo sapiens
agcgccgcggagcctcgg

SEQ ID NO: 55722 - DNA, 19 bp, Homo sapiens
agcgccgcggagcctcggt

SEQ ID NO: 55723 - DNA, 20 bp, Homo sapiens
agcgccgcggagcctcggtt

SEQ ID NO: 55724 - DNA, 21 bp, Homo sapiens
agcgccgcggagcctcggttg

SEQ ID NO: 55725 - DNA, 17 bp, Homo sapiens
gcgccgcggagcctcgg

SEQ ID NO: 55726 - DNA, 18 bp, Homo sapiens
gcgccgcggagcctcggt

SEQ ID NO: 55727 - DNA, 21 bp, Homo sapiens
gcgccgcggagcctcggttgg

SEQ ID NO: 55728 - DNA, 22 bp, Homo sapiens
cgccgcggagcctcggttggcc

SEQ ID NO: 55729 - DNA, 25 bp, Homo sapiens
cgccgcggagcctcggttggcctcg

SEQ ID NO: 55730 - DNA, 30 bp, Homo sapiens
cgccgcggagcctcggttggcctcggatag

SEQ ID NO: 55731 - DNA, 19 bp, Homo sapiens
gccgcggagcctcggttgg

SEQ ID NO: 55732 - DNA, 17 bp, Homo sapiens
ccgcggagcctcggttg

SEQ ID NO: 55733 - DNA, 18 bp, Homo sapiens
ccgcggagcctcggttgg

SEQ ID NO: 55734 - DNA, 19 bp, Homo sapiens
ccgcggagcctcggttggc

SEQ ID NO: 55735 - DNA, 20 bp, Homo sapiens
ccgcggagcctcggttggcc

SEQ ID NO: 55736 - DNA, 21 bp, Homo sapiens
ccgcggagcctcggttggcct

SEQ ID NO: 55737 - DNA, 22 bp, Homo sapiens
ccgcggagcctcggttggcctc

SEQ ID NO: 55738 - DNA, 23 bp, Homo sapiens
ccgcggagcctcggttggcctcg

SEQ ID NO: 55739 - DNA, 24 bp, Homo sapiens
ccgcggagcctcggttggcctcgg

SEQ ID NO: 55740 - DNA, 25 bp, Homo sapiens
ccgcggagcctcggttggcctcgga

SEQ ID NO: 55741 - DNA, 30 bp, Homo sapiens
ccgcggagcctcggttggcctcggatagcc

SEQ ID NO: 55742 - DNA, 22 bp, Homo sapiens
cgcggagcctcggttggcctcg

SEQ ID NO: 55743 - DNA, 23 bp, Homo sapiens
cgcggagcctcggttggcctcgg

SEQ ID NO: 55744 - DNA, 24 bp, Homo sapiens
cgcggagcctcggttggcctcgga

SEQ ID NO: 55745 - DNA, 30 bp, Homo sapiens
cgcggagcctcggttggcctcggatagccg

SEQ ID NO: 55746 - DNA, 18 bp, Homo sapiens
gcggagcctcggttggcc

SEQ ID NO: 55747 - DNA, 20 bp, Homo sapiens
gcggagcctcggttggcctc

SEQ ID NO: 55748 - DNA, 21 bp, Homo sapiens
gcggagcctcggttggcctcg

SEQ ID NO: 55749 - DNA, 22 bp, Homo sapiens
gcggagcctcggttggcctcgg

SEQ ID NO: 55750 - DNA, 23 bp, Homo sapiens
gcggagcctcggttggcctcgga

SEQ ID NO: 55751 - DNA, 30 bp, Homo sapiens
gcggagcctcggttggcctcggatagccgg

SEQ ID NO: 55752 - DNA, 20 bp, Homo sapiens
cggagcctcggttggcctcg

SEQ ID NO: 55753 - DNA, 21 bp, Homo sapiens
cggagcctcggttggcctcgg

SEQ ID NO: 55754 - DNA, 22 bp, Homo sapiens
cggagcctcggttggcctcgga

SEQ ID NO: 55755 - DNA, 29 bp, Homo sapiens
cggagcctcggttggcctcggatagccgg

SEQ ID NO: 55756 - DNA, 30 bp, Homo sapiens; identical to SEQ ID NO: 27805

SEQ ID NO: 55757 - DNA, 21 bp, Homo sapiens
ggagcctcggttggcctcgga

SEQ ID NO: 55758 - DNA, 30 bp, Homo sapiens; identical to SEQ ID NO: 6334

SEQ ID NO: 55759 - DNA, 27 bp, Homo sapiens
gagcctcggttggcctcggatagccgg

SEQ ID NO: 55760 - DNA, 30 bp, Homo sapiens
gagcctcggttggcctcggatagccggtcc

SEQ ID NO: 55761 - DNA, 18 bp, Homo sapiens
agcctcggttggcctcgg

SEQ ID NO: 55762 - DNA, 19 bp, Homo sapiens
agcctcggttggcctcgga

SEQ ID NO: 55763 - DNA, 22 bp, Homo sapiens
agcctcggttggcctcggatag

SEQ ID NO: 55764 - DNA, 30 bp, Homo sapiens; identical to SEQ ID NO: 27830

SEQ ID NO: 55765 - DNA, 25 bp, Homo sapiens
gcctcggttggcctcggatagccgg

SEQ ID NO: 55766 - DNA, 27 bp, Homo sapiens
gcctcggttggcctcggatagccggtc

SEQ ID NO: 55767 - DNA, 28 bp, Homo sapiens
gcctcggttggcctcggatagccggtcc

SEQ ID NO: 55768 - DNA, 29 bp, Homo sapiens
gcctcggttggcctcggatagccggtccc

SEQ ID NO: 55769 - DNA, 16 bp, Homo sapiens
cctcggttggcctcgg

SEQ ID NO: 55770 - DNA, 17 bp, Homo sapiens
cctcggttggcctcgga

SEQ ID NO: 55771 - DNA, 18 bp, Homo sapiens
cctcggttggcctcggat

SEQ ID NO: 55772 - DNA, 19 bp, Homo sapiens
cctcggttggcctcggata

SEQ ID NO: 55773 - DNA, 20 bp, Homo sapiens
cctcggttggcctcggatag

SEQ ID NO: 55774 - DNA, 21 bp, Homo sapiens
cctcggttggcctcggatagc

SEQ ID NO: 55775 - DNA, 22 bp, Homo sapiens
cctcggttggcctcggatagcc

SEQ ID NO: 55776 - DNA, 23 bp, Homo sapiens
cctcggttggcctcggatagccg

SEQ ID NO: 55777 - DNA, 24 bp, Homo sapiens
cctcggttggcctcggatagccgg

SEQ ID NO: 55778 - DNA, 25 bp, Homo sapiens
cctcggttggcctcggatagccggt

SEQ ID NO: 55779 - DNA, 26 bp, Homo sapiens
cctcggttggcctcggatagccggtc

SEQ ID NO: 55780 - DNA, 27 bp, Homo sapiens
cctcggttggcctcggatagccggtcc

SEQ ID NO: 55781 - DNA, 28 bp, Homo sapiens
cctcggttggcctcggatagccggtccc

SEQ ID NO: 55782 - DNA, 30 bp, Homo sapiens
cctcggttggcctcggatagccggtccccc

SEQ ID NO: 55783 - DNA, 16 bp, Homo sapiens
ctcggttggcctcgga

SEQ ID NO: 55784 - DNA, 17 bp, Homo sapiens
ctcggttggcctcggat

SEQ ID NO: 55785 - DNA, 19 bp, Homo sapiens
ctcggttggcctcggatag

SEQ ID NO: 55786 - DNA, 20 bp, Homo sapiens
ctcggttggcctcggatagc

SEQ ID NO: 55787 - DNA, 22 bp, Homo sapiens
ctcggttggcctcggatagccg

SEQ ID NO: 55788 - DNA, 23 bp, Homo sapiens
ctcggttggcctcggatagccgg

SEQ ID NO: 55789 - DNA, 24 bp, Homo sapiens
ctcggttggcctcggatagccggt

SEQ ID NO: 55790 - DNA, 25 bp, Homo sapiens
ctcggttggcctcggatagccggtc

SEQ ID NO: 55791 - DNA, 26 bp, Homo sapiens
ctcggttggcctcggatagccggtcc

SEQ ID NO: 55792 - DNA, 16 bp, Homo sapiens
tcggttggcctcggat

SEQ ID NO: 55793 - DNA, 18 bp, Homo sapiens
tcggttggcctcggatag

SEQ ID NO: 55794 - DNA, 19 bp, Homo sapiens
tcggttggcctcggatagc

SEQ ID NO: 55795 - DNA, 21 bp, Homo sapiens
tcggttggcctcggatagccg

SEQ ID NO: 55796 - DNA, 22 bp, Homo sapiens
tcggttggcctcggatagccgg

SEQ ID NO: 55797 - DNA, 23 bp, Homo sapiens
tcggttggcctcggatagccggt

SEQ ID NO: 55798 - DNA, 24 bp, Homo sapiens
tcggttggcctcggatagccggtc

SEQ ID NO: 55799 - DNA, 25 bp, Homo sapiens
tcggttggcctcggatagccggtcc

SEQ ID NO: 55800 - DNA, 30 bp, Homo sapiens
tcggttggcctcggatagccggtcccccgc

SEQ ID NO: 55801 - DNA, 17 bp, Homo sapiens
cggttggcctcggatag

SEQ ID NO: 55802 - DNA, 21 bp, Homo sapiens
cggttggcctcggatagccgg

SEQ ID NO: 55803 - DNA, 22 bp, Homo sapiens
cggttggcctcggatagccggt

SEQ ID NO: 55804 - DNA, 23 bp, Homo sapiens
cggttggcctcggatagccggtc

SEQ ID NO: 55805 - DNA, 24 bp, Homo sapiens
cggttggcctcggatagccggtcc

SEQ ID NO: 55806 - DNA, 20 bp, Homo sapiens
ggttggcctcggatagccgg

SEQ ID NO: 55807 - DNA, 21 bp, Homo sapiens
ggttggcctcggatagccggt

SEQ ID NO: 55808 - DNA, 22 bp, Homo sapiens
ggttggcctcggatagccggtc

SEQ ID NO: 55809 - DNA, 23 bp, Homo sapiens
ggttggcctcggatagccggtcc

SEQ ID NO: 55810 - DNA, 19 bp, Homo sapiens
gttggcctcggatagccgg

SEQ ID NO: 55811 - DNA, 20 bp, Homo sapiens
gttggcctcggatagccggt

SEQ ID NO: 55812 - DNA, 21 bp, Homo sapiens
gttggcctcggatagccggtc

SEQ ID NO: 55813 - DNA, 22 bp, Homo sapiens
gttggcctcggatagccggtcc

SEQ ID NO: 55814 - DNA, 18 bp, Homo sapiens
ttggcctcggatagccgg

SEQ ID NO: 55815 - DNA, 19 bp, Homo sapiens
ttggcctcggatagccggt

SEQ ID NO: 55816 - DNA, 17 bp, Homo sapiens
tggcctcggatagccgg

SEQ ID NO: 55817 - DNA, 21 bp, Homo sapiens
cctcggatagccggtcccccg

SEQ ID NO: 55818 - DNA, 20 bp, Homo sapiens
ctcggatagccggtcccccg

SEQ ID NO: 55819 - DNA, 21 bp, Homo sapiens
ctcggatagccggtcccccgc

SEQ ID NO: 55820 - DNA, 19 bp, Homo sapiens
tcggatagccggtcccccg

SEQ ID NO: 55821 - DNA, 20 bp, Homo sapiens
tcggatagccggtcccccgc

SEQ ID NO: 55822 - DNA, 23 bp, Homo sapiens
cggatagccggtcccccgcctgt

SEQ ID NO: 55823 - DNA, 17 bp, Homo sapiens
gatagccggtcccccgc

SEQ ID NO: 55824 - DNA, 18 bp, Homo sapiens
gatagccggtcccccgcc

SEQ ID NO: 55825 - DNA, 21 bp, Homo sapiens
gatagccggtcccccgcctgt

SEQ ID NO: 55826 - DNA, 20 bp, Homo sapiens
atagccggtcccccgcctgt

SEQ ID NO: 55827 - DNA, 19 bp, Homo sapiens
tagccggtcccccgcctgt

SEQ ID NO: 55828 - DNA, 20 bp, Homo sapiens
gggacaggcgggggaccggc

SEQ ID NO: 55829 - DNA, 21 bp, Homo sapiens
ggggacaggcgggggaccggc

SEQ ID NO: 55830 - DNA, 22 bp, Homo sapiens
gccggtcccccgcctgtccccg

SEQ ID NO: 55831 - DNA, 23 bp, Homo sapiens
gccggtcccccgcctgtccccgc

SEQ ID NO: 55832 - DNA, 24 bp, Homo sapiens
gccggtcccccgcctgtccccgcc

SEQ ID NO: 55833 - DNA, 25 bp, Homo sapiens
gccggtcccccgcctgtccccgccg

SEQ ID NO: 55834 - DNA, 22 bp, Homo sapiens
ccggtcccccgcctgtccccgc

SEQ ID NO: 55835 - DNA, 21 bp, Homo sapiens
cggtcccccgcctgtccccgc

SEQ ID NO: 55836 - DNA, 18 bp, Homo sapiens
ggtcccccgcctgtcccc

SEQ ID NO: 55837 - DNA, 19 bp, Homo sapiens
ggtcccccgcctgtccccg

SEQ ID NO: 55838 - DNA, 20 bp, Homo sapiens
ggtcccccgcctgtccccgc

SEQ ID NO: 55839 - DNA, 21 bp, Homo sapiens
ggtcccccgcctgtccccgcc

SEQ ID NO: 55840 - DNA, 22 bp, Homo sapiens
ggtcccccgcctgtccccgccg

SEQ ID NO: 55841 - DNA, 23 bp, Homo sapiens
ggtcccccgcctgtccccgccgg

SEQ ID NO: 55842 - DNA, 18 bp, Homo sapiens
gtcccccgcctgtccccg

SEQ ID NO: 55843 - DNA, 19 bp, Homo sapiens
gtcccccgcctgtccccgc

SEQ ID NO: 55844 - DNA, 20 bp, Homo sapiens
gtcccccgcctgtccccgcc

SEQ ID NO: 55845 - DNA, 22 bp, Homo sapiens
gtcccccgcctgtccccgccgg

SEQ ID NO: 55846 - DNA, 23 bp, Homo sapiens
gtcccccgcctgtccccgccggc

SEQ ID NO: 55847 - DNA, 21 bp, Homo sapiens
tcccccgcctgtccccgccgg

SEQ ID NO: 55848 - DNA, 20 bp, Homo sapiens
cccccgcctgtccccgccgg

SEQ ID NO: 55849 - DNA, 19 bp, Homo sapiens
ccccgcctgtccccgccgg

SEQ ID NO: 55850 - DNA, 20 bp, Homo sapiens
ccccgcctgtccccgccggc

SEQ ID NO: 55851 - DNA, 18 bp, Homo sapiens
cccgcctgtccccgccgg

SEQ ID NO: 55852 - DNA, 19 bp, Homo sapiens
cccgcctgtccccgccggc

SEQ ID NO: 55853 - DNA, 17 bp, Homo sapiens
ccgcctgtccccgccgg

SEQ ID NO: 55854 - DNA, 18 bp, Homo sapiens
ccgcctgtccccgccggc

SEQ ID NO: 55855 - DNA, 16 bp, Homo sapiens
cgcctgtccccgccgg

SEQ ID NO: 55856 - DNA, 20 bp, Homo sapiens
cgcctgtccccgccggcggg

SEQ ID NO: 55857 - DNA, 19 bp, Homo sapiens
cccgccggcggggacaggc

SEQ ID NO: 55858 - DNA, 18 bp, Homo sapiens
cctgtccccgccggcggg

SEQ ID NO: 55859 - DNA, 19 bp, Homo sapiens
cctgtccccgccggcgggc

SEQ ID NO: 55860 - DNA, 20 bp, Homo sapiens
cctgtccccgccggcgggcc

SEQ ID NO: 55861 - DNA, 21 bp, Homo sapiens
cctgtccccgccggcgggccg

SEQ ID NO: 55862 - DNA, 22 bp, Homo sapiens
cctgtccccgccggcgggccgc

SEQ ID NO: 55863 - DNA, 23 bp, Homo sapiens
cctgtccccgccggcgggccgcc

SEQ ID NO: 55864 - DNA, 18 bp, Homo sapiens
ctgtccccgccggcgggc

SEQ ID NO: 55865 - DNA, 19 bp, Homo sapiens
ctgtccccgccggcgggcc

SEQ ID NO: 55866 - DNA, 20 bp, Homo sapiens
ctgtccccgccggcgggccg

SEQ ID NO: 55867 - DNA, 21 bp, Homo sapiens
ctgtccccgccggcgggccgc

SEQ ID NO: 55868 - DNA, 22 bp, Homo sapiens
ctgtccccgccggcgggccgcc

SEQ ID NO: 55869 - DNA, 23 bp, Homo sapiens
ctgtccccgccggcgggccgccc

SEQ ID NO: 55870 - DNA, 16 bp, Homo sapiens
tgtccccgccggcggg

SEQ ID NO: 55871 - DNA, 17 bp, Homo sapiens
tgtccccgccggcgggc

SEQ ID NO: 55872 - DNA, 18 bp, Homo sapiens
tgtccccgccggcgggcc

SEQ ID NO: 55873 - DNA, 19 bp, Homo sapiens
tgtccccgccggcgggccg

SEQ ID NO: 55874 - DNA, 20 bp, Homo sapiens
tgtccccgccggcgggccgc

SEQ ID NO: 55875 - DNA, 21 bp, Homo sapiens
tgtccccgccggcgggccgcc

SEQ ID NO: 55876 - DNA, 22 bp, Homo sapiens
tgtccccgccggcgggccgccc

SEQ ID NO: 55877 - DNA, 23 bp, Homo sapiens
tgtccccgccggcgggccgcccc

SEQ ID NO: 55878 - DNA, 24 bp, Homo sapiens
tgtccccgccggcgggccgccccc

SEQ ID NO: 55879 - DNA, 25 bp, Homo sapiens
tgtccccgccggcgggccgcccccc

SEQ ID NO: 55880 - DNA, 26 bp, Homo sapiens
tgtccccgccggcgggccgccccccc

SEQ ID NO: 55881 - DNA, 27 bp, Homo sapiens
tgtccccgccggcgggccgcccccccc

SEQ ID NO: 55882 - DNA, 17 bp, Homo sapiens
gtccccgccggcgggcc

SEQ ID NO: 55883 - DNA, 18 bp, Homo sapiens
gtccccgccggcgggccg

SEQ ID NO: 55884 - DNA, 19 bp, Homo sapiens
gtccccgccggcgggccgc

SEQ ID NO: 55885 - DNA, 20 bp, Homo sapiens
gtccccgccggcgggccgcc

SEQ ID NO: 55886 - DNA, 21 bp, Homo sapiens
gtccccgccggcgggccgccc

SEQ ID NO: 55887 - DNA, 22 bp, Homo sapiens
gtccccgccggcgggccgcccc

SEQ ID NO: 55888 - DNA, 16 bp, Homo sapiens
tccccgccggcgggcc

SEQ ID NO: 55889 - DNA, 18 bp, Homo sapiens
tccccgccggcgggccgc

SEQ ID NO: 55890 - DNA, 19 bp, Homo sapiens
tccccgccggcgggccgcc

SEQ ID NO: 55891 - DNA, 20 bp, Homo sapiens
tccccgccggcgggccgccc

SEQ ID NO: 55892 - DNA, 21 bp, Homo sapiens
tccccgccggcgggccgcccc

SEQ ID NO: 55893 - DNA, 22 bp, Homo sapiens
tccccgccggcgggccgccccc

SEQ ID NO: 55894 - DNA, 23 bp, Homo sapiens
tccccgccggcgggccgcccccc

SEQ ID NO: 55895 - DNA, 24 bp, Homo sapiens
tccccgccggcgggccgccccccc

SEQ ID NO: 55896 - DNA, 25 bp, Homo sapiens
tccccgccggcgggccgcccccccc

SEQ ID NO: 55897 - DNA, 16 bp, Homo sapiens
ccccgccggcgggccg

SEQ ID NO: 55898 - DNA, 17 bp, Homo sapiens
ccccgccggcgggccgc

SEQ ID NO: 55899 - DNA, 18 bp, Homo sapiens
ccccgccggcgggccgcc

SEQ ID NO: 55900 - DNA, 19 bp, Homo sapiens
ccccgccggcgggccgccc

SEQ ID NO: 55901 - DNA, 20 bp, Homo sapiens
ccccgccggcgggccgcccc

SEQ ID NO: 55902 - DNA, 21 bp, Homo sapiens
ccccgccggcgggccgccccc

SEQ ID NO: 55903 - DNA, 22 bp, Homo sapiens
ccccgccggcgggccgcccccc

SEQ ID NO: 55904 - DNA, 23 bp, Homo sapiens
ccccgccggcgggccgccccccc

SEQ ID NO: 55905 - DNA, 24 bp, Homo sapiens
ccccgccggcgggccgcccccccc

SEQ ID NO: 55906 - DNA, 25 bp, Homo sapiens
ccccgccggcgggccgcccccccct

SEQ ID NO: 55907 - DNA, 26 bp, Homo sapiens
ccccgccggcgggccgcccccccctc

SEQ ID NO: 55908 - DNA, 16 bp, Homo sapiens
cccgccggcgggccgc

SEQ ID NO: 55909 - DNA, 17 bp, Homo sapiens
cccgccggcgggccgcc

SEQ ID NO: 55910 - DNA, 18 bp, Homo sapiens
cccgccggcgggccgccc

SEQ ID NO: 55911 - DNA, 19 bp, Homo sapiens
cccgccggcgggccgcccc

SEQ ID NO: 55912 - DNA, 20 bp, Homo sapiens
cccgccggcgggccgccccc

SEQ ID NO: 55913 - DNA, 21 bp, Homo sapiens
cccgccggcgggccgcccccc

SEQ ID NO: 55914 - DNA, 22 bp, Homo sapiens
cccgccggcgggccgccccccc

SEQ ID NO: 55915 - DNA, 23 bp, Homo sapiens
cccgccggcgggccgcccccccc

SEQ ID NO: 55916 - DNA, 24 bp, Homo sapiens
cccgccggcgggccgcccccccct

SEQ ID NO: 55917 - DNA, 16 bp, Homo sapiens
ccgccggcgggccgcc

SEQ ID NO: 55918 - DNA, 17 bp, Homo sapiens
ccgccggcgggccgccc

SEQ ID NO: 55919 - DNA, 18 bp, Homo sapiens
ccgccggcgggccgcccc

SEQ ID NO: 55920 - DNA, 19 bp, Homo sapiens
ccgccggcgggccgccccc

SEQ ID NO: 55921 - DNA, 20 bp, Homo sapiens
ccgccggcgggccgcccccc

SEQ ID NO: 55922 - DNA, 21 bp, Homo sapiens
ccgccggcgggccgccccccc

SEQ ID NO: 55923 - DNA, 22 bp, Homo sapiens
ccgccggcgggccgcccccccc

SEQ ID NO: 55924 - DNA, 16 bp, Homo sapiens
cgccggcgggccgccc

SEQ ID NO: 55925 - DNA, 17 bp, Homo sapiens
cgccggcgggccgcccc

SEQ ID NO: 55926 - DNA, 18 bp, Homo sapiens
cgccggcgggccgccccc

SEQ ID NO: 55927 - DNA, 19 bp, Homo sapiens
cgccggcgggccgcccccc

SEQ ID NO: 55928 - DNA, 20 bp, Homo sapiens
cgccggcgggccgccccccc

SEQ ID NO: 55929 - DNA, 21 bp, Homo sapiens
cgccggcgggccgcccccccc

SEQ ID NO: 55930 - DNA, 22 bp, Homo sapiens
cgccggcgggccgcccccccct

SEQ ID NO: 55931 - DNA, 16 bp, Homo sapiens
gccggcgggccgcccc

SEQ ID NO: 55932 - DNA, 17 bp, Homo sapiens
gccggcgggccgccccc

SEQ ID NO: 55933 - DNA, 18 bp, Homo sapiens
gccggcgggccgcccccc

SEQ ID NO: 55934 - DNA, 19 bp, Homo sapiens
gccggcgggccgccccccc

SEQ ID NO: 55935 - DNA, 20 bp, Homo sapiens
gccggcgggccgcccccccc

SEQ ID NO: 55936 - DNA, 16 bp, Homo sapiens
ggcgggccgccccccc

SEQ ID NO: 55937 - DNA, 17 bp, Homo sapiens
ggcgggccgcccccccc

SEQ ID NO: 55938 - DNA, 18 bp, Homo sapiens
ggcgggccgcccccccct

SEQ ID NO: 55939 - DNA, 19 bp, Homo sapiens
ggcgggccgcccccccctc

SEQ ID NO: 55940 - DNA, 20 bp, Homo sapiens
ggcgggccgcccccccctcc

SEQ ID NO: 55941 - DNA, 23 bp, Homo sapiens
ggcgggccgcccccccctccacg

SEQ ID NO: 55942 - DNA, 23 bp, Homo sapiens
gcgggccgcccccccctccacgc

SEQ ID NO: 55943 - DNA, 19 bp, Homo sapiens
ggccgcccccccctccacg

SEQ ID NO: 55944 - DNA, 20 bp, Homo sapiens
ggccgcccccccctccacgc

SEQ ID NO: 55945 - DNA, 21 bp, Homo sapiens
ccgcccccccctccacgcgcc

SEQ ID NO: 55946 - DNA, 19 bp, Homo sapiens
cgcccccccctccacgcgc

SEQ ID NO: 55947 - DNA, 20 bp, Homo sapiens
cgcccccccctccacgcgcc

SEQ ID NO: 55948 - DNA, 16 bp, Homo sapiens
gcccccccctccacgc

SEQ ID NO: 55949 - DNA, 19 bp, Homo sapiens
gcccccccctccacgcgcc

SEQ ID NO: 55950 - DNA, 20 bp, Homo sapiens
gcccccccctccacgcgccc

SEQ ID NO: 55951 - DNA, 18 bp, Homo sapiens
cccccccctccacgcgcc

SEQ ID NO: 55952 - DNA, 18 bp, Homo sapiens
ccctccacgcgccccgcg

SEQ ID NO: 55953 - DNA, 17 bp, Homo sapiens
ctccacgcgccccgcgc

SEQ ID NO: 55954 - DNA, 19 bp, Homo sapiens
ctccacgcgccccgcgcgc

SEQ ID NO: 55955 - DNA, 22 bp, Homo sapiens
acgcgccccgcgcgcgcgggag

SEQ ID NO: 55956 - DNA, 23 bp, Homo sapiens
acgcgccccgcgcgcgcgggagg

SEQ ID NO: 55957 - DNA, 21 bp, Homo sapiens
gcgccccgcgcgcgcgggagg

SEQ ID NO: 55958 - DNA, 22 bp, Homo sapiens
gcgccccgcgcgcgcgggaggg

SEQ ID NO: 55959 - DNA, 26 bp, Homo sapiens
gcgccccgcgcgcgcgggagggcgcg

SEQ ID NO: 55960 - DNA, 22 bp, Homo sapiens
cgccccgcgcgcgcgggagggc

SEQ ID NO: 55961 - DNA, 23 bp, Homo sapiens
cgccccgcgcgcgcgggagggcg

SEQ ID NO: 55962 - DNA, 24 bp, Homo sapiens
cgccccgcgcgcgcgggagggcgc

SEQ ID NO: 55963 - DNA, 25 bp, Homo sapiens
cgccccgcgcgcgcgggagggcgcg

SEQ ID NO: 55964 - DNA, 24 bp, Homo sapiens
gccccgcgcgcgcgggagggcgcg

SEQ ID NO: 55965 - DNA, 16 bp, Homo sapiens
gcgcgcgcgggagggc

SEQ ID NO: 55966 - DNA, 17 bp, Homo sapiens
gcgcgcgcgggagggcg

SEQ ID NO: 55967 - DNA, 18 bp, Homo sapiens
gcgcgcgcgggagggcgc

SEQ ID NO: 55968 - DNA, 19 bp, Homo sapiens
gcgcgcgcgggagggcgcg

SEQ ID NO: 55969 - DNA, 20 bp, Homo sapiens
gcgcgcgcgggagggcgcgt

SEQ ID NO: 55970 - DNA, 16 bp, Homo sapiens
gcgcgcgggagggcgc

SEQ ID NO: 55971 - DNA, 21 bp, Homo sapiens
gcgggagggcgcgtgccccgc

SEQ ID NO: 55972 - DNA, 23 bp, Homo sapiens
gcgggagggcgcgtgccccgccg

SEQ ID NO: 55973 - DNA, 28 bp, Homo sapiens
gcgggagggcgcgtgccccgccgcgcgc

SEQ ID NO: 55974 - DNA, 21 bp, Homo sapiens
cgggagggcgcgtgccccgcc

SEQ ID NO: 55975 - DNA, 22 bp, Homo sapiens
cgggagggcgcgtgccccgccg

SEQ ID NO: 55976 - DNA, 23 bp, Homo sapiens
cgggagggcgcgtgccccgccgc

SEQ ID NO: 55977 - DNA, 24 bp, Homo sapiens
cgggagggcgcgtgccccgccgcg

SEQ ID NO: 55978 - DNA, 25 bp, Homo sapiens
cgggagggcgcgtgccccgccgcgc

SEQ ID NO: 55979 - DNA, 26 bp, Homo sapiens
cgggagggcgcgtgccccgccgcgcg

SEQ ID NO: 55980 - DNA, 27 bp, Homo sapiens
cgggagggcgcgtgccccgccgcgcgc

SEQ ID NO: 55981 - DNA, 19 bp, Homo sapiens
gggagggcgcgtgccccgc

SEQ ID NO: 55982 - DNA, 22 bp, Homo sapiens
gggagggcgcgtgccccgccgc

SEQ ID NO: 55983 - DNA, 23 bp, Homo sapiens
gggagggcgcgtgccccgccgcg

SEQ ID NO: 55984 - DNA, 24 bp, Homo sapiens
gggagggcgcgtgccccgccgcgc

SEQ ID NO: 55985 - DNA, 25 bp, Homo sapiens
gggagggcgcgtgccccgccgcgcg

SEQ ID NO: 55986 - DNA, 26 bp, Homo sapiens
gggagggcgcgtgccccgccgcgcgc

SEQ ID NO: 55987 - DNA, 22 bp, Homo sapiens
ggagggcgcgtgccccgccgcg

SEQ ID NO: 55988 - DNA, 23 bp, Homo sapiens
ggagggcgcgtgccccgccgcgc

SEQ ID NO: 55989 - DNA, 25 bp, Homo sapiens
ggagggcgcgtgccccgccgcgcgc

SEQ ID NO: 55990 - DNA, 19 bp, Homo sapiens
gagggcgcgtgccccgccg

SEQ ID NO: 55991 - DNA, 20 bp, Homo sapiens
gagggcgcgtgccccgccgc

SEQ ID NO: 55992 - DNA, 21 bp, Homo sapiens
gagggcgcgtgccccgccgcg

SEQ ID NO: 55993 - DNA, 30 bp, Homo sapiens
gagggcgcgtgccccgccgcgcgccgggac

SEQ ID NO: 55994 - DNA, 30 bp, Homo sapiens
agggcgcgtgccccgccgcgcgccgggacc

SEQ ID NO: 55995 - DNA, 18 bp, Homo sapiens
gggcgcgtgccccgccgc

SEQ ID NO: 55996 - DNA, 19 bp, Homo sapiens
gggcgcgtgccccgccgcg

SEQ ID NO: 55997 - DNA, 20 bp, Homo sapiens
gggcgcgtgccccgccgcgc

SEQ ID NO: 55998 - DNA, 22 bp, Homo sapiens
gggcgcgtgccccgccgcgcgc

SEQ ID NO: 55999 - DNA, 30 bp, Homo sapiens; identical to SEQ ID NO: 27938

SEQ ID NO: 56000 - DNA, 17 bp, Homo sapiens
ggcgcgtgccccgccgc

SEQ ID NO: 56001 - DNA, 18 bp, Homo sapiens
ggcgcgtgccccgccgcg

SEQ ID NO: 56002 - DNA, 19 bp, Homo sapiens
ggcgcgtgccccgccgcgc

SEQ ID NO: 56003 - DNA, 21 bp, Homo sapiens
ggcgcgtgccccgccgcgcgc

SEQ ID NO: 56004 - DNA, 30 bp, Homo sapiens
ggcgcgtgccccgccgcgcgccgggaccgg

SEQ ID NO: 56005 - DNA, 27 bp, Homo sapiens
gcgtgccccgccgcgcgccgggaccgg

SEQ ID NO: 56006 - DNA, 18 bp, Homo sapiens
cgtgccccgccgcgcgcc

SEQ ID NO: 56007 - DNA, 20 bp, Homo sapiens
cgtgccccgccgcgcgccgg

SEQ ID NO: 56008 - DNA, 21 bp, Homo sapiens
cgtgccccgccgcgcgccggg

SEQ ID NO: 56009 - DNA, 22 bp, Homo sapiens
cgtgccccgccgcgcgccggga

SEQ ID NO: 56010 - DNA, 16 bp, Homo sapiens
gtgccccgccgcgcgc

SEQ ID NO: 56011 - DNA, 17 bp, Homo sapiens
gtgccccgccgcgcgcc

SEQ ID NO: 56012 - DNA, 19 bp, Homo sapiens
gtgccccgccgcgcgccgg

SEQ ID NO: 56013 - DNA, 16 bp, Homo sapiens
tgccccgccgcgcgcc

SEQ ID NO: 56014 - DNA, 17 bp, Homo sapiens
tgccccgccgcgcgccg

SEQ ID NO: 56015 - DNA, 18 bp, Homo sapiens
tgccccgccgcgcgccgg

SEQ ID NO: 56016 - DNA, 22 bp, Homo sapiens
ccccgccgcgcgccgggaccgg

SEQ ID NO: 56017 - DNA, 23 bp, Homo sapiens
ccccgccgcgcgccgggaccggg

SEQ ID NO: 56018 - DNA, 29 bp, Homo sapiens
ccccgccgcgcgccgggaccggggtccgg

SEQ ID NO: 56019 - DNA, 16 bp, Homo sapiens
cccgccgcgcgccggg

SEQ ID NO: 56020 - DNA, 21 bp, Homo sapiens
cccgccgcgcgccgggaccgg

SEQ ID NO: 56021 - DNA, 22 bp, Homo sapiens
cccgccgcgcgccgggaccggg

SEQ ID NO: 56022 - DNA, 23 bp, Homo sapiens
cccgccgcgcgccgggaccgggg

SEQ ID NO: 56023 - DNA, 28 bp, Homo sapiens
cccgccgcgcgccgggaccggggtccgg

SEQ ID NO: 56024 - DNA, 20 bp, Homo sapiens
ccgccgcgcgccgggaccgg

SEQ ID NO: 56025 - DNA, 21 bp, Homo sapiens
ccgccgcgcgccgggaccggg

SEQ ID NO: 56026 - DNA, 22 bp, Homo sapiens
ccgccgcgcgccgggaccgggg

SEQ ID NO: 56027 - DNA, 19 bp, Homo sapiens
cgccgcgcgccgggaccgg

SEQ ID NO: 56028 - DNA, 20 bp, Homo sapiens
cgccgcgcgccgggaccggg

SEQ ID NO: 56029 - DNA, 21 bp, Homo sapiens
cgccgcgcgccgggaccgggg

SEQ ID NO: 56030 - DNA, 18 bp, Homo sapiens
gccgcgcgccgggaccgg

SEQ ID NO: 56031 - DNA, 19 bp, Homo sapiens
gccgcgcgccgggaccggg

SEQ ID NO: 56032 - DNA, 20 bp, Homo sapiens
gccgcgcgccgggaccgggg

SEQ ID NO: 56033 - DNA, 17 bp, Homo sapiens
ccgcgcgccgggaccgg

SEQ ID NO: 56034 - DNA, 19 bp, Homo sapiens
ccgcgcgccgggaccgggg

SEQ ID NO: 56035 - DNA, 18 bp, Homo sapiens
cgcgcgccgggaccgggg

SEQ ID NO: 56036 - DNA, 17 bp, Homo sapiens
gcgcgccgggaccgggg

SEQ ID NO: 56037 - DNA, 22 bp, Homo sapiens
gcgcgccgggaccggggtccgg

SEQ ID NO: 56038 - DNA, 30 bp, Homo sapiens
gggaccggggtccggtgcggagtgcccttc

SEQ ID NO: 56039 - DNA, 30 bp, Homo sapiens
gaccggggtccggtgcggagtgcccttcgt

SEQ ID NO: 56040 - DNA, 20 bp, Homo sapiens
cggggtccggtgcggagtgc

SEQ ID NO: 56041 - DNA, 21 bp, Homo sapiens
cggggtccggtgcggagtgcc

SEQ ID NO: 56042 - DNA, 20 bp, Homo sapiens
ggggtccggtgcggagtgcc

SEQ ID NO: 56043 - DNA, 29 bp, Homo sapiens
gggtccggtgcggagtgcccttcgtcctg

SEQ ID NO: 56044 - DNA, 17 bp, Homo sapiens
ggtccggtgcggagtgc

SEQ ID NO: 56045 - DNA, 18 bp, Homo sapiens
ggtccggtgcggagtgcc

SEQ ID NO: 56046 - DNA, 19 bp, Homo sapiens
ggtccggtgcggagtgccc

SEQ ID NO: 56047 - DNA, 22 bp, Homo sapiens
ggtccggtgcggagtgcccttc

SEQ ID NO: 56048 - DNA, 24 bp, Homo sapiens
ggtccggtgcggagtgcccttcgt

SEQ ID NO: 56049 - DNA, 25 bp, Homo sapiens
ggtccggtgcggagtgcccttcgtc

SEQ ID NO: 56050 - DNA, 28 bp, Homo sapiens
ggtccggtgcggagtgcccttcgtcctg

SEQ ID NO: 56051 - DNA, 21 bp, Homo sapiens
gtccggtgcggagtgcccttc

SEQ ID NO: 56052 - DNA, 22 bp, Homo sapiens
gtccggtgcggagtgcccttcg

SEQ ID NO: 56053 - DNA, 23 bp, Homo sapiens
gtccggtgcggagtgcccttcgt

SEQ ID NO: 56054 - DNA, 24 bp, Homo sapiens
gtccggtgcggagtgcccttcgtc

SEQ ID NO: 56055 - DNA, 25 bp, Homo sapiens
gtccggtgcggagtgcccttcgtcc

SEQ ID NO: 56056 - DNA, 26 bp, Homo sapiens
gtccggtgcggagtgcccttcgtcct

SEQ ID NO: 56057 - DNA, 27 bp, Homo sapiens
gtccggtgcggagtgcccttcgtcctg

SEQ ID NO: 56058 - DNA, 23 bp, Homo sapiens
tccggtgcggagtgcccttcgtc

SEQ ID NO: 56059 - DNA, 26 bp, Homo sapiens
tccggtgcggagtgcccttcgtcctg

SEQ ID NO: 56060 - DNA, 18 bp, Homo sapiens
cggtgcggagtgcccttc

SEQ ID NO: 56061 - DNA, 19 bp, Homo sapiens
cggtgcggagtgcccttcg

SEQ ID NO: 56062 - DNA, 20 bp, Homo sapiens
cggtgcggagtgcccttcgt

SEQ ID NO: 56063 - DNA, 21 bp, Homo sapiens
cggtgcggagtgcccttcgtc

SEQ ID NO: 56064 - DNA, 22 bp, Homo sapiens
cggtgcggagtgcccttcgtcc

SEQ ID NO: 56065 - DNA, 24 bp, Homo sapiens
cggtgcggagtgcccttcgtcctg

SEQ ID NO: 56066 - DNA, 18 bp, Homo sapiens
ggtgcggagtgcccttcg

SEQ ID NO: 56067 - DNA, 20 bp, Homo sapiens
ggtgcggagtgcccttcgtc

SEQ ID NO: 56068 - DNA, 21 bp, Homo sapiens
ggtgcggagtgcccttcgtcc

SEQ ID NO: 56069 - DNA, 23 bp, Homo sapiens
ggtgcggagtgcccttcgtcctg

SEQ ID NO: 56070 - DNA, 24 bp, Homo sapiens
ggtgcggagtgcccttcgtcctgg

SEQ ID NO: 56071 - DNA, 19 bp, Homo sapiens
gtgcggagtgcccttcgtc

SEQ ID NO: 56072 - DNA, 22 bp, Homo sapiens
gtgcggagtgcccttcgtcctg

SEQ ID NO: 56073 - DNA, 23 bp, Homo sapiens
gtgcggagtgcccttcgtcctgg

SEQ ID NO: 56074 - DNA, 25 bp, Homo sapiens
gtgcggagtgcccttcgtcctggga

SEQ ID NO: 56075 - DNA, 17 bp, Homo sapiens
gcggagtgcccttcgtc

SEQ ID NO: 56076 - DNA, 22 bp, Homo sapiens
gcggagtgcccttcgtcctggg

SEQ ID NO: 56077 - DNA, 23 bp, Homo sapiens
gcggagtgcccttcgtcctggga

SEQ ID NO: 56078 - DNA, 19 bp, Homo sapiens
cggagtgcccttcgtcctg

SEQ ID NO: 56079 - DNA, 20 bp, Homo sapiens
cggagtgcccttcgtcctgg

SEQ ID NO: 56080 - DNA, 21 bp, Homo sapiens
cggagtgcccttcgtcctggg

SEQ ID NO: 56081 - DNA, 22 bp, Homo sapiens
cggagtgcccttcgtcctggga

SEQ ID NO: 56082 - DNA, 18 bp, Homo sapiens
ggagtgcccttcgtcctg

SEQ ID NO: 56083 - DNA, 18 bp, Homo sapiens
gagtgcccttcgtcctgg

SEQ ID NO: 56084 - DNA, 19 bp, Homo sapiens
gagtgcccttcgtcctggg

SEQ ID NO: 56085 - DNA, 20 bp, Homo sapiens
gagtgcccttcgtcctggga

SEQ ID NO: 56086 - DNA, 17 bp, Homo sapiens
agtgcccttcgtcctgg

SEQ ID NO: 56087 - DNA, 18 bp, Homo sapiens
agtgcccttcgtcctggg

SEQ ID NO: 56088 - DNA, 19 bp, Homo sapiens
agtgcccttcgtcctggga

SEQ ID NO: 56089 - DNA, 16 bp, Homo sapiens
gtgcccttcgtcctgg

SEQ ID NO: 56090 - DNA, 17 bp, Homo sapiens
gtgcccttcgtcctggg

SEQ ID NO: 56091 - DNA, 18 bp, Homo sapiens
gtgcccttcgtcctggga

SEQ ID NO: 56092 - DNA, 20 bp, Homo sapiens
gtgcccttcgtcctgggaaa

SEQ ID NO: 56093 - DNA, 22 bp, Homo sapiens
gtgcccttcgtcctgggaaacg

SEQ ID NO: 56094 - DNA, 23 bp, Homo sapiens
gtgcccttcgtcctgggaaacgg

SEQ ID NO: 56095 - DNA, 16 bp, Homo sapiens
tgcccttcgtcctggg

SEQ ID NO: 56096 - DNA, 17 bp, Homo sapiens
tgcccttcgtcctggga

SEQ ID NO: 56097 - DNA, 22 bp, Homo sapiens
tgcccttcgtcctgggaaacgg

SEQ ID NO: 56098 - DNA, 19 bp, Homo sapiens
ccttcgtcctgggaaacgg

SEQ ID NO: 56099 - DNA, 18 bp, Homo sapiens
cttcgtcctgggaaacgg

SEQ ID NO: 56100 - DNA, 19 bp, Homo sapiens
cttcgtcctgggaaacggg

SEQ ID NO: 56101 - DNA, 20 bp, Homo sapiens
cttcgtcctgggaaacgggg

SEQ ID NO: 56102 - DNA, 16 bp, Homo sapiens
ttcgtcctgggaaacg

SEQ ID NO: 56103 - DNA, 17 bp, Homo sapiens
ttcgtcctgggaaacgg

SEQ ID NO: 56104 - DNA, 16 bp, Homo sapiens
tcgtcctgggaaacgg

SEQ ID NO: 56105 - DNA, 17 bp, Homo sapiens
tcgtcctgggaaacggg

SEQ ID NO: 56106 - DNA, 16 bp, Homo sapiens
cgtcctgggaaacggg

SEQ ID NO: 56107 - DNA, 17 bp, Homo sapiens
cgtcctgggaaacgggg

SEQ ID NO: 56108 - DNA, 18 bp, Homo sapiens
cgtcctgggaaacggggc

SEQ ID NO: 56109 - DNA, 20 bp, Homo sapiens
cgtcctgggaaacggggcgc

SEQ ID NO: 56110 - DNA, 30 bp, Homo sapiens
cgtcctgggaaacggggcgcggctggaaag

SEQ ID NO: 56111 - DNA, 16 bp, Homo sapiens
gtcctgggaaacgggg

SEQ ID NO: 56112 - DNA, 17 bp, Homo sapiens
gtcctgggaaacggggc

SEQ ID NO: 56113 - DNA, 17 bp, Homo sapiens
ctgggaaacggggcgcg

SEQ ID NO: 56114 - DNA, 18 bp, Homo sapiens
ctgggaaacggggcgcgg

SEQ ID NO: 56115 - DNA, 19 bp, Homo sapiens
ctgggaaacggggcgcggc

SEQ ID NO: 56116 - DNA, 18 bp, Homo sapiens
tgggaaacggggcgcggc

SEQ ID NO: 56117 - DNA, 20 bp, Homo sapiens
tgggaaacggggcgcggctg

SEQ ID NO: 56118 - DNA, 21 bp, Homo sapiens
tgggaaacggggcgcggctgg

SEQ ID NO: 56119 - DNA, 30 bp, Homo sapiens
tgggaaacggggcgcggctggaaaggcggc

SEQ ID NO: 56120 - DNA, 17 bp, Homo sapiens
gggaaacggggcgcggc

SEQ ID NO: 56121 - DNA, 22 bp, Homo sapiens
gggaaacggggcgcggctggaa

SEQ ID NO: 56122 - DNA, 19 bp, Homo sapiens
gaaacggggcgcggctgga

SEQ ID NO: 56123 - DNA, 20 bp, Homo sapiens
gaaacggggcgcggctggaa

SEQ ID NO: 56124 - DNA, 22 bp, Homo sapiens
gaaacggggcgcggctggaaag

SEQ ID NO: 56125 - DNA, 17 bp, Homo sapiens
aaacggggcgcggctgg

SEQ ID NO: 56126 - DNA, 18 bp, Homo sapiens
aaacggggcgcggctgga

SEQ ID NO: 56127 - DNA, 19 bp, Homo sapiens
aaacggggcgcggctggaa

SEQ ID NO: 56128 - DNA, 20 bp, Homo sapiens
aaacggggcgcggctggaaa

SEQ ID NO: 56129 - DNA, 21 bp, Homo sapiens
aaacggggcgcggctggaaag

SEQ ID NO: 56130 - DNA, 22 bp, Homo sapiens
aaacggggcgcggctggaaagg

SEQ ID NO: 56131 - DNA, 16 bp, Homo sapiens
aacggggcgcggctgg

SEQ ID NO: 56132 - DNA, 17 bp, Homo sapiens
aacggggcgcggctgga

SEQ ID NO: 56133 - DNA, 18 bp, Homo sapiens
aacggggcgcggctggaa

SEQ ID NO: 56134 - DNA, 19 bp, Homo sapiens
aacggggcgcggctggaaa

SEQ ID NO: 56135 - DNA, 20 bp, Homo sapiens
aacggggcgcggctggaaag

SEQ ID NO: 56136 - DNA, 21 bp, Homo sapiens
aacggggcgcggctggaaagg

SEQ ID NO: 56137 - DNA, 22 bp, Homo sapiens
aacggggcgcggctggaaaggc

SEQ ID NO: 56138 - DNA, 16 bp, Homo sapiens
acggggcgcggctgga

SEQ ID NO: 56139 - DNA, 19 bp, Homo sapiens
acggggcgcggctggaaag

SEQ ID NO: 56140 - DNA, 20 bp, Homo sapiens
acggggcgcggctggaaagg

SEQ ID NO: 56141 - DNA, 21 bp, Homo sapiens
acggggcgcggctggaaaggc

SEQ ID NO: 56142 - DNA, 23 bp, Homo sapiens
acggggcgcggctggaaaggcgg

SEQ ID NO: 56143 - DNA, 18 bp, Homo sapiens
cggggcgcggctggaaag

SEQ ID NO: 56144 - DNA, 19 bp, Homo sapiens
cggggcgcggctggaaagg

SEQ ID NO: 56145 - DNA, 20 bp, Homo sapiens
cggggcgcggctggaaaggc

SEQ ID NO: 56146 - DNA, 19 bp, Homo sapiens
ggggcgcggctggaaaggc

SEQ ID NO: 56147 - DNA, 18 bp, Homo sapiens
gggcgcggctggaaaggc

SEQ ID NO: 56148 - DNA, 19 bp, Homo sapiens
gggcgcggctggaaaggcg

SEQ ID NO: 56149 - DNA, 20 bp, Homo sapiens
gggcgcggctggaaaggcgg

SEQ ID NO: 56150 - DNA, 21 bp, Homo sapiens
gggcgcggctggaaaggcggc

SEQ ID NO: 56151 - DNA, 22 bp, Homo sapiens
gggcgcggctggaaaggcggcc

SEQ ID NO: 56152 - DNA, 18 bp, Homo sapiens
ggcgcggctggaaaggcg

SEQ ID NO: 56153 - DNA, 19 bp, Homo sapiens
ggcgcggctggaaaggcgg

SEQ ID NO: 56154 - DNA, 20 bp, Homo sapiens
ggcgcggctggaaaggcggc

SEQ ID NO: 56155 - DNA, 17 bp, Homo sapiens
tggaaaggcggccgccc

SEQ ID NO: 56156 - DNA, 16 bp, Homo sapiens
ggaaaggcggccgccc

SEQ ID NO: 56157 - DNA, 27 bp, Homo sapiens
ggaaaggcggccgccccctcgcccgtc

SEQ ID NO: 56158 - DNA, 21 bp, Homo sapiens
aaggcggccgccccctcgccc

SEQ ID NO: 56159 - DNA, 20 bp, Homo sapiens
aggcggccgccccctcgccc

SEQ ID NO: 56160 - DNA, 22 bp, Homo sapiens
ggcggccgccccctcgcccgtc

SEQ ID NO: 56161 - DNA, 17 bp, Homo sapiens
gcggccgccccctcgcc

SEQ ID NO: 56162 - DNA, 18 bp, Homo sapiens
gcggccgccccctcgccc

SEQ ID NO: 56163 - DNA, 19 bp, Homo sapiens
gcggccgccccctcgcccg

SEQ ID NO: 56164 - DNA, 21 bp, Homo sapiens
gcggccgccccctcgcccgtc

SEQ ID NO: 56165 - DNA, 18 bp, Homo sapiens
cggccgccccctcgcccg

SEQ ID NO: 56166 - DNA, 20 bp, Homo sapiens
cggccgccccctcgcccgtc

SEQ ID NO: 56167 - DNA, 17 bp, Homo sapiens
ggccgccccctcgcccg

SEQ ID NO: 56168 - DNA, 19 bp, Homo sapiens
ggccgccccctcgcccgtc

SEQ ID NO: 56169 - DNA, 22 bp, Homo sapiens
ggccgccccctcgcccgtcacg

SEQ ID NO: 56170 - DNA, 23 bp, Homo sapiens
ggccgccccctcgcccgtcacgc

SEQ ID NO: 56171 - DNA, 16 bp, Homo sapiens
cgggcgagggggcggc

SEQ ID NO: 56172 - DNA, 18 bp, Homo sapiens
gccgccccctcgcccgtc

SEQ ID NO: 56173 - DNA, 19 bp, Homo sapiens
gccgccccctcgcccgtca

SEQ ID NO: 56174 - DNA, 21 bp, Homo sapiens
gccgccccctcgcccgtcacg

SEQ ID NO: 56175 - DNA, 22 bp, Homo sapiens
gccgccccctcgcccgtcacgc

SEQ ID NO: 56176 - DNA, 19 bp, Homo sapiens
cctcgcccgtcacgcaccg

SEQ ID NO: 56177 - DNA, 20 bp, Homo sapiens
cctcgcccgtcacgcaccgc

SEQ ID NO: 56178 - DNA, 21 bp, Homo sapiens
cctcgcccgtcacgcaccgca

SEQ ID NO: 56179 - DNA, 19 bp, Homo sapiens
ctcgcccgtcacgcaccgc

SEQ ID NO: 56180 - DNA, 20 bp, Homo sapiens
ctcgcccgtcacgcaccgca

SEQ ID NO: 56181 - DNA, 29 bp, Homo sapiens
cgcccgtcacgcaccgcacgttcgtgggg

SEQ ID NO: 56182 - DNA, 29 bp, Homo sapiens
gcccgtcacgcaccgcacgttcgtgggga

SEQ ID NO: 56183 - DNA, 30 bp, Homo sapiens
cgtcacgcaccgcacgttcgtggggaacct

SEQ ID NO: 56184 - DNA, 30 bp, Homo sapiens
gtcacgcaccgcacgttcgtggggaacctg

SEQ ID NO: 56185 - DNA, 18 bp, Homo sapiens
cacgcaccgcacgttcgt

SEQ ID NO: 56186 - DNA, 19 bp, Homo sapiens
cacgcaccgcacgttcgtg

SEQ ID NO: 56187 - DNA, 21 bp, Homo sapiens
cacgcaccgcacgttcgtggg

SEQ ID NO: 56188 - DNA, 22 bp, Homo sapiens
cacgcaccgcacgttcgtgggg

SEQ ID NO: 56189 - DNA, 28 bp, Homo sapiens
cacgcaccgcacgttcgtggggaacctg

SEQ ID NO: 56190 - DNA, 29 bp, Homo sapiens
cacgcaccgcacgttcgtggggaacctgg

SEQ ID NO: 56191 - DNA, 20 bp, Homo sapiens
acgcaccgcacgttcgtggg

SEQ ID NO: 56192 - DNA, 27 bp, Homo sapiens
acgcaccgcacgttcgtggggaacctg

SEQ ID NO: 56193 - DNA, 28 bp, Homo sapiens
acgcaccgcacgttcgtggggaacctgg

SEQ ID NO: 56194 - DNA, 30 bp, Homo sapiens
acgcaccgcacgttcgtggggaacctggcg

SEQ ID NO: 56195 - DNA, 18 bp, Homo sapiens
cgcaccgcacgttcgtgg

SEQ ID NO: 56196 - DNA, 19 bp, Homo sapiens
cgcaccgcacgttcgtggg

SEQ ID NO: 56197 - DNA, 20 bp, Homo sapiens
cgcaccgcacgttcgtgggg

SEQ ID NO: 56198 - DNA, 23 bp, Homo sapiens
cgcaccgcacgttcgtggggaac

SEQ ID NO: 56199 - DNA, 24 bp, Homo sapiens
cgcaccgcacgttcgtggggaacc

SEQ ID NO: 56200 - DNA, 26 bp, Homo sapiens
cgcaccgcacgttcgtggggaacctg

SEQ ID NO: 56201 - DNA, 27 bp, Homo sapiens
cgcaccgcacgttcgtggggaacctgg

SEQ ID NO: 56202 - DNA, 29 bp, Homo sapiens
cgcaccgcacgttcgtggggaacctggcg

SEQ ID NO: 56203 - DNA, 30 bp, Homo sapiens; identical to SEQ ID NO: 28003

SEQ ID NO: 56204 - DNA, 25 bp, Homo sapiens
gcaccgcacgttcgtggggaacctg

SEQ ID NO: 56205 - DNA, 26 bp, Homo sapiens
gcaccgcacgttcgtggggaacctgg

SEQ ID NO: 56206 - DNA, 30 bp, Homo sapiens; identical to SEQ ID NO: 28008

SEQ ID NO: 56207 - DNA, 17 bp, Homo sapiens
caccgcacgttcgtggg

SEQ ID NO: 56208 - DNA, 25 bp, Homo sapiens
caccgcacgttcgtggggaacctgg

SEQ ID NO: 56209 - DNA, 29 bp, Homo sapiens
caccgcacgttcgtggggaacctggcgct

SEQ ID NO: 56210 - DNA, 24 bp, Homo sapiens
accgcacgttcgtggggaacctgg

SEQ ID NO: 56211 - DNA, 29 bp, Homo sapiens
accgcacgttcgtggggaacctggcgcta

SEQ ID NO: 56212 - DNA, 22 bp, Homo sapiens
ccgcacgttcgtggggaacctg

SEQ ID NO: 56213 - DNA, 23 bp, Homo sapiens
ccgcacgttcgtggggaacctgg

SEQ ID NO: 56214 - DNA, 29 bp, Homo sapiens
ccgcacgttcgtggggaacctggcgctaa

SEQ ID NO: 56215 - DNA, 21 bp, Homo sapiens
cgcacgttcgtggggaacctg

SEQ ID NO: 56216 - DNA, 22 bp, Homo sapiens
cgcacgttcgtggggaacctgg

SEQ ID NO: 56217 - DNA, 23 bp, Homo sapiens
cgcacgttcgtggggaacctggc

SEQ ID NO: 56218 - DNA, 24 bp, Homo sapiens
cgcacgttcgtggggaacctggcg

SEQ ID NO: 56219 - DNA, 25 bp, Homo sapiens
cgcacgttcgtggggaacctggcgc

SEQ ID NO: 56220 - DNA, 26 bp, Homo sapiens
cgcacgttcgtggggaacctggcgct

SEQ ID NO: 56221 - DNA, 30 bp, Homo sapiens
cgcacgttcgtggggaacctggcgctaaac

SEQ ID NO: 56222 - DNA, 16 bp, Homo sapiens
gcacgttcgtggggaa

SEQ ID NO: 56223 - DNA, 17 bp, Homo sapiens
gcacgttcgtggggaac

SEQ ID NO: 56224 - DNA, 18 bp, Homo sapiens
gcacgttcgtggggaacc

SEQ ID NO: 56225 - DNA, 19 bp, Homo sapiens
gcacgttcgtggggaacct

SEQ ID NO: 56226 - DNA, 20 bp, Homo sapiens
gcacgttcgtggggaacctg

SEQ ID NO: 56227 - DNA, 21 bp, Homo sapiens
gcacgttcgtggggaacctgg

SEQ ID NO: 56228 - DNA, 22 bp, Homo sapiens
gcacgttcgtggggaacctggc

SEQ ID NO: 56229 - DNA, 23 bp, Homo sapiens
gcacgttcgtggggaacctggcg

SEQ ID NO: 56230 - DNA, 24 bp, Homo sapiens
gcacgttcgtggggaacctggcgc

SEQ ID NO: 56231 - DNA, 25 bp, Homo sapiens
gcacgttcgtggggaacctggcgct

SEQ ID NO: 56232 - DNA, 26 bp, Homo sapiens
gcacgttcgtggggaacctggcgcta

SEQ ID NO: 56233 - DNA, 29 bp, Homo sapiens
gcacgttcgtggggaacctggcgctaaac

SEQ ID NO: 56234 - DNA, 30 bp, Homo sapiens; identical to SEQ ID NO: 6373

SEQ ID NO: 56235 - DNA, 19 bp, Homo sapiens
cacgttcgtggggaacctg

SEQ ID NO: 56236 - DNA, 20 bp, Homo sapiens
cacgttcgtggggaacctgg

SEQ ID NO: 56237 - DNA, 21 bp, Homo sapiens
cacgttcgtggggaacctggc

SEQ ID NO: 56238 - DNA, 22 bp, Homo sapiens
cacgttcgtggggaacctggcg

SEQ ID NO: 56239 - DNA, 23 bp, Homo sapiens
cacgttcgtggggaacctggcgc

SEQ ID NO: 56240 - DNA, 24 bp, Homo sapiens
cacgttcgtggggaacctggcgct

SEQ ID NO: 56241 - DNA, 25 bp, Homo sapiens
cacgttcgtggggaacctggcgcta

SEQ ID NO: 56242 - DNA, 29 bp, Homo sapiens
cacgttcgtggggaacctggcgctaaacc

SEQ ID NO: 56243 - DNA, 18 bp, Homo sapiens
acgttcgtggggaacctg

SEQ ID NO: 56244 - DNA, 19 bp, Homo sapiens
acgttcgtggggaacctgg

SEQ ID NO: 56245 - DNA, 20 bp, Homo sapiens
acgttcgtggggaacctggc

SEQ ID NO: 56246 - DNA, 21 bp, Homo sapiens
acgttcgtggggaacctggcg

SEQ ID NO: 56247 - DNA, 22 bp, Homo sapiens
acgttcgtggggaacctggcgc

SEQ ID NO: 56248 - DNA, 23 bp, Homo sapiens
acgttcgtggggaacctggcgct

SEQ ID NO: 56249 - DNA, 28 bp, Homo sapiens
acgttcgtggggaacctggcgctaaacc

SEQ ID NO: 56250 - DNA, 30 bp, Homo sapiens
acgttcgtggggaacctggcgctaaaccat

SEQ ID NO: 56251 - DNA, 17 bp, Homo sapiens
cgttcgtggggaacctg

SEQ ID NO: 56252 - DNA, 18 bp, Homo sapiens
cgttcgtggggaacctgg

SEQ ID NO: 56253 - DNA, 19 bp, Homo sapiens
cgttcgtggggaacctggc

SEQ ID NO: 56254 - DNA, 20 bp, Homo sapiens
cgttcgtggggaacctggcg

SEQ ID NO: 56255 - DNA, 21 bp, Homo sapiens
cgttcgtggggaacctggcgc

SEQ ID NO: 56256 - DNA, 22 bp, Homo sapiens
cgttcgtggggaacctggcgct

SEQ ID NO: 56257 - DNA, 23 bp, Homo sapiens
cgttcgtggggaacctggcgcta

SEQ ID NO: 56258 - DNA, 27 bp, Homo sapiens
cgttcgtggggaacctggcgctaaacc

SEQ ID NO: 56259 - DNA, 30 bp, Homo sapiens; identical to SEQ ID NO: 28054

SEQ ID NO: 56260 - DNA, 16 bp, Homo sapiens
gttcgtggggaacctg

SEQ ID NO: 56261 - DNA, 17 bp, Homo sapiens
gttcgtggggaacctgg

SEQ ID NO: 56262 - DNA, 19 bp, Homo sapiens
gttcgtggggaacctggcg

SEQ ID NO: 56263 - DNA, 20 bp, Homo sapiens
gttcgtggggaacctggcgc

SEQ ID NO: 56264 - DNA, 21 bp, Homo sapiens
gttcgtggggaacctggcgct

SEQ ID NO: 56265 - DNA, 23 bp, Homo sapiens
gttcgtggggaacctggcgctaa

SEQ ID NO: 56266 - DNA, 26 bp, Homo sapiens
gttcgtggggaacctggcgctaaacc

SEQ ID NO: 56267 - DNA, 30 bp, Homo sapiens; identical to SEQ ID NO: 31036

SEQ ID NO: 56268 - DNA, 16 bp, Homo sapiens
ttcgtggggaacctgg

SEQ ID NO: 56269 - DNA, 18 bp, Homo sapiens
ttcgtggggaacctggcg

SEQ ID NO: 56270 - DNA, 19 bp, Homo sapiens
ttcgtggggaacctggcgc

SEQ ID NO: 56271 - DNA, 20 bp, Homo sapiens
ttcgtggggaacctggcgct

SEQ ID NO: 56272 - DNA, 21 bp, Homo sapiens
ttcgtggggaacctggcgcta

SEQ ID NO: 56273 - DNA, 22 bp, Homo sapiens
ttcgtggggaacctggcgctaa

SEQ ID NO: 56274 - DNA, 23 bp, Homo sapiens
ttcgtggggaacctggcgctaaa

SEQ ID NO: 56275 - DNA, 24 bp, Homo sapiens
ttcgtggggaacctggcgctaaac

SEQ ID NO: 56276 - DNA, 25 bp, Homo sapiens
ttcgtggggaacctggcgctaaacc

SEQ ID NO: 56277 - DNA, 30 bp, Homo sapiens; identical to SEQ ID NO: 31040

SEQ ID NO: 56278 - DNA, 17 bp, Homo sapiens
tcgtggggaacctggcg

SEQ ID NO: 56279 - DNA, 18 bp, Homo sapiens
tcgtggggaacctggcgc

SEQ ID NO: 56280 - DNA, 19 bp, Homo sapiens
tcgtggggaacctggcgct

SEQ ID NO: 56281 - DNA, 20 bp, Homo sapiens
tcgtggggaacctggcgcta

SEQ ID NO: 56282 - DNA, 21 bp, Homo sapiens
tcgtggggaacctggcgctaa

SEQ ID NO: 56283 - DNA, 22 bp, Homo sapiens
tcgtggggaacctggcgctaaa

SEQ ID NO: 56284 - DNA, 23 bp, Homo sapiens
tcgtggggaacctggcgctaaac

SEQ ID NO: 56285 - DNA, 24 bp, Homo sapiens
tcgtggggaacctggcgctaaacc

SEQ ID NO: 56286 - DNA, 29 bp, Homo sapiens
tcgtggggaacctggcgctaaaccattcg

SEQ ID NO: 56287 - DNA, 30 bp, Homo sapiens; identical to SEQ ID NO: 31043

SEQ ID NO: 56288 - DNA, 16 bp, Homo sapiens
cgtggggaacctggcg

SEQ ID NO: 56289 - DNA, 17 bp, Homo sapiens
cgtggggaacctggcgc

SEQ ID NO: 56290 - DNA, 18 bp, Homo sapiens
cgtggggaacctggcgct

SEQ ID NO: 56291 - DNA, 19 bp, Homo sapiens
cgtggggaacctggcgcta

SEQ ID NO: 56292 - DNA, 20 bp, Homo sapiens
cgtggggaacctggcgctaa

SEQ ID NO: 56293 - DNA, 21 bp, Homo sapiens
cgtggggaacctggcgctaaa

SEQ ID NO: 56294 - DNA, 22 bp, Homo sapiens
cgtggggaacctggcgctaaac

SEQ ID NO: 56295 - DNA, 23 bp, Homo sapiens
cgtggggaacctggcgctaaacc

SEQ ID NO: 56296 - DNA, 24 bp, Homo sapiens
cgtggggaacctggcgctaaacca

SEQ ID NO: 56297 - DNA, 26 bp, Homo sapiens
cgtggggaacctggcgctaaaccatt

SEQ ID NO: 56298 - DNA, 29 bp, Homo sapiens
cgtggggaacctggcgctaaaccattcgt

SEQ ID NO: 56299 - DNA, 16 bp, Homo sapiens
gtggggaacctggcgc

SEQ ID NO: 56300 - DNA, 17 bp, Homo sapiens
gtggggaacctggcgct

SEQ ID NO: 56301 - DNA, 18 bp, Homo sapiens
gtggggaacctggcgcta

SEQ ID NO: 56302 - DNA, 20 bp, Homo sapiens
gtggggaacctggcgctaaa

SEQ ID NO: 56303 - DNA, 21 bp, Homo sapiens
gtggggaacctggcgctaaac

SEQ ID NO: 56304 - DNA, 22 bp, Homo sapiens
gtggggaacctggcgctaaacc

SEQ ID NO: 56305 - DNA, 28 bp, Homo sapiens
gtggggaacctggcgctaaaccattcgt

SEQ ID NO: 56306 - DNA, 16 bp, Homo sapiens
tggggaacctggcgct

SEQ ID NO: 56307 - DNA, 19 bp, Homo sapiens
tggggaacctggcgctaaa

SEQ ID NO: 56308 - DNA, 20 bp, Homo sapiens
tggggaacctggcgctaaac

SEQ ID NO: 56309 - DNA, 21 bp, Homo sapiens
tggggaacctggcgctaaacc

SEQ ID NO: 56310 - DNA, 18 bp, Homo sapiens
ggggaacctggcgctaaa

SEQ ID NO: 56311 - DNA, 20 bp, Homo sapiens
ggggaacctggcgctaaacc

SEQ ID NO: 56312 - DNA, 17 bp, Homo sapiens
gggaacctggcgctaaa

SEQ ID NO: 56313 - DNA, 19 bp, Homo sapiens
gggaacctggcgctaaacc

SEQ ID NO: 56314 - DNA, 18 bp, Homo sapiens
ggaacctggcgctaaacc

SEQ ID NO: 56315 - DNA, 19 bp, Homo sapiens
ggaacctggcgctaaacca

SEQ ID NO: 56316 - DNA, 17 bp, Homo sapiens
gaacctggcgctaaacc

SEQ ID NO: 56317 - DNA, 18 bp, Homo sapiens
gaacctggcgctaaacca

SEQ ID NO: 56318 - DNA, 20 bp, Homo sapiens
gaacctggcgctaaaccatt

SEQ ID NO: 56319 - DNA, 16 bp, Homo sapiens
aacctggcgctaaacc

SEQ ID NO: 56320 - DNA, 23 bp, Homo sapiens
cctggcgctaaaccattcgtaga

SEQ ID NO: 56321 - DNA, 20 bp, Homo sapiens
tggcgctaaaccattcgtag

SEQ ID NO: 56322 - DNA, 21 bp, Homo sapiens
tggcgctaaaccattcgtaga

SEQ ID NO: 56323 - DNA, 16 bp, Homo sapiens
ggcgctaaaccattcg

SEQ ID NO: 56324 - DNA, 20 bp, Homo sapiens
ggcgctaaaccattcgtaga

SEQ ID NO: 56325 - DNA, 22 bp, Homo sapiens
ggcgctaaaccattcgtagacg

SEQ ID NO: 56326 - DNA, 17 bp, Homo sapiens
gcgctaaaccattcgta

SEQ ID NO: 56327 - DNA, 18 bp, Homo sapiens
gcgctaaaccattcgtag

SEQ ID NO: 56328 - DNA, 19 bp, Homo sapiens
gcgctaaaccattcgtaga

SEQ ID NO: 56329 - DNA, 26 bp, Homo sapiens
gcgctaaaccattcgtagacgacctg

SEQ ID NO: 56330 - DNA, 29 bp, Homo sapiens
gcgctaaaccattcgtagacgacctgctt

SEQ ID NO: 56331 - DNA, 30 bp, Homo sapiens
gcgctaaaccattcgtagacgacctgcttc

SEQ ID NO: 56332 - DNA, 17 bp, Homo sapiens
cgctaaaccattcgtag

SEQ ID NO: 56333 - DNA, 18 bp, Homo sapiens
cgctaaaccattcgtaga

SEQ ID NO: 56334 - DNA, 19 bp, Homo sapiens
cgctaaaccattcgtagac

SEQ ID NO: 56335 - DNA, 20 bp, Homo sapiens
cgctaaaccattcgtagacg

SEQ ID NO: 56336 - DNA, 21 bp, Homo sapiens
cgctaaaccattcgtagacga

SEQ ID NO: 56337 - DNA, 22 bp, Homo sapiens
cgctaaaccattcgtagacgac

SEQ ID NO: 56338 - DNA, 23 bp, Homo sapiens
cgctaaaccattcgtagacgacc

SEQ ID NO: 56339 - DNA, 24 bp, Homo sapiens
cgctaaaccattcgtagacgacct

SEQ ID NO: 56340 - DNA, 25 bp, Homo sapiens
cgctaaaccattcgtagacgacctg

SEQ ID NO: 56341 - DNA, 26 bp, Homo sapiens
cgctaaaccattcgtagacgacctgc

SEQ ID NO: 56342 - DNA, 27 bp, Homo sapiens
cgctaaaccattcgtagacgacctgct

SEQ ID NO: 56343 - DNA, 28 bp, Homo sapiens
cgctaaaccattcgtagacgacctgctt

SEQ ID NO: 56344 - DNA, 29 bp, Homo sapiens
cgctaaaccattcgtagacgacctgcttc

SEQ ID NO: 56345 - DNA, 30 bp, Homo sapiens; identical to SEQ ID NO: 28134

SEQ ID NO: 56346 - DNA, 17 bp, Homo sapiens
gctaaaccattcgtaga

SEQ ID NO: 56347 - DNA, 18 bp, Homo sapiens
gctaaaccattcgtagac

SEQ ID NO: 56348 - DNA, 19 bp, Homo sapiens
gctaaaccattcgtagacg

SEQ ID NO: 56349 - DNA, 20 bp, Homo sapiens
gctaaaccattcgtagacga

SEQ ID NO: 56350 - DNA, 21 bp, Homo sapiens
gctaaaccattcgtagacgac

SEQ ID NO: 56351 - DNA, 22 bp, Homo sapiens
gctaaaccattcgtagacgacc

SEQ ID NO: 56352 - DNA, 23 bp, Homo sapiens
gctaaaccattcgtagacgacct

SEQ ID NO: 56353 - DNA, 24 bp, Homo sapiens
gctaaaccattcgtagacgacctg

SEQ ID NO: 56354 - DNA, 26 bp, Homo sapiens
gctaaaccattcgtagacgacctgct

SEQ ID NO: 56355 - DNA, 27 bp, Homo sapiens
gctaaaccattcgtagacgacctgctt

SEQ ID NO: 56356 - DNA, 28 bp, Homo sapiens
gctaaaccattcgtagacgacctgcttc

SEQ ID NO: 56357 - DNA, 30 bp, Homo sapiens
gctaaaccattcgtagacgacctgcttctg

SEQ ID NO: 56358 - DNA, 16 bp, Homo sapiens
ctaaaccattcgtaga

SEQ ID NO: 56359 - DNA, 18 bp, Homo sapiens
ctaaaccattcgtagacg

SEQ ID NO: 56360 - DNA, 20 bp, Homo sapiens
ctaaaccattcgtagacgac

SEQ ID NO: 56361 - DNA, 21 bp, Homo sapiens
ctaaaccattcgtagacgacc

SEQ ID NO: 56362 - DNA, 22 bp, Homo sapiens
ctaaaccattcgtagacgacct

SEQ ID NO: 56363 - DNA, 23 bp, Homo sapiens
ctaaaccattcgtagacgacctg

SEQ ID NO: 56364 - DNA, 24 bp, Homo sapiens
ctaaaccattcgtagacgacctgc

SEQ ID NO: 56365 - DNA, 25 bp, Homo sapiens
ctaaaccattcgtagacgacctgct

SEQ ID NO: 56366 - DNA, 26 bp, Homo sapiens
ctaaaccattcgtagacgacctgctt

SEQ ID NO: 56367 - DNA, 27 bp, Homo sapiens
ctaaaccattcgtagacgacctgcttc

SEQ ID NO: 56368 - DNA, 29 bp, Homo sapiens
ctaaaccattcgtagacgacctgcttctg

SEQ ID NO: 56369 - DNA, 30 bp, Homo sapiens
ctaaaccattcgtagacgacctgcttctgg

SEQ ID NO: 56370 - DNA, 21 bp, Homo sapiens
taaaccattcgtagacgacct

SEQ ID NO: 56371 - DNA, 22 bp, Homo sapiens
taaaccattcgtagacgacctg

SEQ ID NO: 56372 - DNA, 23 bp, Homo sapiens
taaaccattcgtagacgacctgc

SEQ ID NO: 56373 - DNA, 24 bp, Homo sapiens
taaaccattcgtagacgacctgct

SEQ ID NO: 56374 - DNA, 25 bp, Homo sapiens
taaaccattcgtagacgacctgctt

SEQ ID NO: 56375 - DNA, 26 bp, Homo sapiens
taaaccattcgtagacgacctgcttc

SEQ ID NO: 56376 - DNA, 21 bp, Homo sapiens
aaaccattcgtagacgacctg

SEQ ID NO: 56377 - DNA, 22 bp, Homo sapiens
aaaccattcgtagacgacctgc

SEQ ID NO: 56378 - DNA, 23 bp, Homo sapiens
aaaccattcgtagacgacctgct

SEQ ID NO: 56379 - DNA, 24 bp, Homo sapiens
aaaccattcgtagacgacctgctt

SEQ ID NO: 56380 - DNA, 25 bp, Homo sapiens
aaaccattcgtagacgacctgcttc

SEQ ID NO: 56381 - DNA, 26 bp, Homo sapiens
aaaccattcgtagacgacctgcttct

SEQ ID NO: 56382 - DNA, 27 bp, Homo sapiens
aaaccattcgtagacgacctgcttctg

SEQ ID NO: 56383 - DNA, 28 bp, Homo sapiens
aaaccattcgtagacgacctgcttctgg

SEQ ID NO: 56384 - DNA, 20 bp, Homo sapiens
aaccattcgtagacgacctg

SEQ ID NO: 56385 - DNA, 22 bp, Homo sapiens
aaccattcgtagacgacctgct

SEQ ID NO: 56386 - DNA, 23 bp, Homo sapiens
aaccattcgtagacgacctgctt

SEQ ID NO: 56387 - DNA, 24 bp, Homo sapiens
aaccattcgtagacgacctgcttc

SEQ ID NO: 56388 - DNA, 26 bp, Homo sapiens
aaccattcgtagacgacctgcttctg

SEQ ID NO: 56389 - DNA, 19 bp, Homo sapiens
accattcgtagacgacctg

SEQ ID NO: 56390 - DNA, 21 bp, Homo sapiens
accattcgtagacgacctgct

SEQ ID NO: 56391 - DNA, 22 bp, Homo sapiens
accattcgtagacgacctgctt

SEQ ID NO: 56392 - DNA, 23 bp, Homo sapiens
accattcgtagacgacctgcttc

SEQ ID NO: 56393 - DNA, 25 bp, Homo sapiens
accattcgtagacgacctgcttctg

SEQ ID NO: 56394 - DNA, 18 bp, Homo sapiens
ccattcgtagacgacctg

SEQ ID NO: 56395 - DNA, 20 bp, Homo sapiens
ccattcgtagacgacctgct

SEQ ID NO: 56396 - DNA, 21 bp, Homo sapiens
ccattcgtagacgacctgctt

SEQ ID NO: 56397 - DNA, 22 bp, Homo sapiens
ccattcgtagacgacctgcttc

SEQ ID NO: 56398 - DNA, 23 bp, Homo sapiens
ccattcgtagacgacctgcttct

SEQ ID NO: 56399 - DNA, 24 bp, Homo sapiens
ccattcgtagacgacctgcttctg

SEQ ID NO: 56400 - DNA, 25 bp, Homo sapiens
ccattcgtagacgacctgcttctgg

SEQ ID NO: 56401 - DNA, 17 bp, Homo sapiens
cattcgtagacgacctg

SEQ ID NO: 56402 - DNA, 19 bp, Homo sapiens
cattcgtagacgacctgct

SEQ ID NO: 56403 - DNA, 20 bp, Homo sapiens
cattcgtagacgacctgctt

SEQ ID NO: 56404 - DNA, 21 bp, Homo sapiens
cattcgtagacgacctgcttc

SEQ ID NO: 56405 - DNA, 22 bp, Homo sapiens
cattcgtagacgacctgcttct

SEQ ID NO: 56406 - DNA, 23 bp, Homo sapiens
cattcgtagacgacctgcttctg

SEQ ID NO: 56407 - DNA, 24 bp, Homo sapiens
cattcgtagacgacctgcttctgg

SEQ ID NO: 56408 - DNA, 30 bp, Homo sapiens
cattcgtagacgacctgcttctgggtcggg

SEQ ID NO: 56409 - DNA, 18 bp, Homo sapiens
attcgtagacgacctgct

SEQ ID NO: 56410 - DNA, 19 bp, Homo sapiens
attcgtagacgacctgctt

SEQ ID NO: 56411 - DNA, 20 bp, Homo sapiens
attcgtagacgacctgcttc

SEQ ID NO: 56412 - DNA, 22 bp, Homo sapiens
attcgtagacgacctgcttctg

SEQ ID NO: 56413 - DNA, 23 bp, Homo sapiens
attcgtagacgacctgcttctgg

SEQ ID NO: 56414 - DNA, 24 bp, Homo sapiens
attcgtagacgacctgcttctggg

SEQ ID NO: 56415 - DNA, 30 bp, Homo sapiens
attcgtagacgacctgcttctgggtcgggg

SEQ ID NO: 56416 - DNA, 17 bp, Homo sapiens
ttcgtagacgacctgct

SEQ ID NO: 56417 - DNA, 18 bp, Homo sapiens
ttcgtagacgacctgctt

SEQ ID NO: 56418 - DNA, 19 bp, Homo sapiens
ttcgtagacgacctgcttc

SEQ ID NO: 56419 - DNA, 20 bp, Homo sapiens
ttcgtagacgacctgcttct

SEQ ID NO: 56420 - DNA, 21 bp, Homo sapiens
ttcgtagacgacctgcttctg

SEQ ID NO: 56421 - DNA, 22 bp, Homo sapiens
ttcgtagacgacctgcttctgg

SEQ ID NO: 56422 - DNA, 23 bp, Homo sapiens
ttcgtagacgacctgcttctggg

SEQ ID NO: 56423 - DNA, 24 bp, Homo sapiens
ttcgtagacgacctgcttctgggt

SEQ ID NO: 56424 - DNA, 30 bp, Homo sapiens; identical to SEQ ID NO: 28228

SEQ ID NO: 56425 - DNA, 18 bp, Homo sapiens
tcgtagacgacctgcttc

SEQ ID NO: 56426 - DNA, 16 bp, Homo sapiens
cgtagacgacctgctt

SEQ ID NO: 56427 - DNA, 17 bp, Homo sapiens
cgtagacgacctgcttc

SEQ ID NO: 56428 - DNA, 20 bp, Homo sapiens
cgtagacgacctgcttctgg

SEQ ID NO: 56429 - DNA, 21 bp, Homo sapiens
cgtagacgacctgcttctggg

SEQ ID NO: 56430 - DNA, 30 bp, Homo sapiens
cgtagacgacctgcttctgggtcggggttt

SEQ ID NO: 56431 - DNA, 16 bp, Homo sapiens
gtagacgacctgcttc

SEQ ID NO: 56432 - DNA, 19 bp, Homo sapiens
gtagacgacctgcttctgg

SEQ ID NO: 56433 - DNA, 20 bp, Homo sapiens
gtagacgacctgcttctggg

SEQ ID NO: 56434 - DNA, 21 bp, Homo sapiens
gtagacgacctgcttctgggt

SEQ ID NO: 56435 - DNA, 24 bp, Homo sapiens
gtagacgacctgcttctgggtcgg

SEQ ID NO: 56436 - DNA, 25 bp, Homo sapiens
gtagacgacctgcttctgggtcggg

SEQ ID NO: 56437 - DNA, 26 bp, Homo sapiens
gtagacgacctgcttctgggtcgggg

SEQ ID NO: 56438 - DNA, 28 bp, Homo sapiens
gtagacgacctgcttctgggtcggggtt

SEQ ID NO: 56439 - DNA, 29 bp, Homo sapiens
gtagacgacctgcttctgggtcggggttt

SEQ ID NO: 56440 - DNA, 30 bp, Homo sapiens
gtagacgacctgcttctgggtcggggtttc

SEQ ID NO: 56441 - DNA, 18 bp, Homo sapiens
tagacgacctgcttctgg

SEQ ID NO: 56442 - DNA, 19 bp, Homo sapiens
tagacgacctgcttctggg

SEQ ID NO: 56443 - DNA, 20 bp, Homo sapiens
tagacgacctgcttctgggt

SEQ ID NO: 56444 - DNA, 29 bp, Homo sapiens
agacgacctgcttctgggtcggggtttcg

SEQ ID NO: 56445 - DNA, 30 bp, Homo sapiens
agacgacctgcttctgggtcggggtttcgt

SEQ ID NO: 56446 - DNA, 25 bp, Homo sapiens
gacgacctgcttctgggtcggggtt

SEQ ID NO: 56447 - DNA, 30 bp, Homo sapiens
gacgacctgcttctgggtcggggtttcgta

SEQ ID NO: 56448 - DNA, 19 bp, Homo sapiens
cgacctgcttctgggtcgg

SEQ ID NO: 56449 - DNA, 23 bp, Homo sapiens
gacctgcttctgggtcggggttt

SEQ ID NO: 56450 - DNA, 24 bp, Homo sapiens
gacctgcttctgggtcggggtttc

SEQ ID NO: 56451 - DNA, 25 bp, Homo sapiens
gacctgcttctgggtcggggtttcg

SEQ ID NO: 56452 - DNA, 30 bp, Homo sapiens
gacctgcttctgggtcggggtttcgtacgt

SEQ ID NO: 56453 - DNA, 19 bp, Homo sapiens
ccccgacccagaagcaggt

SEQ ID NO: 56454 - DNA, 29 bp, Homo sapiens
acctgcttctgggtcggggtttcgtacgt

SEQ ID NO: 56455 - DNA, 30 bp, Homo sapiens
acctgcttctgggtcggggtttcgtacgta

SEQ ID NO: 56456 - DNA, 16 bp, Homo sapiens
cctgcttctgggtcgg

SEQ ID NO: 56457 - DNA, 18 bp, Homo sapiens
cctgcttctgggtcgggg

SEQ ID NO: 56458 - DNA, 25 bp, Homo sapiens
cctgcttctgggtcggggtttcgta

SEQ ID NO: 56459 - DNA, 16 bp, Homo sapiens
ctgcttctgggtcggg

SEQ ID NO: 56460 - DNA, 17 bp, Homo sapiens
ctgcttctgggtcgggg

SEQ ID NO: 56461 - DNA, 19 bp, Homo sapiens
ctgcttctgggtcggggtt

SEQ ID NO: 56462 - DNA, 20 bp, Homo sapiens
ctgcttctgggtcggggttt

SEQ ID NO: 56463 - DNA, 21 bp, Homo sapiens
ctgcttctgggtcggggtttc

SEQ ID NO: 56464 - DNA, 22 bp, Homo sapiens
ctgcttctgggtcggggtttcg

SEQ ID NO: 56465 - DNA, 23 bp, Homo sapiens
ctgcttctgggtcggggtttcgt

SEQ ID NO: 56466 - DNA, 24 bp, Homo sapiens
ctgcttctgggtcggggtttcgta

SEQ ID NO: 56467 - DNA, 26 bp, Homo sapiens
ctgcttctgggtcggggtttcgtacg

SEQ ID NO: 56468 - DNA, 28 bp, Homo sapiens
ctgcttctgggtcggggtttcgtacgta

SEQ ID NO: 56469 - DNA, 29 bp, Homo sapiens
ctgcttctgggtcggggtttcgtacgtag

SEQ ID NO: 56470 - DNA, 30 bp, Homo sapiens
ctgcttctgggtcggggtttcgtacgtagc

SEQ ID NO: 56471 - DNA, 16 bp, Homo sapiens
tgcttctgggtcgggg

SEQ ID NO: 56472 - DNA, 18 bp, Homo sapiens
tgcttctgggtcggggtt

SEQ ID NO: 56473 - DNA, 21 bp, Homo sapiens
tgcttctgggtcggggtttcg

SEQ ID NO: 56474 - DNA, 22 bp, Homo sapiens
tgcttctgggtcggggtttcgt

SEQ ID NO: 56475 - DNA, 23 bp, Homo sapiens
tgcttctgggtcggggtttcgta

SEQ ID NO: 56476 - DNA, 25 bp, Homo sapiens
tgcttctgggtcggggtttcgtacg

SEQ ID NO: 56477 - DNA, 27 bp, Homo sapiens
tgcttctgggtcggggtttcgtacgta

SEQ ID NO: 56478 - DNA, 28 bp, Homo sapiens
tgcttctgggtcggggtttcgtacgtag

SEQ ID NO: 56479 - DNA, 29 bp, Homo sapiens
tgcttctgggtcggggtttcgtacgtagc

SEQ ID NO: 56480 - DNA, 17 bp, Homo sapiens
gcttctgggtcggggtt

SEQ ID NO: 56481 - DNA, 19 bp, Homo sapiens
gcttctgggtcggggtttc

SEQ ID NO: 56482 - DNA, 20 bp, Homo sapiens
gcttctgggtcggggtttcg

SEQ ID NO: 56483 - DNA, 21 bp, Homo sapiens
gcttctgggtcggggtttcgt

SEQ ID NO: 56484 - DNA, 22 bp, Homo sapiens
gcttctgggtcggggtttcgta

SEQ ID NO: 56485 - DNA, 24 bp, Homo sapiens
gcttctgggtcggggtttcgtacg

SEQ ID NO: 56486 - DNA, 25 bp, Homo sapiens
gcttctgggtcggggtttcgtacgt

SEQ ID NO: 56487 - DNA, 26 bp, Homo sapiens
gcttctgggtcggggtttcgtacgta

SEQ ID NO: 56488 - DNA, 27 bp, Homo sapiens
gcttctgggtcggggtttcgtacgtag

SEQ ID NO: 56489 - DNA, 28 bp, Homo sapiens
gcttctgggtcggggtttcgtacgtagc

SEQ ID NO: 56490 - DNA, 29 bp, Homo sapiens
gcttctgggtcggggtttcgtacgtagca

SEQ ID NO: 56491 - DNA, 19 bp, Homo sapiens
cttctgggtcggggtttcg

SEQ ID NO: 56492 - DNA, 21 bp, Homo sapiens
cttctgggtcggggtttcgta

SEQ ID NO: 56493 - DNA, 23 bp, Homo sapiens
cttctgggtcggggtttcgtacg

SEQ ID NO: 56494 - DNA, 26 bp, Homo sapiens
cttctgggtcggggtttcgtacgtag

SEQ ID NO: 56495 - DNA, 27 bp, Homo sapiens
cttctgggtcggggtttcgtacgtagc

SEQ ID NO: 56496 - DNA, 28 bp, Homo sapiens
cttctgggtcggggtttcgtacgtagca

SEQ ID NO: 56497 - DNA, 29 bp, Homo sapiens
cttctgggtcggggtttcgtacgtagcag

SEQ ID NO: 56498 - DNA, 18 bp, Homo sapiens
ttctgggtcggggtttcg

SEQ ID NO: 56499 - DNA, 19 bp, Homo sapiens
ttctgggtcggggtttcgt

SEQ ID NO: 56500 - DNA, 20 bp, Homo sapiens
ttctgggtcggggtttcgta

SEQ ID NO: 56501 - DNA, 21 bp, Homo sapiens
ttctgggtcggggtttcgtac

SEQ ID NO: 56502 - DNA, 22 bp, Homo sapiens
ttctgggtcggggtttcgtacg

SEQ ID NO: 56503 - DNA, 23 bp, Homo sapiens
ttctgggtcggggtttcgtacgt

SEQ ID NO: 56504 - DNA, 24 bp, Homo sapiens
ttctgggtcggggtttcgtacgta

SEQ ID NO: 56505 - DNA, 25 bp, Homo sapiens
ttctgggtcggggtttcgtacgtag

SEQ ID NO: 56506 - DNA, 26 bp, Homo sapiens
ttctgggtcggggtttcgtacgtagc

SEQ ID NO: 56507 - DNA, 27 bp, Homo sapiens
ttctgggtcggggtttcgtacgtagca

SEQ ID NO: 56508 - DNA, 30 bp, Homo sapiens; identical to SEQ ID NO: 31073

SEQ ID NO: 56509 - DNA, 17 bp, Homo sapiens
tctgggtcggggtttcg

SEQ ID NO: 56510 - DNA, 18 bp, Homo sapiens
tctgggtcggggtttcgt

SEQ ID NO: 56511 - DNA, 19 bp, Homo sapiens
tctgggtcggggtttcgta

SEQ ID NO: 56512 - DNA, 20 bp, Homo sapiens
tctgggtcggggtttcgtac

SEQ ID NO: 56513 - DNA, 21 bp, Homo sapiens
tctgggtcggggtttcgtacg

SEQ ID NO: 56514 - DNA, 22 bp, Homo sapiens
tctgggtcggggtttcgtacgt

SEQ ID NO: 56515 - DNA, 23 bp, Homo sapiens
tctgggtcggggtttcgtacgta

SEQ ID NO: 56516 - DNA, 24 bp, Homo sapiens
tctgggtcggggtttcgtacgtag

SEQ ID NO: 56517 - DNA, 25 bp, Homo sapiens
tctgggtcggggtttcgtacgtagc

SEQ ID NO: 56518 - DNA, 26 bp, Homo sapiens
tctgggtcggggtttcgtacgtagca

SEQ ID NO: 56519 - DNA, 27 bp, Homo sapiens
tctgggtcggggtttcgtacgtagcag

SEQ ID NO: 56520 - DNA, 29 bp, Homo sapiens
tctgggtcggggtttcgtacgtagcagag

SEQ ID NO: 56521 - DNA, 30 bp, Homo sapiens; identical to SEQ ID NO: 6461

SEQ ID NO: 56522 - DNA, 17 bp, Homo sapiens
ctgggtcggggtttcgt

SEQ ID NO: 56523 - DNA, 18 bp, Homo sapiens
ctgggtcggggtttcgta

SEQ ID NO: 56524 - DNA, 19 bp, Homo sapiens
ctgggtcggggtttcgtac

SEQ ID NO: 56525 - DNA, 20 bp, Homo sapiens
ctgggtcggggtttcgtacg

SEQ ID NO: 56526 - DNA, 21 bp, Homo sapiens
ctgggtcggggtttcgtacgt

SEQ ID NO: 56527 - DNA, 22 bp, Homo sapiens
ctgggtcggggtttcgtacgta

SEQ ID NO: 56528 - DNA, 23 bp, Homo sapiens
ctgggtcggggtttcgtacgtag

SEQ ID NO: 56529 - DNA, 24 bp, Homo sapiens
ctgggtcggggtttcgtacgtagc

SEQ ID NO: 56530 - DNA, 25 bp, Homo sapiens
ctgggtcggggtttcgtacgtagca

SEQ ID NO: 56531 - DNA, 26 bp, Homo sapiens
ctgggtcggggtttcgtacgtagcag

SEQ ID NO: 56532 - DNA, 29 bp, Homo sapiens
ctgggtcggggtttcgtacgtagcagagc

SEQ ID NO: 56533 - DNA, 19 bp, Homo sapiens
tgggtcggggtttcgtacg

SEQ ID NO: 56534 - DNA, 20 bp, Homo sapiens
tgggtcggggtttcgtacgt

SEQ ID NO: 56535 - DNA, 22 bp, Homo sapiens
tgggtcggggtttcgtacgtag

SEQ ID NO: 56536 - DNA, 23 bp, Homo sapiens
tgggtcggggtttcgtacgtagc

SEQ ID NO: 56537 - DNA, 24 bp, Homo sapiens
tgggtcggggtttcgtacgtagca

SEQ ID NO: 56538 - DNA, 21 bp, Homo sapiens
gggtcggggtttcgtacgtag

SEQ ID NO: 56539 - DNA, 22 bp, Homo sapiens
gggtcggggtttcgtacgtagc

SEQ ID NO: 56540 - DNA, 23 bp, Homo sapiens
gggtcggggtttcgtacgtagca

SEQ ID NO: 56541 - DNA, 17 bp, Homo sapiens
ggtcggggtttcgtacg

SEQ ID NO: 56542 - DNA, 19 bp, Homo sapiens
ggtcggggtttcgtacgta

SEQ ID NO: 56543 - DNA, 20 bp, Homo sapiens
ggtcggggtttcgtacgtag

SEQ ID NO: 56544 - DNA, 21 bp, Homo sapiens
ggtcggggtttcgtacgtagc

SEQ ID NO: 56545 - DNA, 22 bp, Homo sapiens
ggtcggggtttcgtacgtagca

SEQ ID NO: 56546 - DNA, 23 bp, Homo sapiens
ggtcggggtttcgtacgtagcag

SEQ ID NO: 56547 - DNA, 24 bp, Homo sapiens
ggtcggggtttcgtacgtagcaga

SEQ ID NO: 56548 - DNA, 25 bp, Homo sapiens
ggtcggggtttcgtacgtagcagag

SEQ ID NO: 56549 - DNA, 26 bp, Homo sapiens
ggtcggggtttcgtacgtagcagagc

SEQ ID NO: 56550 - DNA, 27 bp, Homo sapiens
ggtcggggtttcgtacgtagcagagca

SEQ ID NO: 56551 - DNA, 30 bp, Homo sapiens
ggtcggggtttcgtacgtagcagagcagct

SEQ ID NO: 56552 - DNA, 18 bp, Homo sapiens
gtcggggtttcgtacgta

SEQ ID NO: 56553 - DNA, 19 bp, Homo sapiens
gtcggggtttcgtacgtag

SEQ ID NO: 56554 - DNA, 20 bp, Homo sapiens
gtcggggtttcgtacgtagc

SEQ ID NO: 56555 - DNA, 21 bp, Homo sapiens
gtcggggtttcgtacgtagca

SEQ ID NO: 56556 - DNA, 22 bp, Homo sapiens
gtcggggtttcgtacgtagcag

SEQ ID NO: 56557 - DNA, 18 bp, Homo sapiens
tcggggtttcgtacgtag

SEQ ID NO: 56558 - DNA, 19 bp, Homo sapiens
tcggggtttcgtacgtagc

SEQ ID NO: 56559 - DNA, 20 bp, Homo sapiens
tcggggtttcgtacgtagca

SEQ ID NO: 56560 - DNA, 21 bp, Homo sapiens
tcggggtttcgtacgtagcag

SEQ ID NO: 56561 - DNA, 22 bp, Homo sapiens
tcggggtttcgtacgtagcaga

SEQ ID NO: 56562 - DNA, 23 bp, Homo sapiens
tcggggtttcgtacgtagcagag

SEQ ID NO: 56563 - DNA, 24 bp, Homo sapiens
tcggggtttcgtacgtagcagagc

SEQ ID NO: 56564 - DNA, 17 bp, Homo sapiens
cggggtttcgtacgtag

SEQ ID NO: 56565 - DNA, 18 bp, Homo sapiens
cggggtttcgtacgtagc

SEQ ID NO: 56566 - DNA, 19 bp, Homo sapiens
cggggtttcgtacgtagca

SEQ ID NO: 56567 - DNA, 20 bp, Homo sapiens
cggggtttcgtacgtagcag

SEQ ID NO: 56568 - DNA, 21 bp, Homo sapiens
cggggtttcgtacgtagcaga

SEQ ID NO: 56569 - DNA, 22 bp, Homo sapiens
cggggtttcgtacgtagcagag

SEQ ID NO: 56570 - DNA, 23 bp, Homo sapiens
cggggtttcgtacgtagcagagc

SEQ ID NO: 56571 - DNA, 16 bp, Homo sapiens
ggggtttcgtacgtag

SEQ ID NO: 56572 - DNA, 22 bp, Homo sapiens
ggggtttcgtacgtagcagagc

SEQ ID NO: 56573 - DNA, 18 bp, Homo sapiens
gggtttcgtacgtagcag

SEQ ID NO: 56574 - DNA, 19 bp, Homo sapiens
gggtttcgtacgtagcaga

SEQ ID NO: 56575 - DNA, 20 bp, Homo sapiens
gggtttcgtacgtagcagag

SEQ ID NO: 56576 - DNA, 21 bp, Homo sapiens
gggtttcgtacgtagcagagc

SEQ ID NO: 56577 - DNA, 22 bp, Homo sapiens
gggtttcgtacgtagcagagca

SEQ ID NO: 56578 - DNA, 17 bp, Homo sapiens
ggtttcgtacgtagcag

SEQ ID NO: 56579 - DNA, 18 bp, Homo sapiens
ggtttcgtacgtagcaga

SEQ ID NO: 56580 - DNA, 19 bp, Homo sapiens
ggtttcgtacgtagcagag

SEQ ID NO: 56581 - DNA, 20 bp, Homo sapiens
ggtttcgtacgtagcagagc

SEQ ID NO: 56582 - DNA, 21 bp, Homo sapiens
ggtttcgtacgtagcagagca

SEQ ID NO: 56583 - DNA, 22 bp, Homo sapiens
ggtttcgtacgtagcagagcag

SEQ ID NO: 56584 - DNA, 23 bp, Homo sapiens
ggtttcgtacgtagcagagcagc

SEQ ID NO: 56585 - DNA, 24 bp, Homo sapiens
ggtttcgtacgtagcagagcagct

SEQ ID NO: 56586 - DNA, 25 bp, Homo sapiens
ggtttcgtacgtagcagagcagctc

SEQ ID NO: 56587 - DNA, 19 bp, Homo sapiens
tttcgtacgtagcagagca

SEQ ID NO: 56588 - DNA, 20 bp, Homo sapiens
tttcgtacgtagcagagcag

SEQ ID NO: 56589 - DNA, 23 bp, Homo sapiens
tttcgtacgtagcagagcagctc

SEQ ID NO: 56590 - DNA, 20 bp, Homo sapiens
tcgtacgtagcagagcagct

SEQ ID NO: 56591 - DNA, 21 bp, Homo sapiens
tcgtacgtagcagagcagctc

SEQ ID NO: 56592 - DNA, 23 bp, Homo sapiens
tcgtacgtagcagagcagctccc

SEQ ID NO: 56593 - DNA, 24 bp, Homo sapiens
tcgtacgtagcagagcagctccct

SEQ ID NO: 56594 - DNA, 24 bp, Homo sapiens
gtacgtagcagagcagctccctcg

SEQ ID NO: 56595 - DNA, 25 bp, Homo sapiens
gtacgtagcagagcagctccctcgc

SEQ ID NO: 56596 - DNA, 21 bp, Homo sapiens
cgtagcagagcagctccctcg

SEQ ID NO: 56597 - DNA, 21 bp, Homo sapiens
tagcagagcagctccctcgct

SEQ ID NO: 56598 - DNA, 28 bp, Homo sapiens
tagcagagcagctccctcgctgcgatct

SEQ ID NO: 56599 - DNA, 30 bp, Homo sapiens
tagcagagcagctccctcgctgcgatctat

SEQ ID NO: 56600 - DNA, 16 bp, Homo sapiens
gcagagcagctccctc

SEQ ID NO: 56601 - DNA, 17 bp, Homo sapiens
gcagagcagctccctcg

SEQ ID NO: 56602 - DNA, 18 bp, Homo sapiens
gcagagcagctccctcgc

SEQ ID NO: 56603 - DNA, 19 bp, Homo sapiens
gcagagcagctccctcgct

SEQ ID NO: 56604 - DNA, 20 bp, Homo sapiens
gcagagcagctccctcgctg

SEQ ID NO: 56605 - DNA, 21 bp, Homo sapiens
gcagagcagctccctcgctgc

SEQ ID NO: 56606 - DNA, 22 bp, Homo sapiens
gcagagcagctccctcgctgcg

SEQ ID NO: 56607 - DNA, 23 bp, Homo sapiens
gcagagcagctccctcgctgcga

SEQ ID NO: 56608 - DNA, 24 bp, Homo sapiens
gcagagcagctccctcgctgcgat

SEQ ID NO: 56609 - DNA, 25 bp, Homo sapiens
gcagagcagctccctcgctgcgatc

SEQ ID NO: 56610 - DNA, 26 bp, Homo sapiens
gcagagcagctccctcgctgcgatct

SEQ ID NO: 56611 - DNA, 29 bp, Homo sapiens
gcagagcagctccctcgctgcgatctatt

SEQ ID NO: 56612 - DNA, 30 bp, Homo sapiens; identical to SEQ ID NO: 31089

SEQ ID NO: 56613 - DNA, 22 bp, Homo sapiens
agagcagctccctcgctgcgat

SEQ ID NO: 56614 - DNA, 23 bp, Homo sapiens
agagcagctccctcgctgcgatc

SEQ ID NO: 56615 - DNA, 20 bp, Homo sapiens
gagcagctccctcgctgcga

SEQ ID NO: 56616 - DNA, 21 bp, Homo sapiens
gagcagctccctcgctgcgat

SEQ ID NO: 56617 - DNA, 22 bp, Homo sapiens
gagcagctccctcgctgcgatc

SEQ ID NO: 56618 - DNA, 23 bp, Homo sapiens
gagcagctccctcgctgcgatct

SEQ ID NO: 56619 - DNA, 20 bp, Homo sapiens
gcagctccctcgctgcgatc

SEQ ID NO: 56620 - DNA, 21 bp, Homo sapiens
gcagctccctcgctgcgatct

SEQ ID NO: 56621 - DNA, 18 bp, Homo sapiens
agctccctcgctgcgatc

SEQ ID NO: 56622 - DNA, 19 bp, Homo sapiens
agctccctcgctgcgatct

SEQ ID NO: 56623 - DNA, 17 bp, Homo sapiens
gctccctcgctgcgatc

SEQ ID NO: 56624 - DNA, 18 bp, Homo sapiens
gctccctcgctgcgatct

SEQ ID NO: 56625 - DNA, 22 bp, Homo sapiens
gctccctcgctgcgatctattg

SEQ ID NO: 56626 - DNA, 23 bp, Homo sapiens
gctccctcgctgcgatctattga

SEQ ID NO: 56627 - DNA, 24 bp, Homo sapiens
gctccctcgctgcgatctattgaa

SEQ ID NO: 56628 - DNA, 25 bp, Homo sapiens
gctccctcgctgcgatctattgaaa

SEQ ID NO: 56629 - DNA, 30 bp, Homo sapiens
gctccctcgctgcgatctattgaaagtcag

SEQ ID NO: 56630 - DNA, 21 bp, Homo sapiens
ctccctcgctgcgatctattg

SEQ ID NO: 56631 - DNA, 30 bp, Homo sapiens
tccctcgctgcgatctattgaaagtcagcc

SEQ ID NO: 56632 - DNA, 19 bp, Homo sapiens
ccctcgctgcgatctattg

SEQ ID NO: 56633 - DNA, 20 bp, Homo sapiens
ccctcgctgcgatctattga

SEQ ID NO: 56634 - DNA, 30 bp, Homo sapiens
cctcgctgcgatctattgaaagtcagccct

SEQ ID NO: 56635 - DNA, 21 bp, Homo sapiens
ctcgctgcgatctattgaaag

SEQ ID NO: 56636 - DNA, 23 bp, Homo sapiens
ctcgctgcgatctattgaaagtc

SEQ ID NO: 56637 - DNA, 30 bp, Homo sapiens; identical to SEQ ID NO: 31090

SEQ ID NO: 56638 - DNA, 22 bp, Homo sapiens
tcgctgcgatctattgaaagtc

SEQ ID NO: 56639 - DNA, 29 bp, Homo sapiens
tcgctgcgatctattgaaagtcagccctc

SEQ ID NO: 56640 - DNA, 30 bp, Homo sapiens; identical to SEQ ID NO: 31091

SEQ ID NO: 56641 - DNA, 16 bp, Homo sapiens
cgctgcgatctattga

SEQ ID NO: 56642 - DNA, 17 bp, Homo sapiens
cgctgcgatctattgaa

SEQ ID NO: 56643 - DNA, 18 bp, Homo sapiens
cgctgcgatctattgaaa

SEQ ID NO: 56644 - DNA, 20 bp, Homo sapiens
cgctgcgatctattgaaagt

SEQ ID NO: 56645 - DNA, 21 bp, Homo sapiens
cgctgcgatctattgaaagtc

SEQ ID NO: 56646 - DNA, 29 bp, Homo sapiens
cgctgcgatctattgaaagtcagccctcg

SEQ ID NO: 56647 - DNA, 30 bp, Homo sapiens
cgctgcgatctattgaaagtcagccctcga

SEQ ID NO: 56648 - DNA, 20 bp, Homo sapiens
gctgcgatctattgaaagtc

SEQ ID NO: 56649 - DNA, 21 bp, Homo sapiens
gctgcgatctattgaaagtca

SEQ ID NO: 56650 - DNA, 23 bp, Homo sapiens
gctgcgatctattgaaagtcagc

SEQ ID NO: 56651 - DNA, 29 bp, Homo sapiens
gctgcgatctattgaaagtcagccctcga

SEQ ID NO: 56652 - DNA, 30 bp, Homo sapiens; identical to SEQ ID NO: 31093

SEQ ID NO: 56653 - DNA, 18 bp, Homo sapiens
ctgcgatctattgaaagt

SEQ ID NO: 56654 - DNA, 19 bp, Homo sapiens
ctgcgatctattgaaagtc

SEQ ID NO: 56655 - DNA, 26 bp, Homo sapiens
ctgcgatctattgaaagtcagccctc

SEQ ID NO: 56656 - DNA, 27 bp, Homo sapiens
ctgcgatctattgaaagtcagccctcg

SEQ ID NO: 56657 - DNA, 29 bp, Homo sapiens
ctgcgatctattgaaagtcagccctcgac

SEQ ID NO: 56658 - DNA, 30 bp, Homo sapiens
ctgcgatctattgaaagtcagccctcgaca

SEQ ID NO: 56659 - DNA, 29 bp, Homo sapiens
tgcgatctattgaaagtcagccctcgaca

SEQ ID NO: 56660 - DNA, 30 bp, Homo sapiens
tgcgatctattgaaagtcagccctcgacac

SEQ ID NO: 56661 - DNA, 20 bp, Homo sapiens
gcgatctattgaaagtcagc

SEQ ID NO: 56662 - DNA, 29 bp, Homo sapiens
gcgatctattgaaagtcagccctcgacac

SEQ ID NO: 56663 - DNA, 29 bp, Homo sapiens
cgatctattgaaagtcagccctcgacaca

SEQ ID NO: 56664 - DNA, 22 bp, Homo sapiens
gatctattgaaagtcagccctc

SEQ ID NO: 56665 - DNA, 23 bp, Homo sapiens
gatctattgaaagtcagccctcg

SEQ ID NO: 56666 - DNA, 30 bp, Homo sapiens; identical to SEQ ID NO: 31095

SEQ ID NO: 56667 - DNA, 30 bp, Homo sapiens
atctattgaaagtcagccctcgacacaagg

SEQ ID NO: 56668 - DNA, 30 bp, Homo sapiens
tctattgaaagtcagccctcgacacaaggg

SEQ ID NO: 56669 - DNA, 17 bp, Homo sapiens
ctattgaaagtcagccc

SEQ ID NO: 56670 - DNA, 20 bp, Homo sapiens
ctattgaaagtcagccctcg

SEQ ID NO: 56671 - DNA, 22 bp, Homo sapiens
ctattgaaagtcagccctcgac

SEQ ID NO: 56672 - DNA, 23 bp, Homo sapiens
ctattgaaagtcagccctcgaca

SEQ ID NO: 56673 - DNA, 25 bp, Homo sapiens
ctattgaaagtcagccctcgacaca

SEQ ID NO: 56674 - DNA, 30 bp, Homo sapiens; identical to SEQ ID NO: 31096

SEQ ID NO: 56675 - DNA, 30 bp, Homo sapiens; identical to SEQ ID NO: 28471

SEQ ID NO: 56676 - DNA, 18 bp, Homo sapiens
attgaaagtcagccctcg

SEQ ID NO: 56677 - DNA, 19 bp, Homo sapiens
attgaaagtcagccctcga

SEQ ID NO: 56678 - DNA, 20 bp, Homo sapiens
attgaaagtcagccctcgac

SEQ ID NO: 56679 - DNA, 30 bp, Homo sapiens
attgaaagtcagccctcgacacaagggttt

SEQ ID NO: 56680 - DNA, 30 bp, Homo sapiens; identical to SEQ ID NO: 6512

SEQ ID NO: 56681 - DNA, 16 bp, Homo sapiens
tgaaagtcagccctcg

SEQ ID NO: 56682 - DNA, 18 bp, Homo sapiens
tgaaagtcagccctcgac

SEQ ID NO: 56683 - DNA, 21 bp, Homo sapiens
tgaaagtcagccctcgacaca

SEQ ID NO: 56684 - DNA, 30 bp, Homo sapiens; identical to SEQ ID NO: 28488

SEQ ID NO: 56685 - DNA, 17 bp, Homo sapiens
gaaagtcagccctcgac

SEQ ID NO: 56686 - DNA, 19 bp, Homo sapiens
gaaagtcagccctcgacac

SEQ ID NO: 56687 - DNA, 20 bp, Homo sapiens
gaaagtcagccctcgacaca

SEQ ID NO: 56688 - DNA, 22 bp, Homo sapiens
gaaagtcagccctcgacacaag

SEQ ID NO: 56689 - DNA, 23 bp, Homo sapiens
gaaagtcagccctcgacacaagg

SEQ ID NO: 56690 - DNA, 27 bp, Homo sapiens
gaaagtcagccctcgacacaagggttt

SEQ ID NO: 56691 - DNA, 28 bp, Homo sapiens
gaaagtcagccctcgacacaagggtttg

SEQ ID NO: 56692 - DNA, 29 bp, Homo sapiens
gaaagtcagccctcgacacaagggtttgt

SEQ ID NO: 56693 - DNA, 21 bp, Homo sapiens
aaagtcagccctcgacacaag

SEQ ID NO: 56694 - DNA, 20 bp, Homo sapiens
aagtcagccctcgacacaag

SEQ ID NO: 56695 - DNA, 21 bp, Homo sapiens
aagtcagccctcgacacaagg

SEQ ID NO: 56696 - DNA, 27 bp, Homo sapiens
aagtcagccctcgacacaagggtttgt

SEQ ID NO: 56697 - DNA, 20 bp, Homo sapiens
agtcagccctcgacacaagg

SEQ ID NO: 56698 - DNA, 26 bp, Homo sapiens
agtcagccctcgacacaagggtttgt

SEQ ID NO: 56699 - DNA, 18 bp, Homo sapiens
gtcagccctcgacacaag

SEQ ID NO: 56700 - DNA, 19 bp, Homo sapiens
gtcagccctcgacacaagg

SEQ ID NO: 56701 - DNA, 20 bp, Homo sapiens
gtcagccctcgacacaaggg

SEQ ID NO: 56702 - DNA, 21 bp, Homo sapiens
gtcagccctcgacacaagggt

SEQ ID NO: 56703 - DNA, 22 bp, Homo sapiens
gtcagccctcgacacaagggtt

SEQ ID NO: 56704 - DNA, 24 bp, Homo sapiens
gtcagccctcgacacaagggtttg

SEQ ID NO: 56705 - DNA, 25 bp, Homo sapiens
gtcagccctcgacacaagggtttgt

SEQ ID NO: 56706 - DNA, 17 bp, Homo sapiens
tcagccctcgacacaag

SEQ ID NO: 56707 - DNA, 18 bp, Homo sapiens
tcagccctcgacacaagg

SEQ ID NO: 56708 - DNA, 23 bp, Homo sapiens
tcagccctcgacacaagggtttg

SEQ ID NO: 56709 - DNA, 24 bp, Homo sapiens
tcagccctcgacacaagggtttgt

SEQ ID NO: 56710 - DNA, 16 bp, Homo sapiens
cagccctcgacacaag

SEQ ID NO: 56711 - DNA, 17 bp, Homo sapiens
cagccctcgacacaagg

SEQ ID NO: 56712 - DNA, 21 bp, Homo sapiens
cagccctcgacacaagggttt

SEQ ID NO: 56713 - DNA, 22 bp, Homo sapiens
cagccctcgacacaagggtttg

SEQ ID NO: 56714 - DNA, 23 bp, Homo sapiens
cagccctcgacacaagggtttgt

SEQ ID NO: 56715 - DNA, 20 bp, Homo sapiens
agccctcgacacaagggttt

SEQ ID NO: 56716 - DNA, 21 bp, Homo sapiens
agccctcgacacaagggtttg

SEQ ID NO: 56717 - DNA, 22 bp, Homo sapiens
agccctcgacacaagggtttgt

SEQ ID NO: 56718 - DNA, 16 bp, Homo sapiens
gccctcgacacaaggg

SEQ ID NO: 56719 - DNA, 18 bp, Homo sapiens
gccctcgacacaagggtt

SEQ ID NO: 56720 - DNA, 19 bp, Homo sapiens
gccctcgacacaagggttt

SEQ ID NO: 56721 - DNA, 20 bp, Homo sapiens
gccctcgacacaagggtttg

SEQ ID NO: 56722 - DNA, 21 bp, Homo sapiens
gccctcgacacaagggtttgt

SEQ ID NO: 56723 - DNA, 22 bp, Homo sapiens
gccctcgacacaagggtttgtc

SEQ ID NO: 56724 - DNA, 23 bp, Homo sapiens
gccctcgacacaagggtttgtcc

SEQ ID NO: 56725 - DNA, 18 bp, Homo sapiens
ccctcgacacaagggttt

SEQ ID NO: 56726 - DNA, 19 bp, Homo sapiens
ccctcgacacaagggtttg

SEQ ID NO: 56727 - DNA, 20 bp, Homo sapiens
ccctcgacacaagggtttgt

SEQ ID NO: 56728 - DNA, 21 bp, Homo sapiens
ccctcgacacaagggtttgtc

SEQ ID NO: 56729 - DNA, 17 bp, Homo sapiens
cctcgacacaagggttt

SEQ ID NO: 56730 - DNA, 18 bp, Homo sapiens
cctcgacacaagggtttg

SEQ ID NO: 56731 - DNA, 19 bp, Homo sapiens
cctcgacacaagggtttgt

SEQ ID NO: 56732 - DNA, 20 bp, Homo sapiens
cctcgacacaagggtttgtc

SEQ ID NO: 56733 - DNA, 16 bp, Homo sapiens
ctcgacacaagggttt

SEQ ID NO: 56734 - DNA, 17 bp, Homo sapiens
ctcgacacaagggtttg

SEQ ID NO: 56735 - DNA, 18 bp, Homo sapiens
ctcgacacaagggtttgt

SEQ ID NO: 56736 - DNA, 19 bp, Homo sapiens
ctcgacacaagggtttgtc

SEQ ID NO: 56737 - DNA, 16 bp, Homo sapiens
tcgacacaagggtttg

SEQ ID NO: 56738 - DNA, 17 bp, Homo sapiens
tcgacacaagggtttgt

SEQ ID NO: 56739 - DNA, 16 bp, Homo sapiens
cgacacaagggtttgt

SEQ ID NO: 56740 - DNA, 19 bp, Homo sapiens
cgtcttcctccctcccggc

SEQ ID NO: 56741 - DNA, 18 bp, Homo sapiens
gcgggcgtggtggtgggg

SEQ ID NO: 56742 - DNA, 19 bp, Homo sapiens
gcgggcgtggtggtggggg

SEQ ID NO: 56743 - DNA, 17 bp, Homo sapiens
cgggcgtggtggtgggg

SEQ ID NO: 56744 - DNA, 18 bp, Homo sapiens
cgggcgtggtggtggggg

SEQ ID NO: 56745 - DNA, 17 bp, Homo sapiens
gtggtggtgggggtggg

SEQ ID NO: 56746 - DNA, 17 bp, Homo sapiens
gtggtgggggtgggggg

SEQ ID NO: 56747 - DNA, 18 bp, Homo sapiens
gtggtgggggtggggggg

SEQ ID NO: 56748 - DNA, 17 bp, Homo sapiens
tggtgggggtggggggg

SEQ ID NO: 56749 - DNA, 18 bp, Homo sapiens
tggtgggggtggggggga

SEQ ID NO: 56750 - DNA, 20 bp, Homo sapiens
gggacggggtccggggagcg

SEQ ID NO: 56751 - DNA, 22 bp, Homo sapiens
gtaggagtgcccgtcgggacga

SEQ ID NO: 56752 - DNA, 21 bp, Homo sapiens
taggagtgcccgtcgggacga

SEQ ID NO: 56753 - DNA, 23 bp, Homo sapiens
taggagtgcccgtcgggacgaac

SEQ ID NO: 56754 - DNA, 22 bp, Homo sapiens
agtgcccgtcgggacgaaccgc

SEQ ID NO: 56755 - DNA, 23 bp, Homo sapiens
agtgcccgtcgggacgaaccgca

SEQ ID NO: 56756 - DNA, 23 bp, Homo sapiens
agtgcccgtcgggacgagccgga

SEQ ID NO: 56757 - DNA, 22 bp, Homo sapiens
gtgcccgtcgggacgagccgga

SEQ ID NO: 56758 - DNA, 23 bp, Homo sapiens
gtgcccgtcgggacgagccggac

SEQ ID NO: 56759 - DNA, 23 bp, Homo sapiens
agtgcccgtcgggacgagccgga

SEQ ID NO: 56760 - DNA, 22 bp, Homo sapiens
gtgcccgtcgggacgagccgga

SEQ ID NO: 56761 - DNA, 23 bp, Homo sapiens
gtgcccgtcgggacgagccggac

SEQ ID NO: 56762 - DNA, 17 bp, Homo sapiens
ctggtctcgaactcctg

SEQ ID NO: 56763 - DNA, 20 bp, Homo sapiens
gaggaggaggaggaggacga

SEQ ID NO: 56764 - DNA, 21 bp, Homo sapiens
ggaggaggaggaggaggagga

SEQ ID NO: 56765 - DNA, 23 bp, Homo sapiens
gaggaggaggaggaggaggagga

SEQ ID NO: 56766 - DNA, 24 bp, Homo sapiens
ggaggaggaggaggaggaggagga

SEQ ID NO: 56767 - DNA, 25 bp, Homo sapiens
gaggaggaggaggaggaggaggagg

SEQ ID NO: 56768 - DNA, 24 bp, Homo sapiens
gaggaggaggaggaggaggaggag

SEQ ID NO: 56769 - DNA, 21 bp, Homo sapiens
ggaggaggaggaggaggagga

SEQ ID NO: 56770 - DNA, 23 bp, Homo sapiens
gaggaggaggaggaggaggagga

SEQ ID NO: 56771 - DNA, 24 bp, Homo sapiens
ggaggaggaggaggaggaggagga

SEQ ID NO: 56772 - DNA, 25 bp, Homo sapiens
gaggaggaggaggaggaggaggagg

SEQ ID NO: 56773 - DNA, 24 bp, Homo sapiens
gaggaggaggaggaggaggaggag

SEQ ID NO: 56774 - DNA, 21 bp, Homo sapiens
ggaggaggaggaggaggagga

SEQ ID NO: 56775 - DNA, 23 bp, Homo sapiens
gaggaggaggaggaggaggagga

SEQ ID NO: 56776 - DNA, 24 bp, Homo sapiens
ggaggaggaggaggaggaggagga

SEQ ID NO: 56777 - DNA, 25 bp, Homo sapiens
gaggaggaggaggaggaggaggagg

SEQ ID NO: 56778 - DNA, 24 bp, Homo sapiens
gaggaggaggaggaggaggaggag

SEQ ID NO: 56779 - DNA, 21 bp, Homo sapiens
ggaggaggaggaggaggagga

SEQ ID NO: 56780 - DNA, 23 bp, Homo sapiens
gaggaggaggaggaggaggagga

SEQ ID NO: 56781 - DNA, 24 bp, Homo sapiens
ggaggaggaggaggaggaggagga

SEQ ID NO: 56782 - DNA, 25 bp, Homo sapiens
gaggaggaggaggaggaggaggagg

SEQ ID NO: 56783 - DNA, 24 bp, Homo sapiens
gaggaggaggaggaggaggaggag

SEQ ID NO: 56784 - DNA, 21 bp, Homo sapiens
ggaggaggaggaggaggagga

SEQ ID NO: 56785 - DNA, 23 bp, Homo sapiens
gaggaggaggaggaggaggagga

SEQ ID NO: 56786 - DNA, 24 bp, Homo sapiens
ggaggaggaggaggaggaggagga

SEQ ID NO: 56787 - DNA, 25 bp, Homo sapiens
gaggaggaggaggaggaggaggagg

SEQ ID NO: 56788 - DNA, 24 bp, Homo sapiens
gaggaggaggaggaggaggaggag

SEQ ID NO: 56789 - DNA, 21 bp, Homo sapiens
ggaggaggaggaggaggagga

SEQ ID NO: 56790 - DNA, 23 bp, Homo sapiens
gaggaggaggaggaggaggagga

SEQ ID NO: 56791 - DNA, 24 bp, Homo sapiens
ggaggaggaggaggaggaggagga

SEQ ID NO: 56792 - DNA, 25 bp, Homo sapiens
gaggaggaggaggaggaggaggagg

SEQ ID NO: 56793 - DNA, 24 bp, Homo sapiens
gaggaggaggaggaggaggaggag

SEQ ID NO: 56794 - DNA, 21 bp, Homo sapiens
ggaggaggaggaggaggagga

SEQ ID NO: 56795 - DNA, 23 bp, Homo sapiens
gaggaggaggaggaggaggagga

SEQ ID NO: 56796 - DNA, 24 bp, Homo sapiens
ggaggaggaggaggaggaggagga

SEQ ID NO: 56797 - DNA, 25 bp, Homo sapiens
gaggaggaggaggaggaggaggagg

SEQ ID NO: 56798 - DNA, 24 bp, Homo sapiens
gaggaggaggaggaggaggaggag

SEQ ID NO: 56799 - DNA, 21 bp, Homo sapiens
ggaggaggaggaggaggagga

SEQ ID NO: 56800 - DNA, 23 bp, Homo sapiens
gaggaggaggaggaggaggagga

SEQ ID NO: 56801 - DNA, 24 bp, Homo sapiens
ggaggaggaggaggaggaggagga

SEQ ID NO: 56802 - DNA, 25 bp, Homo sapiens
gaggaggaggaggaggaggaggagg

SEQ ID NO: 56803 - DNA, 24 bp, Homo sapiens
gaggaggaggaggaggaggaggag

SEQ ID NO: 56804 - DNA, 21 bp, Homo sapiens
ggaggaggaggaggaggagga

SEQ ID NO: 56805 - DNA, 23 bp, Homo sapiens
gaggaggaggaggaggaggagga

SEQ ID NO: 56806 - DNA, 24 bp, Homo sapiens
ggaggaggaggaggaggaggagga

SEQ ID NO: 56807 - DNA, 25 bp, Homo sapiens
gaggaggaggaggaggaggaggagg

SEQ ID NO: 56808 - DNA, 24 bp, Homo sapiens
gaggaggaggaggaggaggaggag

SEQ ID NO: 56809 - DNA, 21 bp, Homo sapiens
ggaggaggaggaggaggagga

SEQ ID NO: 56810 - DNA, 23 bp, Homo sapiens
gaggaggaggaggaggaggagga

SEQ ID NO: 56811 - DNA, 16 bp, Homo sapiens
gggtggagggtggggc

SEQ ID NO: 56812 - DNA, 18 bp, Homo sapiens
ggtggtggtggtggtggt

SEQ ID NO: 56813 - DNA, 21 bp, Homo sapiens
gctggtctcgaactcctgacc

SEQ ID NO: 56814 - DNA, 17 bp, Homo sapiens
ctggtctcgaactcctg

SEQ ID NO: 56815 - DNA, 20 bp, Homo sapiens
ctggtctcgaactcctgacc

SEQ ID NO: 56816 - DNA, 17 bp, Homo sapiens
tggtctcgaactcctga

SEQ ID NO: 56817 - DNA, 20 bp, Homo sapiens
ctggtctcgaactcctgacc

SEQ ID NO: 56818 - DNA, 21 bp, Homo sapiens
gctggtctcgaactcctgacc

SEQ ID NO: 56819 - DNA, 17 bp, Homo sapiens
tggtctcgaactcctga

SEQ ID NO: 56820 - DNA, 17 bp, Homo sapiens
ctggtctcgaactcctg

SEQ ID NO: 56821 - DNA, 18 bp, Homo sapiens
cccacggcgcctgactcc

SEQ ID NO: 56822 - DNA, 19 bp, Homo sapiens
ccccacggcgcctgactcc

SEQ ID NO: 56823 - DNA, 20 bp, Homo sapiens
gccccacggcgcctgactcc

SEQ ID NO: 56824 - DNA, 22 bp, Homo sapiens
ctgccccacggcgcctgactcc

SEQ ID NO: 56825 - DNA, 21 bp, Homo sapiens
ctctctctctctctctccccc

SEQ ID NO: 56826 - DNA, 19 bp, Homo sapiens
ctctctctctctctccccc

SEQ ID NO: 56827 - DNA, 17 bp, Homo sapiens
ctctctctctctccccc

SEQ ID NO: 56828 - DNA, 16 bp, Homo sapiens
tctctctctctccccc

SEQ ID NO: 56829 - DNA, 24 bp, Homo sapiens
gtctacggccataccaccctgaac

SEQ ID NO: 56830 - DNA, 25 bp, Homo sapiens
gtctacggccataccaccctgaacg

SEQ ID NO: 56831 - DNA, 29 bp, Homo sapiens
gtctacggccataccaccctgaacgcgcc

SEQ ID NO: 56832 - DNA, 30 bp, Homo sapiens; identical to SEQ ID NO: 8

SEQ ID NO: 56833 - DNA, 31 bp, Homo sapiens; identical to SEQ ID NO: 9

SEQ ID NO: 56834 - DNA, 32 bp, Homo sapiens; identical to SEQ ID NO: 10

SEQ ID NO: 56835 - DNA, 33 bp, Homo sapiens; identical to SEQ ID NO: 11

SEQ ID NO: 56836 - DNA, 34 bp, Homo sapiens; identical to SEQ ID NO: 6542

SEQ ID NO: 56837 - DNA, 35 bp, Homo sapiens; identical to SEQ ID NO: 6543

SEQ ID NO: 56838 - DNA, 36 bp, Homo sapiens; identical to SEQ ID NO: 6544

SEQ ID NO: 56839 - DNA, 37 bp, Homo sapiens; identical to SEQ ID NO: 6545

SEQ ID NO: 56840 - DNA, 38 bp, Homo sapiens; identical to SEQ ID NO: 6546

SEQ ID NO: 56841 - DNA, 39 bp, Homo sapiens; identical to SEQ ID NO: 6547

SEQ ID NO: 56842 - DNA, 40 bp, Homo sapiens; identical to SEQ ID NO: 6548

SEQ ID NO: 56843 - DNA, 41 bp, Homo sapiens; identical to SEQ ID NO: 6549

SEQ ID NO: 56844 - DNA, 42 bp, Homo sapiens; identical to SEQ ID NO: 6550

SEQ ID NO: 56845 - DNA, 20 bp, Homo sapiens
accaccctgaacgcgcccga

SEQ ID NO: 56846 - DNA, 43 bp, Homo sapiens; identical to SEQ ID NO: 6904

SEQ ID NO: 56847 - DNA, 41 bp, Homo sapiens; identical to SEQ ID NO: 6918

SEQ ID NO: 56848 - DNA, 40 bp, Homo sapiens; identical to SEQ ID NO: 6929

SEQ ID NO: 56849 - DNA, 39 bp, Homo sapiens; identical to SEQ ID NO: 6934

SEQ ID NO: 56850 - DNA, 38 bp, Homo sapiens; identical to SEQ ID NO: 6936

SEQ ID NO: 56851 - DNA, 37 bp, Homo sapiens; identical to SEQ ID NO: 6942

SEQ ID NO: 56852 - DNA, 35 bp, Homo sapiens
gtcgggcctggttagtacttggatgggagaccgcc

SEQ ID NO: 56853 - DNA, 27 bp, Homo sapiens
tggttagtacttggatgggagaccgcc

SEQ ID NO: 56854 - DNA, 25 bp, Homo sapiens
gttagtacttggatgggagaccgcc

SEQ ID NO: 56855 - DNA, 24 bp, Homo sapiens
ttagtacttggatgggagaccgcc

SEQ ID NO: 56856 - DNA, 48 bp, Homo sapiens
tagtacttggatgggagaccgcctgggaataccgggtgctgtaggctt

SEQ ID NO: 56857 - DNA, 22 bp, Homo sapiens
agtacttggatgggagaccgcc

SEQ ID NO: 56858 - DNA, 47 bp, Homo sapiens; identical to SEQ ID NO: 6956

SEQ ID NO: 56859 - DNA, 48 bp, Homo sapiens
agtacttggatgggagaccgcctgggaataccgggtgctgtaggcttt

SEQ ID NO: 56860 - DNA, 21 bp, Homo sapiens
gtacttggatgggagaccgcc

SEQ ID NO: 56861 - DNA, 45 bp, Homo sapiens
gtacttggatgggagaccgcctgggaataccgggtgctgtaggct

SEQ ID NO: 56862 - DNA, 46 bp, Homo sapiens; identical to SEQ ID NO: 6963

SEQ ID NO: 56863 - DNA, 47 bp, Homo sapiens; identical to SEQ ID NO: 6964

SEQ ID NO: 56864 - DNA, 44 bp, Homo sapiens
tacttggatgggagaccgcctgggaataccgggtgctgtaggct

SEQ ID NO: 56865 - DNA, 45 bp, Homo sapiens; identical to SEQ ID NO: 6966

SEQ ID NO: 56866 - DNA, 46 bp, Homo sapiens; identical to SEQ ID NO: 6967

SEQ ID NO: 56867 - DNA, 19 bp, Homo sapiens
acttggatgggagaccgcc

SEQ ID NO: 56868 - DNA, 43 bp, Homo sapiens
acttggatgggagaccgcctgggaataccgggtgctgtaggct

SEQ ID NO: 56869 - DNA, 44 bp, Homo sapiens; identical to SEQ ID NO: 6971

SEQ ID NO: 56870 - DNA, 45 bp, Homo sapiens; identical to SEQ ID NO: 6972

SEQ ID NO: 56871 - DNA, 42 bp, Homo sapiens
cttggatgggagaccgcctgggaataccgggtgctgtaggct

SEQ ID NO: 56872 - DNA, 43 bp, Homo sapiens; identical to SEQ ID NO: 6981

SEQ ID NO: 56873 - DNA, 44 bp, Homo sapiens; identical to SEQ ID NO: 6982

SEQ ID NO: 56874 - DNA, 41 bp, Homo sapiens
ttggatgggagaccgcctgggaataccgggtgctgtaggct

SEQ ID NO: 56875 - DNA, 42 bp, Homo sapiens; identical to SEQ ID NO: 6988

SEQ ID NO: 56876 - DNA, 43 bp, Homo sapiens
ttggatgggagaccgcctgggaataccgggtgctgtaggcttt

SEQ ID NO: 56877 - DNA, 40 bp, Homo sapiens
tggatgggagaccgcctgggaataccgggtgctgtaggct

SEQ ID NO: 56878 - DNA, 41 bp, Homo sapiens
tggatgggagaccgcctgggaataccgggtgctgtaggctt

SEQ ID NO: 56879 - DNA, 42 bp, Homo sapiens
tggatgggagaccgcctgggaataccgggtgctgtaggcttt

SEQ ID NO: 56880 - DNA, 39 bp, Homo sapiens
ggatgggagaccgcctgggaataccgggtgctgtaggct

SEQ ID NO: 56881 - DNA, 40 bp, Homo sapiens; identical to SEQ ID NO: 6990

SEQ ID NO: 56882 - DNA, 41 bp, Homo sapiens
ggatgggagaccgcctgggaataccgggtgctgtaggcttt

SEQ ID NO: 56883 - DNA, 38 bp, Homo sapiens; identical to SEQ ID NO: 6991

SEQ ID NO: 56884 - DNA, 39 bp, Homo sapiens; identical to SEQ ID NO: 6992

SEQ ID NO: 56885 - DNA, 40 bp, Homo sapiens; identical to SEQ ID NO: 6993

SEQ ID NO: 56886 - DNA, 37 bp, Homo sapiens; identical to SEQ ID NO: 6995

SEQ ID NO: 56887 - DNA, 38 bp, Homo sapiens; identical to SEQ ID NO: 6996

SEQ ID NO: 56888 - DNA, 39 bp, Homo sapiens; identical to SEQ ID NO: 6997

SEQ ID NO: 56889 - DNA, 37 bp, Homo sapiens; identical to SEQ ID NO: 6999

SEQ ID NO: 56890 - DNA, 38 bp, Homo sapiens; identical to SEQ ID NO: 7000

SEQ ID NO: 56891 - DNA, 36 bp, Homo sapiens; identical to SEQ ID NO: 7002

SEQ ID NO: 56892 - DNA, 37 bp, Homo sapiens; identical to SEQ ID NO: 7003

SEQ ID NO: 56893 - DNA, 34 bp, Homo sapiens; identical to SEQ ID NO: 7004

SEQ ID NO: 56894 - DNA, 35 bp, Homo sapiens; identical to SEQ ID NO: 7005

SEQ ID NO: 56895 - DNA, 36 bp, Homo sapiens; identical to SEQ ID NO: 7006

SEQ ID NO: 56896 - DNA, 33 bp, Homo sapiens; identical to SEQ ID NO: 165

SEQ ID NO: 56897 - DNA, 34 bp, Homo sapiens; identical to SEQ ID NO: 7008

SEQ ID NO: 56898 - DNA, 35 bp, Homo sapiens
gagaccgcctgggaataccgggtgctgtaggcttt

SEQ ID NO: 56899 - DNA, 33 bp, Homo sapiens; identical to SEQ ID NO: 166

SEQ ID NO: 56900 - DNA, 34 bp, Homo sapiens
agaccgcctgggaataccgggtgctgtaggcttt

SEQ ID NO: 56901 - DNA, 32 bp, Homo sapiens; identical to SEQ ID NO: 167

SEQ ID NO: 56902 - DNA, 33 bp, Homo sapiens; identical to SEQ ID NO: 168

SEQ ID NO: 56903 - DNA, 30 bp, Homo sapiens; identical to SEQ ID NO: 7014

SEQ ID NO: 56904 - DNA, 31 bp, Homo sapiens; identical to SEQ ID NO: 169

SEQ ID NO: 56905 - DNA, 32 bp, Homo sapiens; identical to SEQ ID NO: 7016

SEQ ID NO: 56906 - DNA, 29 bp, Homo sapiens
ccgcctgggaataccgggtgctgtaggct

SEQ ID NO: 56907 - DNA, 30 bp, Homo sapiens; identical to SEQ ID NO: 171

SEQ ID NO: 56908 - DNA, 31 bp, Homo sapiens; identical to SEQ ID NO: 172

SEQ ID NO: 56909 - DNA, 29 bp, Homo sapiens
cgcctgggaataccgggtgctgtaggctt

SEQ ID NO: 56910 - DNA, 30 bp, Homo sapiens; identical to SEQ ID NO: 174

SEQ ID NO: 56911 - DNA, 28 bp, Homo sapiens
gcctgggaataccgggtgctgtaggctt

SEQ ID NO: 56912 - DNA, 29 bp, Homo sapiens
gcctgggaataccgggtgctgtaggcttt

SEQ ID NO: 56913 - DNA, 27 bp, Homo sapiens
cctgggaataccgggtgctgtaggctt

SEQ ID NO: 56914 - DNA, 28 bp, Homo sapiens
cctgggaataccgggtgctgtaggcttt

SEQ ID NO: 56915 - DNA, 25 bp, Homo sapiens
ctgggaataccgggtgctgtaggct

SEQ ID NO: 56916 - DNA, 26 bp, Homo sapiens
ctgggaataccgggtgctgtaggctt

SEQ ID NO: 56917 - DNA, 27 bp, Homo sapiens
ctgggaataccgggtgctgtaggcttt

SEQ ID NO: 56918 - DNA, 24 bp, Homo sapiens
tgggaataccgggtgctgtaggct

SEQ ID NO: 56919 - DNA, 25 bp, Homo sapiens
tgggaataccgggtgctgtaggctt

SEQ ID NO: 56920 - DNA, 26 bp, Homo sapiens
tgggaataccgggtgctgtaggcttt

SEQ ID NO: 56921 - DNA, 23 bp, Homo sapiens
gggaataccgggtgctgtaggct

SEQ ID NO: 56922 - DNA, 24 bp, Homo sapiens
gggaataccgggtgctgtaggctt

SEQ ID NO: 56923 - DNA, 25 bp, Homo sapiens
gggaataccgggtgctgtaggcttt

SEQ ID NO: 56924 - DNA, 22 bp, Homo sapiens
ggaataccgggtgctgtaggct

SEQ ID NO: 56925 - DNA, 23 bp, Homo sapiens
ggaataccgggtgctgtaggctt

SEQ ID NO: 56926 - DNA, 24 bp, Homo sapiens
ggaataccgggtgctgtaggcttt

SEQ ID NO: 56927 - DNA, 21 bp, Homo sapiens
gaataccgggtgctgtaggct

SEQ ID NO: 56928 - DNA, 22 bp, Homo sapiens
gaataccgggtgctgtaggctt

SEQ ID NO: 56929 - DNA, 23 bp, Homo sapiens
gaataccgggtgctgtaggcttt

SEQ ID NO: 56930 - DNA, 20 bp, Homo sapiens
aataccgggtgctgtaggct

SEQ ID NO: 56931 - DNA, 21 bp, Homo sapiens
aataccgggtgctgtaggctt

SEQ ID NO: 56932 - DNA, 22 bp, Homo sapiens
aataccgggtgctgtaggcttt

SEQ ID NO: 56933 - DNA, 19 bp, Homo sapiens
ataccgggtgctgtaggct

SEQ ID NO: 56934 - DNA, 20 bp, Homo sapiens
ataccgggtgctgtaggctt

SEQ ID NO: 56935 - DNA, 21 bp, Homo sapiens
ataccgggtgctgtaggcttt

SEQ ID NO: 56936 - DNA, 18 bp, Homo sapiens
taccgggtgctgtaggct

SEQ ID NO: 56937 - DNA, 19 bp, Homo sapiens
taccgggtgctgtaggctt

SEQ ID NO: 56938 - DNA, 20 bp, Homo sapiens
taccgggtgctgtaggcttt

SEQ ID NO: 56939 - DNA, 17 bp, Homo sapiens
accgggtgctgtaggct

SEQ ID NO: 56940 - DNA, 18 bp, Homo sapiens
accgggtgctgtaggctt

SEQ ID NO: 56941 - DNA, 19 bp, Homo sapiens
accgggtgctgtaggcttt

SEQ ID NO: 56942 - DNA, 16 bp, Homo sapiens
ccgggtgctgtaggct

SEQ ID NO: 56943 - DNA, 17 bp, Homo sapiens
ccgggtgctgtaggctt

SEQ ID NO: 56944 - DNA, 18 bp, Homo sapiens
ccgggtgctgtaggcttt

SEQ ID NO: 56945 - DNA, 16 bp, Homo sapiens
cgggtgctgtaggctt

SEQ ID NO: 56946 - DNA, 17 bp, Homo sapiens
cgggtgctgtaggcttt

SEQ ID NO: 56947 - DNA, 16 bp, Homo sapiens
gggtgctgtaggcttt

SEQ ID NO: 56948 - DNA, 32 bp, Homo sapiens; identical to SEQ ID NO: 215

SEQ ID NO: 56949 - DNA, 40 bp, Homo sapiens
ccccaataaagctaaaactcacctgagttgtaaaaaactc

SEQ ID NO: 56950 - DNA, 39 bp, Homo sapiens
cccaataaagctaaaactcacctgagttgtaaaaaactc

SEQ ID NO: 56951 - DNA, 21 bp, Homo sapiens
cacctgagttgtaaaaaactc

SEQ ID NO: 56952 - DNA, 20 bp, Homo sapiens
gctaaacctagccccaaacc

SEQ ID NO: 56953 - DNA, 21 bp, Homo sapiens
gctaaacctagccccaaaccc

SEQ ID NO: 56954 - DNA, 22 bp, Homo sapiens
gctaaacctagccccaaaccca

SEQ ID NO: 56955 - DNA, 23 bp, Homo sapiens
gctaaacctagccccaaacccac

SEQ ID NO: 56956 - DNA, 24 bp, Homo sapiens
gctaaacctagccccaaacccact

SEQ ID NO: 56957 - DNA, 37 bp, Homo sapiens; identical to SEQ ID NO: 8830

SEQ ID NO: 56958 - DNA, 38 bp, Homo sapiens; identical to SEQ ID NO: 8831

SEQ ID NO: 56959 - DNA, 45 bp, Homo sapiens; identical to SEQ ID NO: 8838

SEQ ID NO: 56960 - DNA, 46 bp, Homo sapiens
caaaccatttacccaaataaagtataggcgatagaaattgaaacct

SEQ ID NO: 56961 - DNA, 40 bp, Homo sapiens; identical to SEQ ID NO: 9011

SEQ ID NO: 56962 - DNA, 33 bp, Homo sapiens; identical to SEQ ID NO: 882

SEQ ID NO: 56963 - DNA, 27 bp, Homo sapiens
aagtataggcgatagaaattgaaacct

SEQ ID NO: 56964 - DNA, 23 bp, Homo sapiens
ataggcgatagaaattgaaacct

SEQ ID NO: 56965 - DNA, 18 bp, Homo sapiens
cgatagaaattgaaacct

SEQ ID NO: 56966 - DNA, 16 bp, Homo sapiens
aaaaatttcggttggg

SEQ ID NO: 56967 - DNA, 28 bp, Homo sapiens
cccgtaaatgatatcatctcaacttagt

SEQ ID NO: 56968 - DNA, 29 bp, Homo sapiens
cccgtaaatgatatcatctcaacttagta

SEQ ID NO: 56969 - DNA, 32 bp, Homo sapiens; identical to SEQ ID NO: 11788

SEQ ID NO: 56970 - DNA, 37 bp, Homo sapiens
cccgtaaatgatatcatctcaacttagtattataccc

SEQ ID NO: 56971 - DNA, 27 bp, Homo sapiens
ccgtaaatgatatcatctcaacttagt

SEQ ID NO: 56972 - DNA, 28 bp, Homo sapiens
ccgtaaatgatatcatctcaacttagta

SEQ ID NO: 56973 - DNA, 31 bp, Homo sapiens; identical to SEQ ID NO: 11792

SEQ ID NO: 56974 - DNA, 22 bp, Homo sapiens
cttcgtgatcgatgtggtgacg

SEQ ID NO: 56975 - DNA, 23 bp, Homo sapiens
cttcgtgatcgatgtggtgacgt

SEQ ID NO: 56976 - DNA, 24 bp, Homo sapiens
cttcgtgatcgatgtggtgacgtc

SEQ ID NO: 56977 - DNA, 29 bp, Homo sapiens
cttcgtgatcgatgtggtgacgtcgtgct

SEQ ID NO: 56978 - DNA, 31 bp, Homo sapiens; identical to SEQ ID NO: 1879

SEQ ID NO: 56979 - DNA, 36 bp, Homo sapiens; identical to SEQ ID NO: 11916

SEQ ID NO: 56980 - DNA, 37 bp, Homo sapiens; identical to SEQ ID NO: 11917

SEQ ID NO: 56981 - DNA, 42 bp, Homo sapiens; identical to SEQ ID NO: 11922

SEQ ID NO: 56982 - DNA, 21 bp, Homo sapiens
ttcgtgatcgatgtggtgacg

SEQ ID NO: 56983 - DNA, 19 bp, Homo sapiens
gatgtggtgacgtcgtgct

SEQ ID NO: 56984 - DNA, 21 bp, Homo sapiens
gatgtggtgacgtcgtgctct

SEQ ID NO: 56985 - DNA, 25 bp, Homo sapiens
gatgtggtgacgtcgtgctctcccg

SEQ ID NO: 56986 - DNA, 26 bp, Homo sapiens
gatgtggtgacgtcgtgctctcccgg

SEQ ID NO: 56987 - DNA, 27 bp, Homo sapiens
gatgtggtgacgtcgtgctctcccggg

SEQ ID NO: 56988 - DNA, 31 bp, Homo sapiens
gatgtggtgacgtcgtgctctcccgggccgg

SEQ ID NO: 56989 - DNA, 32 bp, Homo sapiens
gatgtggtgacgtcgtgctctcccgggccggg

SEQ ID NO: 56990 - DNA, 35 bp, Homo sapiens
gatgtggtgacgtcgtgctctcccgggccgggtcc

SEQ ID NO: 56991 - DNA, 36 bp, Homo sapiens
gatgtggtgacgtcgtgctctcccgggccgggtccg

SEQ ID NO: 56992 - DNA, 37 bp, Homo sapiens
gatgtggtgacgtcgtgctctcccgggccgggtccga

SEQ ID NO: 56993 - DNA, 38 bp, Homo sapiens
gatgtggtgacgtcgtgctctcccgggccgggtccgag

SEQ ID NO: 56994 - DNA, 42 bp, Homo sapiens
gatgtggtgacgtcgtgctctcccgggccgggtccgagccgc

SEQ ID NO: 56995 - DNA, 43 bp, Homo sapiens
gatgtggtgacgtcgtgctctcccgggccgggtccgagccgcg

SEQ ID NO: 56996 - DNA, 44 bp, Homo sapiens
gatgtggtgacgtcgtgctctcccgggccgggtccgagccgcga

SEQ ID NO: 56997 - DNA, 45 bp, Homo sapiens
gatgtggtgacgtcgtgctctcccgggccgggtccgagccgcgac

SEQ ID NO: 56998 - DNA, 46 bp, Homo sapiens
gatgtggtgacgtcgtgctctcccgggccgggtccgagccgcgacg

SEQ ID NO: 56999 - DNA, 51 bp, Homo sapiens
gatgtggtgacgtcgtgctctcccgggccgggtccgagccgcgacgggcga

SEQ ID NO: 57000 - DNA, 21 bp, Homo sapiens
ccccccgagcggctcaccggc

SEQ ID NO: 57001 - DNA, 16 bp, Homo sapiens
tacctggttgatcctg

SEQ ID NO: 57002 - DNA, 17 bp, Homo sapiens
tacctggttgatcctgc

SEQ ID NO: 57003 - DNA, 18 bp, Homo sapiens
tacctggttgatcctgcc

SEQ ID NO: 57004 - DNA, 19 bp, Homo sapiens
tacctggttgatcctgcca

SEQ ID NO: 57005 - DNA, 24 bp, Homo sapiens
tacctggttgatcctgccagtagc

SEQ ID NO: 57006 - DNA, 35 bp, Homo sapiens; identical to SEQ ID NO: 12071

SEQ ID NO: 57007 - DNA, 44 bp, Homo sapiens; identical to SEQ ID NO: 12079

SEQ ID NO: 57008 - DNA, 36 bp, Homo sapiens
gctcattaaatcagttatggttcctttggtcgctcg

SEQ ID NO: 57009 - DNA, 34 bp, Homo sapiens
tcattaaatcagttatggttcctttggtcgctcg

SEQ ID NO: 57010 - DNA, 32 bp, Homo sapiens; identical to SEQ ID NO: 1993

SEQ ID NO: 57011 - DNA, 29 bp, Homo sapiens
aaatcagttatggttcctttggtcgctcg

SEQ ID NO: 57012 - DNA, 30 bp, Homo sapiens; identical to SEQ ID NO: 1997

SEQ ID NO: 57013 - DNA, 31 bp, Homo sapiens; identical to SEQ ID NO: 1998

SEQ ID NO: 57014 - DNA, 32 bp, Homo sapiens; identical to SEQ ID NO: 1999

SEQ ID NO: 57015 - DNA, 24 bp, Homo sapiens
agttatggttcctttggtcgctcg

SEQ ID NO: 57016 - DNA, 26 bp, Homo sapiens
agttatggttcctttggtcgctcgct

SEQ ID NO: 57017 - DNA, 27 bp, Homo sapiens
agttatggttcctttggtcgctcgctc

SEQ ID NO: 57018 - DNA, 45 bp, Homo sapiens; identical to SEQ ID NO: 12466

SEQ ID NO: 57019 - DNA, 44 bp, Homo sapiens; identical to SEQ ID NO: 12474

SEQ ID NO: 57020 - DNA, 43 bp, Homo sapiens; identical to SEQ ID NO: 12482

SEQ ID NO: 57021 - DNA, 42 bp, Homo sapiens; identical to SEQ ID NO: 12493

SEQ ID NO: 57022 - DNA, 43 bp, Homo sapiens
cctacttggataactgtggtaattctagagctaatacatgccg

SEQ ID NO: 57023 - DNA, 44 bp, Homo sapiens
cctacttggataactgtggtaattctagagctaatacatgccga

SEQ ID NO: 57024 - DNA, 41 bp, Homo sapiens; identical to SEQ ID NO: 12502

SEQ ID NO: 57025 - DNA, 42 bp, Homo sapiens
ctacttggataactgtggtaattctagagctaatacatgccg

SEQ ID NO: 57026 - DNA, 43 bp, Homo sapiens
ctacttggataactgtggtaattctagagctaatacatgccga

SEQ ID NO: 57027 - DNA, 40 bp, Homo sapiens; identical to SEQ ID NO: 12511

SEQ ID NO: 57028 - DNA, 41 bp, Homo sapiens
tacttggataactgtggtaattctagagctaatacatgccg

SEQ ID NO: 57029 - DNA, 22 bp, Homo sapiens
cccggtcagcccctctccggcc

SEQ ID NO: 57030 - DNA, 25 bp, Homo sapiens
cccggtcagcccctctccggccccg

SEQ ID NO: 57031 - DNA, 20 bp, Homo sapiens
ccggtcagcccctctccggc

SEQ ID NO: 57032 - DNA, 21 bp, Homo sapiens
ccggtcagcccctctccggcc

SEQ ID NO: 57033 - DNA, 39 bp, Homo sapiens
ccggtcagcccctctccggccccggccggggggcgggcg

SEQ ID NO: 57034 - DNA, 19 bp, Homo sapiens
cggtcagcccctctccggc

SEQ ID NO: 57035 - DNA, 26 bp, Homo sapiens
gccccggccggggggcgggcgccggc

SEQ ID NO: 57036 - DNA, 41 bp, Homo sapiens
ggcggctttggtgactctagataacctcgggccgatcgcac

SEQ ID NO: 57037 - DNA, 39 bp, Homo sapiens
cggctttggtgactctagataacctcgggccgatcgcac

SEQ ID NO: 57038 - DNA, 38 bp, Homo sapiens; identical to SEQ ID NO: 12749

SEQ ID NO: 57039 - DNA, 39 bp, Homo sapiens; identical to SEQ ID NO: 12750

SEQ ID NO: 57040 - DNA, 40 bp, Homo sapiens
ggctttggtgactctagataacctcgggccgatcgcacgc

SEQ ID NO: 57041 - DNA, 41 bp, Homo sapiens; identical to SEQ ID NO: 12751

SEQ ID NO: 57042 - DNA, 42 bp, Homo sapiens
ggctttggtgactctagataacctcgggccgatcgcacgccc

SEQ ID NO: 57043 - DNA, 43 bp, Homo sapiens
ggctttggtgactctagataacctcgggccgatcgcacgcccc

SEQ ID NO: 57044 - DNA, 26 bp, Homo sapiens
gctttggtgactctagataacctcgg

SEQ ID NO: 57045 - DNA, 37 bp, Homo sapiens; identical to SEQ ID NO: 12761

SEQ ID NO: 57046 - DNA, 40 bp, Homo sapiens
gctttggtgactctagataacctcgggccgatcgcacgcc

SEQ ID NO: 57047 - DNA, 36 bp, Homo sapiens; identical to SEQ ID NO: 12767

SEQ ID NO: 57048 - DNA, 37 bp, Homo sapiens; identical to SEQ ID NO: 12768

SEQ ID NO: 57049 - DNA, 40 bp, Homo sapiens
ctttggtgactctagataacctcgggccgatcgcacgccc

SEQ ID NO: 57050 - DNA, 41 bp, Homo sapiens
ctttggtgactctagataacctcgggccgatcgcacgcccc

SEQ ID NO: 57051 - DNA, 35 bp, Homo sapiens
tttggtgactctagataacctcgggccgatcgcac

SEQ ID NO: 57052 - DNA, 27 bp, Homo sapiens
cactcccgacccggggaggtagtgacg

SEQ ID NO: 57053 - DNA, 28 bp, Homo sapiens
cactcccgacccggggaggtagtgacga

SEQ ID NO: 57054 - DNA, 26 bp, Homo sapiens
actcccgacccggggaggtagtgacg

SEQ ID NO: 57055 - DNA, 27 bp, Homo sapiens
actcccgacccggggaggtagtgacga

SEQ ID NO: 57056 - DNA, 23 bp, Homo sapiens
cccgacccggggaggtagtgacg

SEQ ID NO: 57057 - DNA, 24 bp, Homo sapiens
cccgacccggggaggtagtgacga

SEQ ID NO: 57058 - DNA, 20 bp, Homo sapiens
aaaaataacaatacaggact

SEQ ID NO: 57059 - DNA, 22 bp, Homo sapiens
aaaaataacaatacaggactct

SEQ ID NO: 57060 - DNA, 38 bp, Homo sapiens
aaaaataacaatacaggactctttcgaggccctgtaat

SEQ ID NO: 57061 - DNA, 18 bp, Homo sapiens
ctttcgaggccctgtaat

SEQ ID NO: 57062 - DNA, 17 bp, Homo sapiens
tttcgaggccctgtaat

SEQ ID NO: 57063 - DNA, 38 bp, Homo sapiens
ggaatgagtccactttaaatcctttaacgaggatccat

SEQ ID NO: 57064 - DNA, 28 bp, Homo sapiens
cactttaaatcctttaacgaggatccat

SEQ ID NO: 57065 - DNA, 31 bp, Homo sapiens
ggcgggcggtccgccgcgaggcgagccaccg

SEQ ID NO: 57066 - DNA, 18 bp, Homo sapiens
cccgcggggcccgaagcg

SEQ ID NO: 57067 - DNA, 20 bp, Homo sapiens
cccgcggggcccgaagcgtt

SEQ ID NO: 57068 - DNA, 44 bp, Homo sapiens
gaagcgtttactttgaaaaaattagagtgttcaaagcaggcccg

SEQ ID NO: 57069 - DNA, 36 bp, Homo sapiens; identical to SEQ ID NO: 13840

SEQ ID NO: 57070 - DNA, 35 bp, Homo sapiens; identical to SEQ ID NO: 13842

SEQ ID NO: 57071 - DNA, 33 bp, Homo sapiens; identical to SEQ ID NO: 13847

SEQ ID NO: 57072 - DNA, 29 bp, Homo sapiens
agccgcctggataccgcagctaggaataa

SEQ ID NO: 57073 - DNA, 28 bp, Homo sapiens
gccgcctggataccgcagctaggaataa

SEQ ID NO: 57074 - DNA, 27 bp, Homo sapiens
ccgcctggataccgcagctaggaataa

SEQ ID NO: 57075 - DNA, 26 bp, Homo sapiens
cgcctggataccgcagctaggaataa

SEQ ID NO: 57076 - DNA, 25 bp, Homo sapiens
gcctggataccgcagctaggaataa

SEQ ID NO: 57077 - DNA, 22 bp, Homo sapiens
tggataccgcagctaggaataa

SEQ ID NO: 57078 - DNA, 17 bp, Homo sapiens
accgcagctaggaataa

SEQ ID NO: 57079 - DNA, 16 bp, Homo sapiens
ccgcagctaggaataa

SEQ ID NO: 57080 - DNA, 31 bp, Homo sapiens; identical to SEQ ID NO: 2455

SEQ ID NO: 57081 - DNA, 30 bp, Homo sapiens; identical to SEQ ID NO: 13907

SEQ ID NO: 57082 - DNA, 27 bp, Homo sapiens
cggttctattttgttggttttcggaac

SEQ ID NO: 57083 - DNA, 26 bp, Homo sapiens
ggttctattttgttggttttcggaac

SEQ ID NO: 57084 - DNA, 16 bp, Homo sapiens
cggcgcaagacggacc

SEQ ID NO: 57085 - DNA, 28 bp, Homo sapiens
ttcattaatcaagaacgaaagtcggagg

SEQ ID NO: 57086 - DNA, 27 bp, Homo sapiens
acgaaagtcggaggttcgaagacgatc

SEQ ID NO: 57087 - DNA, 21 bp, Homo sapiens
cccgccgggcagcttccggga

SEQ ID NO: 57088 - DNA, 22 bp, Homo sapiens
cccgccgggcagcttccgggaa

SEQ ID NO: 57089 - DNA, 22 bp, Homo sapiens
accaggagtggagcctgcggct

SEQ ID NO: 57090 - DNA, 39 bp, Homo sapiens; identical to SEQ ID NO: 15530

SEQ ID NO: 57091 - DNA, 40 bp, Homo sapiens; identical to SEQ ID NO: 15531

SEQ ID NO: 57092 - DNA, 54 bp, Homo sapiens
ggttaattccgataacgaacgagactctggcatgctaactagttacgcgacccc

SEQ ID NO: 57093 - DNA, 41 bp, Homo sapiens; identical to SEQ ID NO: 15765

SEQ ID NO: 57094 - DNA, 40 bp, Homo sapiens; identical to SEQ ID NO: 15795

SEQ ID NO: 57095 - DNA, 41 bp, Homo sapiens; identical to SEQ ID NO: 15796

SEQ ID NO: 57096 - DNA, 39 bp, Homo sapiens; identical to SEQ ID NO: 15825

SEQ ID NO: 57097 - DNA, 38 bp, Homo sapiens; identical to SEQ ID NO: 15852

SEQ ID NO: 57098 - DNA, 30 bp, Homo sapiens; identical to SEQ ID NO: 3180

SEQ ID NO: 57099 - DNA, 32 bp, Homo sapiens; identical to SEQ ID NO: 3182

SEQ ID NO: 57100 - DNA, 37 bp, Homo sapiens; identical to SEQ ID NO: 15879

SEQ ID NO: 57101 - DNA, 36 bp, Homo sapiens; identical to SEQ ID NO: 15907

SEQ ID NO: 57102 - DNA, 34 bp, Homo sapiens
gagactctggcatgctaactagttacgcgacccc

SEQ ID NO: 57103 - DNA, 16 bp, Homo sapiens
gagcggtcggcgtccc

SEQ ID NO: 57104 - DNA, 37 bp, Homo sapiens
ttagtgaggccctcggatcggccccgccggggtcggc

SEQ ID NO: 57105 - DNA, 28 bp, Homo sapiens
ccctcggatcggccccgccggggtcggc

SEQ ID NO: 57106 - DNA, 24 bp, Homo sapiens
cctcggatcggccccgccggggtc

SEQ ID NO: 57107 - DNA, 25 bp, Homo sapiens
cctcggatcggccccgccggggtcg

SEQ ID NO: 57108 - DNA, 27 bp, Homo sapiens
cctcggatcggccccgccggggtcggc

SEQ ID NO: 57109 - DNA, 21 bp, Homo sapiens
ctcggatcggccccgccgggg

SEQ ID NO: 57110 - DNA, 22 bp, Homo sapiens
ctcggatcggccccgccggggt

SEQ ID NO: 57111 - DNA, 23 bp, Homo sapiens
ctcggatcggccccgccggggtc

SEQ ID NO: 57112 - DNA, 26 bp, Homo sapiens
ctcggatcggccccgccggggtcggc

SEQ ID NO: 57113 - DNA, 27 bp, Homo sapiens
ctcggatcggccccgccggggtcggcc

SEQ ID NO: 57114 - DNA, 25 bp, Homo sapiens
tcggatcggccccgccggggtcggc

SEQ ID NO: 57115 - DNA, 24 bp, Homo sapiens
cggatcggccccgccggggtcggc

SEQ ID NO: 57116 - DNA, 19 bp, Homo sapiens
cggccccgccggggtcggc

SEQ ID NO: 57117 - DNA, 18 bp, Homo sapiens
ggccccgccggggtcggc

SEQ ID NO: 57118 - DNA, 17 bp, Homo sapiens
gccccgccggggtcggc

SEQ ID NO: 57119 - DNA, 18 bp, Homo sapiens
gccccgccggggtcggcc

SEQ ID NO: 57120 - DNA, 18 bp, Homo sapiens
ccccgccggggtcggccc

SEQ ID NO: 57121 - DNA, 17 bp, Homo sapiens
cccgccggggtcggccc

SEQ ID NO: 57122 - DNA, 17 bp, Homo sapiens
cacggccctggcggagc

SEQ ID NO: 57123 - DNA, 16 bp, Homo sapiens
acggccctggcggagc

SEQ ID NO: 57124 - DNA, 17 bp, Homo sapiens
acggccctggcggagcg

SEQ ID NO: 57125 - DNA, 18 bp, Homo sapiens
acggccctggcggagcgc

SEQ ID NO: 57126 - DNA, 19 bp, Homo sapiens
acggccctggcggagcgct

SEQ ID NO: 57127 - DNA, 25 bp, Homo sapiens
acggccctggcggagcgctgagaag

SEQ ID NO: 57128 - DNA, 26 bp, Homo sapiens
acggccctggcggagcgctgagaaga

SEQ ID NO: 57129 - DNA, 28 bp, Homo sapiens
acggccctggcggagcgctgagaagacg

SEQ ID NO: 57130 - DNA, 36 bp, Homo sapiens; identical to SEQ ID NO: 16977

SEQ ID NO: 57131 - DNA, 38 bp, Homo sapiens
acggccctggcggagcgctgagaagacggtcgaacttg

SEQ ID NO: 57132 - DNA, 39 bp, Homo sapiens; identical to SEQ ID NO: 16978

SEQ ID NO: 57133 - DNA, 40 bp, Homo sapiens; identical to SEQ ID NO: 16979

SEQ ID NO: 57134 - DNA, 41 bp, Homo sapiens; identical to SEQ ID NO: 16980

SEQ ID NO: 57135 - DNA, 42 bp, Homo sapiens; identical to SEQ ID NO: 16981

SEQ ID NO: 57136 - DNA, 44 bp, Homo sapiens; identical to SEQ ID NO: 16983

SEQ ID NO: 57137 - DNA, 45 bp, Homo sapiens; identical to SEQ ID NO: 16984

SEQ ID NO: 57138 - DNA, 47 bp, Homo sapiens; identical to SEQ ID NO: 16985

SEQ ID NO: 57139 - DNA, 17 bp, Homo sapiens
cggccctggcggagcgc

SEQ ID NO: 57140 - DNA, 30 bp, Homo sapiens; identical to SEQ ID NO: 16998

SEQ ID NO: 57141 - DNA, 40 bp, Homo sapiens; identical to SEQ ID NO: 17002

SEQ ID NO: 57142 - DNA, 41 bp, Homo sapiens; identical to SEQ ID NO: 17003

SEQ ID NO: 57143 - DNA, 43 bp, Homo sapiens; identical to SEQ ID NO: 17005

SEQ ID NO: 57144 - DNA, 29 bp, Homo sapiens
ggccctggcggagcgctgagaagacggtc

SEQ ID NO: 57145 - DNA, 37 bp, Homo sapiens
ggccctggcggagcgctgagaagacggtcgaacttga

SEQ ID NO: 57146 - DNA, 39 bp, Homo sapiens; identical to SEQ ID NO: 17015

SEQ ID NO: 57147 - DNA, 43 bp, Homo sapiens; identical to SEQ ID NO: 17016

SEQ ID NO: 57148 - DNA, 36 bp, Homo sapiens
gccctggcggagcgctgagaagacggtcgaacttga

SEQ ID NO: 57149 - DNA, 38 bp, Homo sapiens
gccctggcggagcgctgagaagacggtcgaacttgact

SEQ ID NO: 57150 - DNA, 42 bp, Homo sapiens
gccctggcggagcgctgagaagacggtcgaacttgactatct

SEQ ID NO: 57151 - DNA, 26 bp, Homo sapiens
agcgctgagaagacggtcgaacttga

SEQ ID NO: 57152 - DNA, 32 bp, Homo sapiens; identical to SEQ ID NO: 3464

SEQ ID NO: 57153 - DNA, 34 bp, Homo sapiens
agcgctgagaagacggtcgaacttgactatctag

SEQ ID NO: 57154 - DNA, 25 bp, Homo sapiens
gcgctgagaagacggtcgaacttga

SEQ ID NO: 57155 - DNA, 31 bp, Homo sapiens; identical to SEQ ID NO: 3465

SEQ ID NO: 57156 - DNA, 34 bp, Homo sapiens
gcgctgagaagacggtcgaacttgactatctaga

SEQ ID NO: 57157 - DNA, 35 bp, Homo sapiens
gcgctgagaagacggtcgaacttgactatctagag

SEQ ID NO: 57158 - DNA, 29 bp, Homo sapiens
cgctgagaagacggtcgaacttgactatc

SEQ ID NO: 57159 - DNA, 26 bp, Homo sapiens
gctgagaagacggtcgaacttgacta

SEQ ID NO: 57160 - DNA, 28 bp, Homo sapiens
gctgagaagacggtcgaacttgactatc

SEQ ID NO: 57161 - DNA, 29 bp, Homo sapiens
gctgagaagacggtcgaacttgactatct

SEQ ID NO: 57162 - DNA, 31 bp, Homo sapiens; identical to SEQ ID NO: 17079

SEQ ID NO: 57163 - DNA, 30 bp, Homo sapiens; identical to SEQ ID NO: 3481

SEQ ID NO: 57164 - DNA, 26 bp, Homo sapiens
gagaagacggtcgaacttgactatct

SEQ ID NO: 57165 - DNA, 28 bp, Homo sapiens
gagaagacggtcgaacttgactatctag

SEQ ID NO: 57166 - DNA, 27 bp, Homo sapiens
agaagacggtcgaacttgactatctag

SEQ ID NO: 57167 - DNA, 50 bp, Homo sapiens
gtaaaagtcgtaacaaggtttccgtaggtgaacctgcggaaggatcatta

SEQ ID NO: 57168 - DNA, 49 bp, Homo sapiens
taaaagtcgtaacaaggtttccgtaggtgaacctgcggaaggatcatta

SEQ ID NO: 57169 - DNA, 48 bp, Homo sapiens
aaaagtcgtaacaaggtttccgtaggtgaacctgcggaaggatcatta

SEQ ID NO: 57170 - DNA, 44 bp, Homo sapiens
gtcgtaacaaggtttccgtaggtgaacctgcggaaggatcatta

SEQ ID NO: 57171 - DNA, 43 bp, Homo sapiens
tcgtaacaaggtttccgtaggtgaacctgcggaaggatcatta

SEQ ID NO: 57172 - DNA, 42 bp, Homo sapiens
cgtaacaaggtttccgtaggtgaacctgcggaaggatcatta

SEQ ID NO: 57173 - DNA, 39 bp, Homo sapiens
gtaacaaggtttccgtaggtgaacctgcggaaggatcat

SEQ ID NO: 57174 - DNA, 40 bp, Homo sapiens
gtaacaaggtttccgtaggtgaacctgcggaaggatcatt

SEQ ID NO: 57175 - DNA, 41 bp, Homo sapiens
gtaacaaggtttccgtaggtgaacctgcggaaggatcatta

SEQ ID NO: 57176 - DNA, 43 bp, Homo sapiens
gtaacaaggtttccgtaggtgaacctgcggaaggatcattaac

SEQ ID NO: 57177 - DNA, 40 bp, Homo sapiens
taacaaggtttccgtaggtgaacctgcggaaggatcatta

SEQ ID NO: 57178 - DNA, 39 bp, Homo sapiens
aacaaggtttccgtaggtgaacctgcggaaggatcatta

SEQ ID NO: 57179 - DNA, 38 bp, Homo sapiens
acaaggtttccgtaggtgaacctgcggaaggatcatta

SEQ ID NO: 57180 - DNA, 36 bp, Homo sapiens
aaggtttccgtaggtgaacctgcggaaggatcatta

SEQ ID NO: 57181 - DNA, 35 bp, Homo sapiens
aggtttccgtaggtgaacctgcggaaggatcatta

SEQ ID NO: 57182 - DNA, 33 bp, Homo sapiens; identical to SEQ ID NO: 17216

SEQ ID NO: 57183 - DNA, 32 bp, Homo sapiens; identical to SEQ ID NO: 3525

SEQ ID NO: 57184 - DNA, 29 bp, Homo sapiens
ccgtaggtgaacctgcggaaggatcatta

SEQ ID NO: 57185 - DNA, 28 bp, Homo sapiens
cgtaggtgaacctgcggaaggatcatta

SEQ ID NO: 57186 - DNA, 27 bp, Homo sapiens
gtaggtgaacctgcggaaggatcatta

SEQ ID NO: 57187 - DNA, 26 bp, Homo sapiens
taggtgaacctgcggaaggatcatta

SEQ ID NO: 57188 - DNA, 24 bp, Homo sapiens
ggtgaacctgcggaaggatcatta

SEQ ID NO: 57189 - DNA, 17 bp, Homo sapiens
ctgcggaaggatcatta

SEQ ID NO: 57190 - DNA, 16 bp, Homo sapiens
tgcggaaggatcatta

SEQ ID NO: 57191 - DNA, 19 bp, Homo sapiens
gaaggatcattaacggagc

SEQ ID NO: 57192 - DNA, 17 bp, Homo sapiens
cccggcggccgtcgcgc

SEQ ID NO: 57193 - DNA, 20 bp, Homo sapiens
cccggcggccgtcgcgcgcc

SEQ ID NO: 57194 - DNA, 43 bp, Homo sapiens; identical to SEQ ID NO: 17297

SEQ ID NO: 57195 - DNA, 42 bp, Homo sapiens; identical to SEQ ID NO: 17298

SEQ ID NO: 57196 - DNA, 41 bp, Homo sapiens; identical to SEQ ID NO: 17300

SEQ ID NO: 57197 - DNA, 40 bp, Homo sapiens; identical to SEQ ID NO: 17303

SEQ ID NO: 57198 - DNA, 17 bp, Homo sapiens
ctcgtacgactcttagc

SEQ ID NO: 57199 - DNA, 18 bp, Homo sapiens
ctcgtacgactcttagcg

SEQ ID NO: 57200 - DNA, 19 bp, Homo sapiens
ctcgtacgactcttagcgg

SEQ ID NO: 57201 - DNA, 39 bp, Homo sapiens; identical to SEQ ID NO: 17317

SEQ ID NO: 57202 - DNA, 16 bp, Homo sapiens
tcgtacgactcttagc

SEQ ID NO: 57203 - DNA, 17 bp, Homo sapiens
tcgtacgactcttagcg

SEQ ID NO: 57204 - DNA, 18 bp, Homo sapiens
tcgtacgactcttagcgg

SEQ ID NO: 57205 - DNA, 36 bp, Homo sapiens; identical to SEQ ID NO: 17332

SEQ ID NO: 57206 - DNA, 38 bp, Homo sapiens; identical to SEQ ID NO: 17334

SEQ ID NO: 57207 - DNA, 40 bp, Homo sapiens
tcgtacgactcttagcggtggatcactcggctcgtgcgtc

SEQ ID NO: 57208 - DNA, 42 bp, Homo sapiens
tcgtacgactcttagcggtggatcactcggctcgtgcgtcga

SEQ ID NO: 57209 - DNA, 17 bp, Homo sapiens
cgtacgactcttagcgg

SEQ ID NO: 57210 - DNA, 35 bp, Homo sapiens; identical to SEQ ID NO: 17346

SEQ ID NO: 57211 - DNA, 37 bp, Homo sapiens; identical to SEQ ID NO: 17348

SEQ ID NO: 57212 - DNA, 16 bp, Homo sapiens
gtacgactcttagcgg

SEQ ID NO: 57213 - DNA, 36 bp, Homo sapiens
gtacgactcttagcggtggatcactcggctcgtgcg

SEQ ID NO: 57214 - DNA, 17 bp, Homo sapiens
cgactcttagcggtgga

SEQ ID NO: 57215 - DNA, 19 bp, Homo sapiens
cgactcttagcggtggatc

SEQ ID NO: 57216 - DNA, 22 bp, Homo sapiens
cgactcttagcggtggatcact

SEQ ID NO: 57217 - DNA, 26 bp, Homo sapiens
cgactcttagcggtggatcactcggc

SEQ ID NO: 57218 - DNA, 27 bp, Homo sapiens
cgactcttagcggtggatcactcggct

SEQ ID NO: 57219 - DNA, 28 bp, Homo sapiens
cgactcttagcggtggatcactcggctc

SEQ ID NO: 57220 - DNA, 29 bp, Homo sapiens
cgactcttagcggtggatcactcggctcg

SEQ ID NO: 57221 - DNA, 30 bp, Homo sapiens; identical to SEQ ID NO: 3579

SEQ ID NO: 57222 - DNA, 31 bp, Homo sapiens; identical to SEQ ID NO: 3580

SEQ ID NO: 57223 - DNA, 32 bp, Homo sapiens; identical to SEQ ID NO: 3581

SEQ ID NO: 57224 - DNA, 33 bp, Homo sapiens; identical to SEQ ID NO: 3582

SEQ ID NO: 57225 - DNA, 34 bp, Homo sapiens; identical to SEQ ID NO: 17395

SEQ ID NO: 57226 - DNA, 35 bp, Homo sapiens; identical to SEQ ID NO: 17396

SEQ ID NO: 57227 - DNA, 36 bp, Homo sapiens; identical to SEQ ID NO: 17397

SEQ ID NO: 57228 - DNA, 37 bp, Homo sapiens; identical to SEQ ID NO: 17398

SEQ ID NO: 57229 - DNA, 38 bp, Homo sapiens; identical to SEQ ID NO: 17399

SEQ ID NO: 57230 - DNA, 39 bp, Homo sapiens; identical to SEQ ID NO: 17400

SEQ ID NO: 57231 - DNA, 17 bp, Homo sapiens
gactcttagcggtggat

SEQ ID NO: 57232 - DNA, 25 bp, Homo sapiens
gactcttagcggtggatcactcggc

SEQ ID NO: 57233 - DNA, 26 bp, Homo sapiens
gactcttagcggtggatcactcggct

SEQ ID NO: 57234 - DNA, 30 bp, Homo sapiens; identical to SEQ ID NO: 3590

SEQ ID NO: 57235 - DNA, 32 bp, Homo sapiens; identical to SEQ ID NO: 3591

SEQ ID NO: 57236 - DNA, 36 bp, Homo sapiens; identical to SEQ ID NO: 17422

SEQ ID NO: 57237 - DNA, 27 bp, Homo sapiens
cggtggatcactcggctcgtgcgtcga

SEQ ID NO: 57238 - DNA, 28 bp, Homo sapiens
cggtggatcactcggctcgtgcgtcgat

SEQ ID NO: 57239 - DNA, 42 bp, Homo sapiens
aagaacgcagctagctgcgagaattaatgtgaattgcaggac

SEQ ID NO: 57240 - DNA, 43 bp, Homo sapiens
aagaacgcagctagctgcgagaattaatgtgaattgcaggaca

SEQ ID NO: 57241 - DNA, 36 bp, Homo sapiens; identical to SEQ ID NO: 17525

SEQ ID NO: 57242 - DNA, 37 bp, Homo sapiens; identical to SEQ ID NO: 17526

SEQ ID NO: 57243 - DNA, 27 bp, Homo sapiens
tgcgagaattaatgtgaattgcaggac

SEQ ID NO: 57244 - DNA, 26 bp, Homo sapiens
gcgagaattaatgtgaattgcaggac

SEQ ID NO: 57245 - DNA, 25 bp, Homo sapiens
cgagaattaatgtgaattgcaggac

SEQ ID NO: 57246 - DNA, 26 bp, Homo sapiens
cgagaattaatgtgaattgcaggaca

SEQ ID NO: 57247 - DNA, 24 bp, Homo sapiens
gagaattaatgtgaattgcaggac

SEQ ID NO: 57248 - DNA, 23 bp, Homo sapiens
agaattaatgtgaattgcaggac

SEQ ID NO: 57249 - DNA, 24 bp, Homo sapiens
agaattaatgtgaattgcaggaca

SEQ ID NO: 57250 - DNA, 23 bp, Homo sapiens
gaattaatgtgaattgcaggaca

SEQ ID NO: 57251 - DNA, 21 bp, Homo sapiens
aattaatgtgaattgcaggac

SEQ ID NO: 57252 - DNA, 22 bp, Homo sapiens
aattaatgtgaattgcaggaca

SEQ ID NO: 57253 - DNA, 24 bp, Homo sapiens
aattaatgtgaattgcaggacaca

SEQ ID NO: 57254 - DNA, 21 bp, Homo sapiens
attaatgtgaattgcaggaca

SEQ ID NO: 57255 - DNA, 20 bp, Homo sapiens
ttaatgtgaattgcaggaca

SEQ ID NO: 57256 - DNA, 19 bp, Homo sapiens
taatgtgaattgcaggaca

SEQ ID NO: 57257 - DNA, 21 bp, Homo sapiens
taatgtgaattgcaggacaca

SEQ ID NO: 57258 - DNA, 18 bp, Homo sapiens
aatgtgaattgcaggaca

SEQ ID NO: 57259 - DNA, 17 bp, Homo sapiens
atgtgaattgcaggaca

SEQ ID NO: 57260 - DNA, 43 bp, Homo sapiens; identical to SEQ ID NO: 17742

SEQ ID NO: 57261 - DNA, 44 bp, Homo sapiens; identical to SEQ ID NO: 17743

SEQ ID NO: 57262 - DNA, 41 bp, Homo sapiens; identical to SEQ ID NO: 17760

SEQ ID NO: 57263 - DNA, 42 bp, Homo sapiens; identical to SEQ ID NO: 17761

SEQ ID NO: 57264 - DNA, 43 bp, Homo sapiens; identical to SEQ ID NO: 17762

SEQ ID NO: 57265 - DNA, 40 bp, Homo sapiens; identical to SEQ ID NO: 17778

SEQ ID NO: 57266 - DNA, 41 bp, Homo sapiens; identical to SEQ ID NO: 17779

SEQ ID NO: 57267 - DNA, 42 bp, Homo sapiens; identical to SEQ ID NO: 17780

SEQ ID NO: 57268 - DNA, 39 bp, Homo sapiens; identical to SEQ ID NO: 17793

SEQ ID NO: 57269 - DNA, 40 bp, Homo sapiens; identical to SEQ ID NO: 17794

SEQ ID NO: 57270 - DNA, 41 bp, Homo sapiens; identical to SEQ ID NO: 17795

SEQ ID NO: 57271 - DNA, 42 bp, Homo sapiens; identical to SEQ ID NO: 17796

SEQ ID NO: 57272 - DNA, 73 bp, Homo sapiens
attgatcatcgacacttcgaacgcacttgcggccccgggttcctcccggggctacgcctgtctgagcgtcgct

SEQ ID NO: 57273 - DNA, 34 bp, Homo sapiens; identical to SEQ ID NO: 17839

SEQ ID NO: 57274 - DNA, 30 bp, Homo sapiens; identical to SEQ ID NO: 3706

SEQ ID NO: 57275 - DNA, 31 bp, Homo sapiens; identical to SEQ ID NO: 3707

SEQ ID NO: 57276 - DNA, 54 bp, Homo sapiens
aacgcacttgcggccccgggttcctcccggggctacgcctgtctgagcgtcgct

SEQ ID NO: 57277 - DNA, 53 bp, Homo sapiens
acgcacttgcggccccgggttcctcccggggctacgcctgtctgagcgtcgct

SEQ ID NO: 57278 - DNA, 52 bp, Homo sapiens
cgcacttgcggccccgggttcctcccggggctacgcctgtctgagcgtcgct

SEQ ID NO: 57279 - DNA, 51 bp, Homo sapiens
gcacttgcggccccgggttcctcccggggctacgcctgtctgagcgtcgct

SEQ ID NO: 57280 - DNA, 50 bp, Homo sapiens
cacttgcggccccgggttcctcccggggctacgcctgtctgagcgtcgct

SEQ ID NO: 57281 - DNA, 49 bp, Homo sapiens
acttgcggccccgggttcctcccggggctacgcctgtctgagcgtcgct

SEQ ID NO: 57282 - DNA, 50 bp, Homo sapiens
acttgcggccccgggttcctcccggggctacgcctgtctgagcgtcgctt

SEQ ID NO: 57283 - DNA, 48 bp, Homo sapiens
cttgcggccccgggttcctcccggggctacgcctgtctgagcgtcgct

SEQ ID NO: 57284 - DNA, 49 bp, Homo sapiens
cttgcggccccgggttcctcccggggctacgcctgtctgagcgtcgctt

SEQ ID NO: 57285 - DNA, 47 bp, Homo sapiens; identical to SEQ ID NO: 17967

SEQ ID NO: 57286 - DNA, 48 bp, Homo sapiens
ttgcggccccgggttcctcccggggctacgcctgtctgagcgtcgctt

SEQ ID NO: 57287 - DNA, 46 bp, Homo sapiens; identical to SEQ ID NO: 17968

SEQ ID NO: 57288 - DNA, 47 bp, Homo sapiens
tgcggccccgggttcctcccggggctacgcctgtctgagcgtcgctt

SEQ ID NO: 57289 - DNA, 45 bp, Homo sapiens; identical to SEQ ID NO: 17969

SEQ ID NO: 57290 - DNA, 46 bp, Homo sapiens
gcggccccgggttcctcccggggctacgcctgtctgagcgtcgctt

SEQ ID NO: 57291 - DNA, 44 bp, Homo sapiens; identical to SEQ ID NO: 17970

SEQ ID NO: 57292 - DNA, 40 bp, Homo sapiens
cccgggttcctcccggggctacgcctgtctgagcgtcgct

SEQ ID NO: 57293 - DNA, 41 bp, Homo sapiens
cccgggttcctcccggggctacgcctgtctgagcgtcgctt

SEQ ID NO: 57294 - DNA, 39 bp, Homo sapiens
ccgggttcctcccggggctacgcctgtctgagcgtcgct

SEQ ID NO: 57295 - DNA, 38 bp, Homo sapiens
cgggttcctcccggggctacgcctgtctgagcgtcgct

SEQ ID NO: 57296 - DNA, 36 bp, Homo sapiens; identical to SEQ ID NO: 17981

SEQ ID NO: 57297 - DNA, 35 bp, Homo sapiens; identical to SEQ ID NO: 17987

SEQ ID NO: 57298 - DNA, 34 bp, Homo sapiens; identical to SEQ ID NO: 17993

SEQ ID NO: 57299 - DNA, 33 bp, Homo sapiens; identical to SEQ ID NO: 3741

SEQ ID NO: 57300 - DNA, 34 bp, Homo sapiens; identical to SEQ ID NO: 18002

SEQ ID NO: 57301 - DNA, 32 bp, Homo sapiens; identical to SEQ ID NO: 3743

SEQ ID NO: 57302 - DNA, 31 bp, Homo sapiens; identical to SEQ ID NO: 3747

SEQ ID NO: 57303 - DNA, 32 bp, Homo sapiens; identical to SEQ ID NO: 3748

SEQ ID NO: 57304 - DNA, 24 bp, Homo sapiens
tcccggggctacgcctgtctgagc

SEQ ID NO: 57305 - DNA, 27 bp, Homo sapiens
tcccggggctacgcctgtctgagcgtc

SEQ ID NO: 57306 - DNA, 28 bp, Homo sapiens
tcccggggctacgcctgtctgagcgtcg

SEQ ID NO: 57307 - DNA, 29 bp, Homo sapiens
tcccggggctacgcctgtctgagcgtcgc

SEQ ID NO: 57308 - DNA, 30 bp, Homo sapiens; identical to SEQ ID NO: 3754

SEQ ID NO: 57309 - DNA, 21 bp, Homo sapiens
cccggggctacgcctgtctga

SEQ ID NO: 57310 - DNA, 22 bp, Homo sapiens
cccggggctacgcctgtctgag

SEQ ID NO: 57311 - DNA, 23 bp, Homo sapiens
cccggggctacgcctgtctgagc

SEQ ID NO: 57312 - DNA, 25 bp, Homo sapiens
cccggggctacgcctgtctgagcgt

SEQ ID NO: 57313 - DNA, 26 bp, Homo sapiens
cccggggctacgcctgtctgagcgtc

SEQ ID NO: 57314 - DNA, 27 bp, Homo sapiens
cccggggctacgcctgtctgagcgtcg

SEQ ID NO: 57315 - DNA, 28 bp, Homo sapiens
cccggggctacgcctgtctgagcgtcgc

SEQ ID NO: 57316 - DNA, 29 bp, Homo sapiens
cccggggctacgcctgtctgagcgtcgct

SEQ ID NO: 57317 - DNA, 30 bp, Homo sapiens; identical to SEQ ID NO: 3762

SEQ ID NO: 57318 - DNA, 22 bp, Homo sapiens
ccggggctacgcctgtctgagc

SEQ ID NO: 57319 - DNA, 24 bp, Homo sapiens
ccggggctacgcctgtctgagcgt

SEQ ID NO: 57320 - DNA, 25 bp, Homo sapiens
ccggggctacgcctgtctgagcgtc

SEQ ID NO: 57321 - DNA, 26 bp, Homo sapiens
ccggggctacgcctgtctgagcgtcg

SEQ ID NO: 57322 - DNA, 27 bp, Homo sapiens
ccggggctacgcctgtctgagcgtcgc

SEQ ID NO: 57323 - DNA, 28 bp, Homo sapiens
ccggggctacgcctgtctgagcgtcgct

SEQ ID NO: 57324 - DNA, 29 bp, Homo sapiens
ccggggctacgcctgtctgagcgtcgctt

SEQ ID NO: 57325 - DNA, 20 bp, Homo sapiens
cggggctacgcctgtctgag

SEQ ID NO: 57326 - DNA, 21 bp, Homo sapiens
cggggctacgcctgtctgagc

SEQ ID NO: 57327 - DNA, 22 bp, Homo sapiens
cggggctacgcctgtctgagcg

SEQ ID NO: 57328 - DNA, 24 bp, Homo sapiens
cggggctacgcctgtctgagcgtc

SEQ ID NO: 57329 - DNA, 25 bp, Homo sapiens
cggggctacgcctgtctgagcgtcg

SEQ ID NO: 57330 - DNA, 26 bp, Homo sapiens
cggggctacgcctgtctgagcgtcgc

SEQ ID NO: 57331 - DNA, 27 bp, Homo sapiens
cggggctacgcctgtctgagcgtcgct

SEQ ID NO: 57332 - DNA, 28 bp, Homo sapiens
cggggctacgcctgtctgagcgtcgctt

SEQ ID NO: 57333 - DNA, 25 bp, Homo sapiens
ggggctacgcctgtctgagcgtcgc

SEQ ID NO: 57334 - DNA, 26 bp, Homo sapiens
ggggctacgcctgtctgagcgtcgct

SEQ ID NO: 57335 - DNA, 27 bp, Homo sapiens
ggggctacgcctgtctgagcgtcgctt

SEQ ID NO: 57336 - DNA, 24 bp, Homo sapiens
gggctacgcctgtctgagcgtcgc

SEQ ID NO: 57337 - DNA, 25 bp, Homo sapiens
gggctacgcctgtctgagcgtcgct

SEQ ID NO: 57338 - DNA, 26 bp, Homo sapiens
gggctacgcctgtctgagcgtcgctt

SEQ ID NO: 57339 - DNA, 23 bp, Homo sapiens
ggctacgcctgtctgagcgtcgc

SEQ ID NO: 57340 - DNA, 24 bp, Homo sapiens
ggctacgcctgtctgagcgtcgct

SEQ ID NO: 57341 - DNA, 18 bp, Homo sapiens
gctacgcctgtctgagcg

SEQ ID NO: 57342 - DNA, 23 bp, Homo sapiens
gctacgcctgtctgagcgtcgct

SEQ ID NO: 57343 - DNA, 22 bp, Homo sapiens
ctacgcctgtctgagcgtcgct

SEQ ID NO: 57344 - DNA, 23 bp, Homo sapiens
ctacgcctgtctgagcgtcgctt

SEQ ID NO: 57345 - DNA, 20 bp, Homo sapiens
tacgcctgtctgagcgtcgc

SEQ ID NO: 57346 - DNA, 21 bp, Homo sapiens
tacgcctgtctgagcgtcgct

SEQ ID NO: 57347 - DNA, 22 bp, Homo sapiens
tacgcctgtctgagcgtcgctt

SEQ ID NO: 57348 - DNA, 20 bp, Homo sapiens
acgcctgtctgagcgtcgct

SEQ ID NO: 57349 - DNA, 21 bp, Homo sapiens
acgcctgtctgagcgtcgctt

SEQ ID NO: 57350 - DNA, 18 bp, Homo sapiens
cgcctgtctgagcgtcgc

SEQ ID NO: 57351 - DNA, 19 bp, Homo sapiens
cgcctgtctgagcgtcgct

SEQ ID NO: 57352 - DNA, 20 bp, Homo sapiens
cgcctgtctgagcgtcgctt

SEQ ID NO: 57353 - DNA, 18 bp, Homo sapiens
gcctgtctgagcgtcgct

SEQ ID NO: 57354 - DNA, 19 bp, Homo sapiens
gcctgtctgagcgtcgctt

SEQ ID NO: 57355 - DNA, 16 bp, Homo sapiens
cctgtctgagcgtcgc

SEQ ID NO: 57356 - DNA, 17 bp, Homo sapiens
cctgtctgagcgtcgct

SEQ ID NO: 57357 - DNA, 18 bp, Homo sapiens
cctgtctgagcgtcgctt

SEQ ID NO: 57358 - DNA, 16 bp, Homo sapiens
ctgtctgagcgtcgct

SEQ ID NO: 57359 - DNA, 17 bp, Homo sapiens
ctgtctgagcgtcgctt

SEQ ID NO: 57360 - DNA, 16 bp, Homo sapiens
tgtctgagcgtcgctt

SEQ ID NO: 57361 - DNA, 29 bp, Homo sapiens
acgcgacctcagatcagacgtggcgaccc

SEQ ID NO: 57362 - DNA, 30 bp, Homo sapiens; identical to SEQ ID NO: 3848

SEQ ID NO: 57363 - DNA, 31 bp, Homo sapiens; identical to SEQ ID NO: 3849

SEQ ID NO: 57364 - DNA, 32 bp, Homo sapiens; identical to SEQ ID NO: 3850

SEQ ID NO: 57365 - DNA, 34 bp, Homo sapiens; identical to SEQ ID NO: 18226

SEQ ID NO: 57366 - DNA, 35 bp, Homo sapiens; identical to SEQ ID NO: 18227

SEQ ID NO: 57367 - DNA, 36 bp, Homo sapiens; identical to SEQ ID NO: 18228

SEQ ID NO: 57368 - DNA, 37 bp, Homo sapiens; identical to SEQ ID NO: 18229

SEQ ID NO: 57369 - DNA, 38 bp, Homo sapiens; identical to SEQ ID NO: 18230

SEQ ID NO: 57370 - DNA, 42 bp, Homo sapiens; identical to SEQ ID NO: 18234

SEQ ID NO: 57371 - DNA, 17 bp, Homo sapiens
cgcgacctcagatcaga

SEQ ID NO: 57372 - DNA, 18 bp, Homo sapiens
cgcgacctcagatcagac

SEQ ID NO: 57373 - DNA, 19 bp, Homo sapiens
cgcgacctcagatcagacg

SEQ ID NO: 57374 - DNA, 20 bp, Homo sapiens
cgcgacctcagatcagacgt

SEQ ID NO: 57375 - DNA, 21 bp, Homo sapiens
cgcgacctcagatcagacgtg

SEQ ID NO: 57376 - DNA, 22 bp, Homo sapiens
cgcgacctcagatcagacgtgg

SEQ ID NO: 57377 - DNA, 23 bp, Homo sapiens
cgcgacctcagatcagacgtggc

SEQ ID NO: 57378 - DNA, 24 bp, Homo sapiens
cgcgacctcagatcagacgtggcg

SEQ ID NO: 57379 - DNA, 25 bp, Homo sapiens
cgcgacctcagatcagacgtggcga

SEQ ID NO: 57380 - DNA, 26 bp, Homo sapiens
cgcgacctcagatcagacgtggcgac

SEQ ID NO: 57381 - DNA, 27 bp, Homo sapiens
cgcgacctcagatcagacgtggcgacc

SEQ ID NO: 57382 - DNA, 28 bp, Homo sapiens
cgcgacctcagatcagacgtggcgaccc

SEQ ID NO: 57383 - DNA, 29 bp, Homo sapiens
cgcgacctcagatcagacgtggcgacccg

SEQ ID NO: 57384 - DNA, 30 bp, Homo sapiens; identical to SEQ ID NO: 3865

SEQ ID NO: 57385 - DNA, 31 bp, Homo sapiens; identical to SEQ ID NO: 3866

SEQ ID NO: 57386 - DNA, 32 bp, Homo sapiens; identical to SEQ ID NO: 3867

SEQ ID NO: 57387 - DNA, 33 bp, Homo sapiens; identical to SEQ ID NO: 3868

SEQ ID NO: 57388 - DNA, 34 bp, Homo sapiens; identical to SEQ ID NO: 18258

SEQ ID NO: 57389 - DNA, 35 bp, Homo sapiens; identical to SEQ ID NO: 18259

SEQ ID NO: 57390 - DNA, 36 bp, Homo sapiens; identical to SEQ ID NO: 18260

SEQ ID NO: 57391 - DNA, 37 bp, Homo sapiens; identical to SEQ ID NO: 18261

SEQ ID NO: 57392 - DNA, 38 bp, Homo sapiens; identical to SEQ ID NO: 18262

SEQ ID NO: 57393 - DNA, 39 bp, Homo sapiens; identical to SEQ ID NO: 18263

SEQ ID NO: 57394 - DNA, 40 bp, Homo sapiens; identical to SEQ ID NO: 18264

SEQ ID NO: 57395 - DNA, 41 bp, Homo sapiens; identical to SEQ ID NO: 18265

SEQ ID NO: 57396 - DNA, 42 bp, Homo sapiens; identical to SEQ ID NO: 18266

SEQ ID NO: 57397 - DNA, 43 bp, Homo sapiens; identical to SEQ ID NO: 18267

SEQ ID NO: 57398 - DNA, 44 bp, Homo sapiens; identical to SEQ ID NO: 18268

SEQ ID NO: 57399 - DNA, 45 bp, Homo sapiens; identical to SEQ ID NO: 18269

SEQ ID NO: 57400 - DNA, 46 bp, Homo sapiens; identical to SEQ ID NO: 18270

SEQ ID NO: 57401 - DNA, 22 bp, Homo sapiens
gcgacctcagatcagacgtggc

SEQ ID NO: 57402 - DNA, 23 bp, Homo sapiens
gcgacctcagatcagacgtggcg

SEQ ID NO: 57403 - DNA, 28 bp, Homo sapiens
gcgacctcagatcagacgtggcgacccg

SEQ ID NO: 57404 - DNA, 21 bp, Homo sapiens
cgacctcagatcagacgtggc

SEQ ID NO: 57405 - DNA, 18 bp, Homo sapiens
cctcagatcagacgtggc

SEQ ID NO: 57406 - DNA, 17 bp, Homo sapiens
ctcagatcagacgtggc

SEQ ID NO: 57407 - DNA, 38 bp, Homo sapiens
ccgcggcggggcgcgggacatgtggcgtacggaagacc

SEQ ID NO: 57408 - DNA, 42 bp, Homo sapiens
ccgcggcggggcgcgggacatgtggcgtacggaagacccgct

SEQ ID NO: 57409 - DNA, 35 bp, Homo sapiens
cgcggcggggcgcgggacatgtggcgtacggaaga

SEQ ID NO: 57410 - DNA, 29 bp, Homo sapiens
gtacggaagacccgctccccggcgccgct

SEQ ID NO: 57411 - DNA, 20 bp, Homo sapiens
cggaagacccgctccccggc

SEQ ID NO: 57412 - DNA, 22 bp, Homo sapiens
cggaagacccgctccccggcgc

SEQ ID NO: 57413 - DNA, 23 bp, Homo sapiens
cggaagacccgctccccggcgcc

SEQ ID NO: 57414 - DNA, 24 bp, Homo sapiens
cggaagacccgctccccggcgccg

SEQ ID NO: 57415 - DNA, 25 bp, Homo sapiens
cggaagacccgctccccggcgccgc

SEQ ID NO: 57416 - DNA, 26 bp, Homo sapiens
cggaagacccgctccccggcgccgct

SEQ ID NO: 57417 - DNA, 27 bp, Homo sapiens
cggaagacccgctccccggcgccgctc

SEQ ID NO: 57418 - DNA, 28 bp, Homo sapiens
cggaagacccgctccccggcgccgctcg

SEQ ID NO: 57419 - DNA, 58 bp, Homo sapiens
cggaagacccgctccccggcgccgctcgtggggggcccaagtccttctgatcgaggcc

SEQ ID NO: 57420 - DNA, 59 bp, Homo sapiens
cggaagacccgctccccggcgccgctcgtggggggcccaagtccttctgatcgaggccc

SEQ ID NO: 57421 - DNA, 21 bp, Homo sapiens
ggaagacccgctccccggcgc

SEQ ID NO: 57422 - DNA, 22 bp, Homo sapiens
ggaagacccgctccccggcgcc

SEQ ID NO: 57423 - DNA, 25 bp, Homo sapiens
ggaagacccgctccccggcgccgct

SEQ ID NO: 57424 - DNA, 17 bp, Homo sapiens
gacccgctccccggcgc

SEQ ID NO: 57425 - DNA, 18 bp, Homo sapiens
gacccgctccccggcgcc

SEQ ID NO: 57426 - DNA, 19 bp, Homo sapiens
gacccgctccccggcgccg

SEQ ID NO: 57427 - DNA, 21 bp, Homo sapiens
gacccgctccccggcgccgct

SEQ ID NO: 57428 - DNA, 16 bp, Homo sapiens
acccgctccccggcgc

SEQ ID NO: 57429 - DNA, 16 bp, Homo sapiens
cccgctccccggcgcc

SEQ ID NO: 57430 - DNA, 33 bp, Homo sapiens; identical to SEQ ID NO: 4026

SEQ ID NO: 57431 - DNA, 34 bp, Homo sapiens; identical to SEQ ID NO: 18783

SEQ ID NO: 57432 - DNA, 32 bp, Homo sapiens; identical to SEQ ID NO: 4029

SEQ ID NO: 57433 - DNA, 33 bp, Homo sapiens; identical to SEQ ID NO: 18788

SEQ ID NO: 57434 - DNA, 31 bp, Homo sapiens; identical to SEQ ID NO: 4033

SEQ ID NO: 57435 - DNA, 32 bp, Homo sapiens; identical to SEQ ID NO: 4034

SEQ ID NO: 57436 - DNA, 33 bp, Homo sapiens
gtggggggcccaagtccttctgatcgaggccca

SEQ ID NO: 57437 - DNA, 29 bp, Homo sapiens
tggggggcccaagtccttctgatcgaggc

SEQ ID NO: 57438 - DNA, 30 bp, Homo sapiens; identical to SEQ ID NO: 4038

SEQ ID NO: 57439 - DNA, 31 bp, Homo sapiens; identical to SEQ ID NO: 4039

SEQ ID NO: 57440 - DNA, 27 bp, Homo sapiens
ggggcccaagtccttctgatcgaggcc

SEQ ID NO: 57441 - DNA, 26 bp, Homo sapiens
gggcccaagtccttctgatcgaggcc

SEQ ID NO: 57442 - DNA, 24 bp, Homo sapiens
gcccaagtccttctgatcgaggcc

SEQ ID NO: 57443 - DNA, 25 bp, Homo sapiens
gcccaagtccttctgatcgaggccc

SEQ ID NO: 57444 - DNA, 23 bp, Homo sapiens
cccaagtccttctgatcgaggcc

SEQ ID NO: 57445 - DNA, 24 bp, Homo sapiens
cccaagtccttctgatcgaggccc

SEQ ID NO: 57446 - DNA, 22 bp, Homo sapiens
ccaagtccttctgatcgaggcc

SEQ ID NO: 57447 - DNA, 23 bp, Homo sapiens
ccaagtccttctgatcgaggccc

SEQ ID NO: 57448 - DNA, 21 bp, Homo sapiens
caagtccttctgatcgaggcc

SEQ ID NO: 57449 - DNA, 22 bp, Homo sapiens
caagtccttctgatcgaggccc

SEQ ID NO: 57450 - DNA, 17 bp, Homo sapiens
tccttctgatcgaggcc

SEQ ID NO: 57451 - DNA, 18 bp, Homo sapiens
tccttctgatcgaggccc

SEQ ID NO: 57452 - DNA, 16 bp, Homo sapiens
ccttctgatcgaggcc

SEQ ID NO: 57453 - DNA, 17 bp, Homo sapiens
ccttctgatcgaggccc

SEQ ID NO: 57454 - DNA, 16 bp, Homo sapiens
cttctgatcgaggccc

SEQ ID NO: 57455 - DNA, 20 bp, Homo sapiens
cggcccccggcgcgccgggc

SEQ ID NO: 57456 - DNA, 27 bp, Homo sapiens
cggcccccggcgcgccgggcccgggtc

SEQ ID NO: 57457 - DNA, 28 bp, Homo sapiens
cggcccccggcgcgccgggcccgggtct

SEQ ID NO: 57458 - DNA, 19 bp, Homo sapiens
ggcccccggcgcgccgggc

SEQ ID NO: 57459 - DNA, 24 bp, Homo sapiens
ggcccccggcgcgccgggcccggg

SEQ ID NO: 57460 - DNA, 22 bp, Homo sapiens
cccccggcgcgccgggcccggg

SEQ ID NO: 57461 - DNA, 18 bp, Homo sapiens
cggcgcgccgggcccggg

SEQ ID NO: 57462 - DNA, 21 bp, Homo sapiens
cgccgggcccgggtcttcccg

SEQ ID NO: 57463 - DNA, 28 bp, Homo sapiens
ccatctaaggctaaataccggcacgaga

SEQ ID NO: 57464 - DNA, 21 bp, Homo sapiens
tgaaaagaactttgaagagag

SEQ ID NO: 57465 - DNA, 23 bp, Homo sapiens
tgaaaagaactttgaagagagag

SEQ ID NO: 57466 - DNA, 24 bp, Homo sapiens
tgaaaagaactttgaagagagagt

SEQ ID NO: 57467 - DNA, 32 bp, Homo sapiens; identical to SEQ ID NO: 19256

SEQ ID NO: 57468 - DNA, 36 bp, Homo sapiens
cgcagtccgcccggaggattcaacccggcggcgggt

SEQ ID NO: 57469 - DNA, 35 bp, Homo sapiens
gcagtccgcccggaggattcaacccggcggcgggt

SEQ ID NO: 57470 - DNA, 34 bp, Homo sapiens
cagtccgcccggaggattcaacccggcggcgggt

SEQ ID NO: 57471 - DNA, 31 bp, Homo sapiens; identical to SEQ ID NO: 4191

SEQ ID NO: 57472 - DNA, 32 bp, Homo sapiens; identical to SEQ ID NO: 4192

SEQ ID NO: 57473 - DNA, 19 bp, Homo sapiens
cccggcggcgggtccggcc

SEQ ID NO: 57474 - DNA, 20 bp, Homo sapiens
cccggcggcgggtccggccg

SEQ ID NO: 57475 - DNA, 22 bp, Homo sapiens
cccggcggcgggtccggccgtg

SEQ ID NO: 57476 - DNA, 26 bp, Homo sapiens
cccggcggcgggtccggccgtgtcgg

SEQ ID NO: 57477 - DNA, 29 bp, Homo sapiens
cccggcggcgggtccggccgtgtcggcgg

SEQ ID NO: 57478 - DNA, 30 bp, Homo sapiens; identical to SEQ ID NO: 41602

SEQ ID NO: 57479 - DNA, 31 bp, Homo sapiens
cccggcggcgggtccggccgtgtcggcggcc

SEQ ID NO: 57480 - DNA, 37 bp, Homo sapiens
cccggcggcgggtccggccgtgtcggcggcccggcgg

SEQ ID NO: 57481 - DNA, 27 bp, Homo sapiens
ccggcggcgggtccggccgtgtcggcg

SEQ ID NO: 57482 - DNA, 26 bp, Homo sapiens
cggcggcgggtccggccgtgtcggcg

SEQ ID NO: 57483 - DNA, 27 bp, Homo sapiens
cggcggcgggtccggccgtgtcggcgg

SEQ ID NO: 57484 - DNA, 19 bp, Homo sapiens
ggtccggccgtgtcggcgg

SEQ ID NO: 57485 - DNA, 16 bp, Homo sapiens
gtccggccgtgtcggc

SEQ ID NO: 57486 - DNA, 17 bp, Homo sapiens
gtccggccgtgtcggcg

SEQ ID NO: 57487 - DNA, 18 bp, Homo sapiens
gtccggccgtgtcggcgg

SEQ ID NO: 57488 - DNA, 16 bp, Homo sapiens
tccggccgtgtcggcg

SEQ ID NO: 57489 - DNA, 17 bp, Homo sapiens
tccggccgtgtcggcgg

SEQ ID NO: 57490 - DNA, 16 bp, Homo sapiens
ccggccgtgtcggcgg

SEQ ID NO: 57491 - DNA, 16 bp, Homo sapiens
cggccgtgtcggcggc

SEQ ID NO: 57492 - DNA, 20 bp, Homo sapiens
tcccgacccctccacccgcc

SEQ ID NO: 57493 - DNA, 21 bp, Homo sapiens
tcccgacccctccacccgccc

SEQ ID NO: 57494 - DNA, 19 bp, Homo sapiens
cccgacccctccacccgcc

SEQ ID NO: 57495 - DNA, 20 bp, Homo sapiens
cccgacccctccacccgccc

SEQ ID NO: 57496 - DNA, 19 bp, Homo sapiens
ccgacccctccacccgccc

SEQ ID NO: 57497 - DNA, 17 bp, Homo sapiens
cgacccctccacccgcc

SEQ ID NO: 57498 - DNA, 18 bp, Homo sapiens
cgacccctccacccgccc

SEQ ID NO: 57499 - DNA, 20 bp, Homo sapiens
cccgccctcccttcccccgc

SEQ ID NO: 57500 - DNA, 21 bp, Homo sapiens
cccgccctcccttcccccgcc

SEQ ID NO: 57501 - DNA, 20 bp, Homo sapiens
ccgccctcccttcccccgcc

SEQ ID NO: 57502 - DNA, 18 bp, Homo sapiens
cgccctcccttcccccgc

SEQ ID NO: 57503 - DNA, 19 bp, Homo sapiens
cgccctcccttcccccgcc

SEQ ID NO: 57504 - DNA, 20 bp, Homo sapiens
cgccctcccttcccccgccg

SEQ ID NO: 57505 - DNA, 20 bp, Homo sapiens
cccgccgcccctcctcctcc

SEQ ID NO: 57506 - DNA, 23 bp, Homo sapiens
ctcctccccggagggggcgggct

SEQ ID NO: 57507 - DNA, 20 bp, Homo sapiens
cctccccggagggggcgggc

SEQ ID NO: 57508 - DNA, 33 bp, Homo sapiens
cggcgggtgcgggggtgggcgggcggggccggg

SEQ ID NO: 57509 - DNA, 17 bp, Homo sapiens
cccccgaccggcgaccg

SEQ ID NO: 57510 - DNA, 28 bp, Homo sapiens
cccccgaccggcgaccggccgccgccgg

SEQ ID NO: 57511 - DNA, 29 bp, Homo sapiens
cccccgaccggcgaccggccgccgccggg

SEQ ID NO: 57512 - DNA, 31 bp, Homo sapiens; identical to SEQ ID NO: 19446

SEQ ID NO: 57513 - DNA, 32 bp, Homo sapiens
cccccgaccggcgaccggccgccgccgggcgc

SEQ ID NO: 57514 - DNA, 25 bp, Homo sapiens
ccccgaccggcgaccggccgccgcc

SEQ ID NO: 57515 - DNA, 27 bp, Homo sapiens
ccccgaccggcgaccggccgccgccgg

SEQ ID NO: 57516 - DNA, 28 bp, Homo sapiens
ccccgaccggcgaccggccgccgccggg

SEQ ID NO: 57517 - DNA, 30 bp, Homo sapiens
ccccgaccggcgaccggccgccgccgggcg

SEQ ID NO: 57518 - DNA, 24 bp, Homo sapiens
cccgaccggcgaccggccgccgcc

SEQ ID NO: 57519 - DNA, 26 bp, Homo sapiens
cccgaccggcgaccggccgccgccgg

SEQ ID NO: 57520 - DNA, 29 bp, Homo sapiens
cccgaccggcgaccggccgccgccgggcg

SEQ ID NO: 57521 - DNA, 25 bp, Homo sapiens
ccgaccggcgaccggccgccgccgg

SEQ ID NO: 57522 - DNA, 22 bp, Homo sapiens
cggcgaccggccgccgccgggc

SEQ ID NO: 57523 - DNA, 20 bp, Homo sapiens
ggcgaccggccgccgccggg

SEQ ID NO: 57524 - DNA, 21 bp, Homo sapiens
ggcgaccggccgccgccgggc

SEQ ID NO: 57525 - DNA, 19 bp, Homo sapiens
cgccgcgaccggctccggg

SEQ ID NO: 57526 - DNA, 16 bp, Homo sapiens
cgcgaccggctccggg

SEQ ID NO: 57527 - DNA, 21 bp, Homo sapiens
tcctcctcccccgtctccgcc

SEQ ID NO: 57528 - DNA, 20 bp, Homo sapiens
cctcctcccccgtctccgcc

SEQ ID NO: 57529 - DNA, 18 bp, Homo sapiens
tcctcccccgtctccgcc

SEQ ID NO: 57530 - DNA, 17 bp, Homo sapiens
cctcccccgtctccgcc

SEQ ID NO: 57531 - DNA, 18 bp, Homo sapiens
cctcccccgtctccgccc

SEQ ID NO: 57532 - DNA, 19 bp, Homo sapiens
cctcccccgtctccgcccc

SEQ ID NO: 57533 - DNA, 16 bp, Homo sapiens
ctcccccgtctccgcc

SEQ ID NO: 57534 - DNA, 17 bp, Homo sapiens
ctcccccgtctccgccc

SEQ ID NO: 57535 - DNA, 23 bp, Homo sapiens
ctcccccgtctccgccccccggc

SEQ ID NO: 57536 - DNA, 24 bp, Homo sapiens
ctcccccgtctccgccccccggcc

SEQ ID NO: 57537 - DNA, 16 bp, Homo sapiens
tcccccgtctccgccc

SEQ ID NO: 57538 - DNA, 17 bp, Homo sapiens
tcccccgtctccgcccc

SEQ ID NO: 57539 - DNA, 22 bp, Homo sapiens
tcccccgtctccgccccccggc

SEQ ID NO: 57540 - DNA, 23 bp, Homo sapiens
tcccccgtctccgccccccggcc

SEQ ID NO: 57541 - DNA, 21 bp, Homo sapiens
cccccgtctccgccccccggc

SEQ ID NO: 57542 - DNA, 22 bp, Homo sapiens
cccccgtctccgccccccggcc

SEQ ID NO: 57543 - DNA, 20 bp, Homo sapiens
ccccgtctccgccccccggc

SEQ ID NO: 57544 - DNA, 21 bp, Homo sapiens
ccccgtctccgccccccggcc

SEQ ID NO: 57545 - DNA, 22 bp, Homo sapiens
ccccgtctccgccccccggccc

SEQ ID NO: 57546 - DNA, 26 bp, Homo sapiens
ccccgtctccgccccccggccccgcg

SEQ ID NO: 57547 - DNA, 28 bp, Homo sapiens
ccccgtctccgccccccggccccgcgtc

SEQ ID NO: 57548 - DNA, 32 bp, Homo sapiens; identical to SEQ ID NO: 19549

SEQ ID NO: 57549 - DNA, 33 bp, Homo sapiens; identical to SEQ ID NO: 19550

SEQ ID NO: 57550 - DNA, 18 bp, Homo sapiens
cccgtctccgccccccgg

SEQ ID NO: 57551 - DNA, 19 bp, Homo sapiens
cccgtctccgccccccggc

SEQ ID NO: 57552 - DNA, 20 bp, Homo sapiens
cccgtctccgccccccggcc

SEQ ID NO: 57553 - DNA, 21 bp, Homo sapiens
cccgtctccgccccccggccc

SEQ ID NO: 57554 - DNA, 23 bp, Homo sapiens
cccgtctccgccccccggccccg

SEQ ID NO: 57555 - DNA, 24 bp, Homo sapiens
cccgtctccgccccccggccccgc

SEQ ID NO: 57556 - DNA, 25 bp, Homo sapiens
cccgtctccgccccccggccccgcg

SEQ ID NO: 57557 - DNA, 26 bp, Homo sapiens
cccgtctccgccccccggccccgcgt

SEQ ID NO: 57558 - DNA, 27 bp, Homo sapiens
cccgtctccgccccccggccccgcgtc

SEQ ID NO: 57559 - DNA, 28 bp, Homo sapiens
cccgtctccgccccccggccccgcgtcc

SEQ ID NO: 57560 - DNA, 29 bp, Homo sapiens
cccgtctccgccccccggccccgcgtcct

SEQ ID NO: 57561 - DNA, 30 bp, Homo sapiens; identical to SEQ ID NO: 42425

SEQ ID NO: 57562 - DNA, 31 bp, Homo sapiens; identical to SEQ ID NO: 19552

SEQ ID NO: 57563 - DNA, 32 bp, Homo sapiens; identical to SEQ ID NO: 4220

SEQ ID NO: 57564 - DNA, 18 bp, Homo sapiens
ccgtctccgccccccggc

SEQ ID NO: 57565 - DNA, 19 bp, Homo sapiens
ccgtctccgccccccggcc

SEQ ID NO: 57566 - DNA, 20 bp, Homo sapiens
ccgtctccgccccccggccc

SEQ ID NO: 57567 - DNA, 23 bp, Homo sapiens
ccgtctccgccccccggccccgc

SEQ ID NO: 57568 - DNA, 24 bp, Homo sapiens
ccgtctccgccccccggccccgcg

SEQ ID NO: 57569 - DNA, 26 bp, Homo sapiens
ccgtctccgccccccggccccgcgtc

SEQ ID NO: 57570 - DNA, 27 bp, Homo sapiens
ccgtctccgccccccggccccgcgtcc

SEQ ID NO: 57571 - DNA, 28 bp, Homo sapiens
ccgtctccgccccccggccccgcgtcct

SEQ ID NO: 57572 - DNA, 29 bp, Homo sapiens
ccgtctccgccccccggccccgcgtcctc

SEQ ID NO: 57573 - DNA, 30 bp, Homo sapiens; identical to SEQ ID NO: 4221

SEQ ID NO: 57574 - DNA, 31 bp, Homo sapiens; identical to SEQ ID NO: 4222

SEQ ID NO: 57575 - DNA, 17 bp, Homo sapiens
cgtctccgccccccggc

SEQ ID NO: 57576 - DNA, 18 bp, Homo sapiens
cgtctccgccccccggcc

SEQ ID NO: 57577 - DNA, 19 bp, Homo sapiens
cgtctccgccccccggccc

SEQ ID NO: 57578 - DNA, 22 bp, Homo sapiens
cgtctccgccccccggccccgc

SEQ ID NO: 57579 - DNA, 23 bp, Homo sapiens
cgtctccgccccccggccccgcg

SEQ ID NO: 57580 - DNA, 24 bp, Homo sapiens
cgtctccgccccccggccccgcgt

SEQ ID NO: 57581 - DNA, 25 bp, Homo sapiens
cgtctccgccccccggccccgcgtc

SEQ ID NO: 57582 - DNA, 26 bp, Homo sapiens
cgtctccgccccccggccccgcgtcc

SEQ ID NO: 57583 - DNA, 27 bp, Homo sapiens
cgtctccgccccccggccccgcgtcct

SEQ ID NO: 57584 - DNA, 28 bp, Homo sapiens
cgtctccgccccccggccccgcgtcctc

SEQ ID NO: 57585 - DNA, 29 bp, Homo sapiens
cgtctccgccccccggccccgcgtcctcc

SEQ ID NO: 57586 - DNA, 30 bp, Homo sapiens; identical to SEQ ID NO: 19567

SEQ ID NO: 57587 - DNA, 19 bp, Homo sapiens
tccgccccccggccccgcg

SEQ ID NO: 57588 - DNA, 21 bp, Homo sapiens
tccgccccccggccccgcgtc

SEQ ID NO: 57589 - DNA, 22 bp, Homo sapiens
tccgccccccggccccgcgtcc

SEQ ID NO: 57590 - DNA, 23 bp, Homo sapiens
tccgccccccggccccgcgtcct

SEQ ID NO: 57591 - DNA, 25 bp, Homo sapiens
tccgccccccggccccgcgtcctcc

SEQ ID NO: 57592 - DNA, 26 bp, Homo sapiens
tccgccccccggccccgcgtcctccc

SEQ ID NO: 57593 - DNA, 18 bp, Homo sapiens
ccgccccccggccccgcg

SEQ ID NO: 57594 - DNA, 19 bp, Homo sapiens
ccgccccccggccccgcgt

SEQ ID NO: 57595 - DNA, 20 bp, Homo sapiens
ccgccccccggccccgcgtc

SEQ ID NO: 57596 - DNA, 21 bp, Homo sapiens
ccgccccccggccccgcgtcc

SEQ ID NO: 57597 - DNA, 22 bp, Homo sapiens
ccgccccccggccccgcgtcct

SEQ ID NO: 57598 - DNA, 23 bp, Homo sapiens
ccgccccccggccccgcgtcctc

SEQ ID NO: 57599 - DNA, 24 bp, Homo sapiens
ccgccccccggccccgcgtcctcc

SEQ ID NO: 57600 - DNA, 25 bp, Homo sapiens
ccgccccccggccccgcgtcctccc

SEQ ID NO: 57601 - DNA, 16 bp, Homo sapiens
cgccccccggccccgc

SEQ ID NO: 57602 - DNA, 17 bp, Homo sapiens
cgccccccggccccgcg

SEQ ID NO: 57603 - DNA, 18 bp, Homo sapiens
cgccccccggccccgcgt

SEQ ID NO: 57604 - DNA, 19 bp, Homo sapiens
cgccccccggccccgcgtc

SEQ ID NO: 57605 - DNA, 20 bp, Homo sapiens
cgccccccggccccgcgtcc

SEQ ID NO: 57606 - DNA, 21 bp, Homo sapiens
cgccccccggccccgcgtcct

SEQ ID NO: 57607 - DNA, 22 bp, Homo sapiens
cgccccccggccccgcgtcctc

SEQ ID NO: 57608 - DNA, 23 bp, Homo sapiens
cgccccccggccccgcgtcctcc

SEQ ID NO: 57609 - DNA, 24 bp, Homo sapiens
cgccccccggccccgcgtcctccc

SEQ ID NO: 57610 - DNA, 18 bp, Homo sapiens
gccccccggccccgcgtc

SEQ ID NO: 57611 - DNA, 23 bp, Homo sapiens
gccccccggccccgcgtcctccc

SEQ ID NO: 57612 - DNA, 18 bp, Homo sapiens
cccccggccccgcgtcct

SEQ ID NO: 57613 - DNA, 20 bp, Homo sapiens
cccccggccccgcgtcctcc

SEQ ID NO: 57614 - DNA, 21 bp, Homo sapiens
cccccggccccgcgtcctccc

SEQ ID NO: 57615 - DNA, 19 bp, Homo sapiens
ccccggccccgcgtcctcc

SEQ ID NO: 57616 - DNA, 20 bp, Homo sapiens
ccccggccccgcgtcctccc

SEQ ID NO: 57617 - DNA, 18 bp, Homo sapiens
cccggccccgcgtcctcc

SEQ ID NO: 57618 - DNA, 19 bp, Homo sapiens
cccggccccgcgtcctccc

SEQ ID NO: 57619 - DNA, 30 bp, Homo sapiens; identical to SEQ ID NO: 19625

SEQ ID NO: 57620 - DNA, 24 bp, Homo sapiens
cgcgggtcggggcggcggcggcgg

SEQ ID NO: 57621 - DNA, 22 bp, Homo sapiens
cgggtcggggcggcggcggcgg

SEQ ID NO: 57622 - DNA, 24 bp, Homo sapiens
ccccccgagtgttacagccccccc

SEQ ID NO: 57623 - DNA, 27 bp, Homo sapiens
ccccccgagtgttacagcccccccggc

SEQ ID NO: 57624 - DNA, 36 bp, Homo sapiens
agcactcgccgaatcccggggccgagggagcgagac

SEQ ID NO: 57625 - DNA, 18 bp, Homo sapiens
cccggggccgagggagcg

SEQ ID NO: 57626 - DNA, 19 bp, Homo sapiens
cccggggccgagggagcga

SEQ ID NO: 57627 - DNA, 21 bp, Homo sapiens
cccggggccgagggagcgaga

SEQ ID NO: 57628 - DNA, 22 bp, Homo sapiens
cccggggccgagggagcgagac

SEQ ID NO: 57629 - DNA, 24 bp, Homo sapiens
cccggggccgagggagcgagaccc

SEQ ID NO: 57630 - DNA, 25 bp, Homo sapiens
cccggggccgagggagcgagacccg

SEQ ID NO: 57631 - DNA, 30 bp, Homo sapiens
cccggggccgagggagcgagacccgtcgcc

SEQ ID NO: 57632 - DNA, 28 bp, Homo sapiens
cggggccgagggagcgagacccgtcgcc

SEQ ID NO: 57633 - DNA, 22 bp, Homo sapiens
cgctctcccccctcccggcgcc

SEQ ID NO: 57634 - DNA, 16 bp, Homo sapiens
cccccctcccggcgcc

SEQ ID NO: 57635 - DNA, 17 bp, Homo sapiens
cccccctcccggcgccc

SEQ ID NO: 57636 - DNA, 28 bp, Homo sapiens
cccccctcccggcgcccacccccgcggg

SEQ ID NO: 57637 - DNA, 29 bp, Homo sapiens
cccccctcccggcgcccacccccgcgggg

SEQ ID NO: 57638 - DNA, 27 bp, Homo sapiens
ccccctcccggcgcccacccccgcggg

SEQ ID NO: 57639 - DNA, 18 bp, Homo sapiens
cggcgcccacccccgcgg

SEQ ID NO: 57640 - DNA, 19 bp, Homo sapiens
cggcgcccacccccgcggg

SEQ ID NO: 57641 - DNA, 20 bp, Homo sapiens
cggcgcccacccccgcgggg

SEQ ID NO: 57642 - DNA, 17 bp, Homo sapiens
ggcgcccacccccgcgg

SEQ ID NO: 57643 - DNA, 18 bp, Homo sapiens
ggcgcccacccccgcggg

SEQ ID NO: 57644 - DNA, 17 bp, Homo sapiens
gcgcccacccccgcggg

SEQ ID NO: 57645 - DNA, 39 bp, Homo sapiens
ccccgcgaggggggtctcccccgcgggggcgcgccggcg

SEQ ID NO: 57646 - DNA, 37 bp, Homo sapiens; identical to SEQ ID NO: 19880

SEQ ID NO: 57647 - DNA, 17 bp, Homo sapiens
cccccgcgggggcgcgc

SEQ ID NO: 57648 - DNA, 18 bp, Homo sapiens
cccccgcgggggcgcgcc

SEQ ID NO: 57649 - DNA, 19 bp, Homo sapiens
cccccgcgggggcgcgccg

SEQ ID NO: 57650 - DNA, 20 bp, Homo sapiens
cccccgcgggggcgcgccgg

SEQ ID NO: 57651 - DNA, 21 bp, Homo sapiens
cccccgcgggggcgcgccggc

SEQ ID NO: 57652 - DNA, 22 bp, Homo sapiens
cccccgcgggggcgcgccggcg

SEQ ID NO: 57653 - DNA, 23 bp, Homo sapiens
cccccgcgggggcgcgccggcgt

SEQ ID NO: 57654 - DNA, 17 bp, Homo sapiens
ccccgcgggggcgcgcc

SEQ ID NO: 57655 - DNA, 18 bp, Homo sapiens
ccccgcgggggcgcgccg

SEQ ID NO: 57656 - DNA, 19 bp, Homo sapiens
ccccgcgggggcgcgccgg

SEQ ID NO: 57657 - DNA, 20 bp, Homo sapiens
ccccgcgggggcgcgccggc

SEQ ID NO: 57658 - DNA, 21 bp, Homo sapiens
ccccgcgggggcgcgccggcg

SEQ ID NO: 57659 - DNA, 16 bp, Homo sapiens
cccgcgggggcgcgcc

SEQ ID NO: 57660 - DNA, 17 bp, Homo sapiens
cccgcgggggcgcgccg

SEQ ID NO: 57661 - DNA, 18 bp, Homo sapiens
cccgcgggggcgcgccgg

SEQ ID NO: 57662 - DNA, 19 bp, Homo sapiens
cccgcgggggcgcgccggc

SEQ ID NO: 57663 - DNA, 20 bp, Homo sapiens
cccgcgggggcgcgccggcg

SEQ ID NO: 57664 - DNA, 26 bp, Homo sapiens
cgggccacccctcccacggcgcgacc

SEQ ID NO: 57665 - DNA, 18 bp, Homo sapiens
cccctcccacggcgcgac

SEQ ID NO: 57666 - DNA, 19 bp, Homo sapiens
cccctcccacggcgcgacc

SEQ ID NO: 57667 - DNA, 20 bp, Homo sapiens
cccctcccacggcgcgaccg

SEQ ID NO: 57668 - DNA, 17 bp, Homo sapiens
ccctcccacggcgcgac

SEQ ID NO: 57669 - DNA, 18 bp, Homo sapiens
ccctcccacggcgcgacc

SEQ ID NO: 57670 - DNA, 19 bp, Homo sapiens
ccctcccacggcgcgaccg

SEQ ID NO: 57671 - DNA, 18 bp, Homo sapiens
cctcccacggcgcgaccg

SEQ ID NO: 57672 - DNA, 17 bp, Homo sapiens
ctcccacggcgcgaccg

SEQ ID NO: 57673 - DNA, 16 bp, Homo sapiens
tcccacggcgcgaccg

SEQ ID NO: 57674 - DNA, 22 bp, Homo sapiens
cggcgcgaccgctctcccaccc

SEQ ID NO: 57675 - DNA, 23 bp, Homo sapiens
cggcgcgaccgctctcccacccc

SEQ ID NO: 57676 - DNA, 30 bp, Homo sapiens; identical to SEQ ID NO: 19945

SEQ ID NO: 57677 - DNA, 23 bp, Homo sapiens
cccctcctccccgcgcccccgcc

SEQ ID NO: 57678 - DNA, 24 bp, Homo sapiens
cccctcctccccgcgcccccgccc

SEQ ID NO: 57679 - DNA, 22 bp, Homo sapiens
ccctcctccccgcgcccccgcc

SEQ ID NO: 57680 - DNA, 17 bp, Homo sapiens
cccgcgcccccgccccg

SEQ ID NO: 57681 - DNA, 23 bp, Homo sapiens
cccgccccggcgacggggggggt

SEQ ID NO: 57682 - DNA, 17 bp, Homo sapiens
cgcgcgcgggtcggggg

SEQ ID NO: 57683 - DNA, 18 bp, Homo sapiens
cgcgcgcgggtcgggggg

SEQ ID NO: 57684 - DNA, 19 bp, Homo sapiens
cgcgcgcgggtcggggggc

SEQ ID NO: 57685 - DNA, 22 bp, Homo sapiens
cgcgcgcgggtcggggggcggg

SEQ ID NO: 57686 - DNA, 23 bp, Homo sapiens
cgcgcgcgggtcggggggcgggg

SEQ ID NO: 57687 - DNA, 24 bp, Homo sapiens
cgcgcgcgggtcggggggcggggc

SEQ ID NO: 57688 - DNA, 25 bp, Homo sapiens
cgcgcgcgggtcggggggcggggcg

SEQ ID NO: 57689 - DNA, 26 bp, Homo sapiens
cgcgcgcgggtcggggggcggggcgg

SEQ ID NO: 57690 - DNA, 27 bp, Homo sapiens
cgcgcgcgggtcggggggcggggcgga

SEQ ID NO: 57691 - DNA, 28 bp, Homo sapiens
cgcgcgcgggtcggggggcggggcggac

SEQ ID NO: 57692 - DNA, 16 bp, Homo sapiens
cgcgcgggtcgggggg

SEQ ID NO: 57693 - DNA, 20 bp, Homo sapiens
cgcgcgggtcggggggcggg

SEQ ID NO: 57694 - DNA, 21 bp, Homo sapiens
cgcgcgggtcggggggcgggg

SEQ ID NO: 57695 - DNA, 33 bp, Homo sapiens; identical to SEQ ID NO: 4274

SEQ ID NO: 57696 - DNA, 34 bp, Homo sapiens; identical to SEQ ID NO: 20013

SEQ ID NO: 57697 - DNA, 35 bp, Homo sapiens; identical to SEQ ID NO: 20014

SEQ ID NO: 57698 - DNA, 31 bp, Homo sapiens; identical to SEQ ID NO: 4275

SEQ ID NO: 57699 - DNA, 32 bp, Homo sapiens; identical to SEQ ID NO: 4276

SEQ ID NO: 57700 - DNA, 33 bp, Homo sapiens; identical to SEQ ID NO: 4277

SEQ ID NO: 57701 - DNA, 34 bp, Homo sapiens; identical to SEQ ID NO: 20024

SEQ ID NO: 57702 - DNA, 35 bp, Homo sapiens; identical to SEQ ID NO: 20025

SEQ ID NO: 57703 - DNA, 19 bp, Homo sapiens
cgccccgggcgggtcgcgc

SEQ ID NO: 57704 - DNA, 20 bp, Homo sapiens
cgccccgggcgggtcgcgcc

SEQ ID NO: 57705 - DNA, 21 bp, Homo sapiens
cgccccgggcgggtcgcgccg

SEQ ID NO: 57706 - DNA, 26 bp, Homo sapiens
cgccccgggcgggtcgcgccgtcggg

SEQ ID NO: 57707 - DNA, 27 bp, Homo sapiens
cgccccgggcgggtcgcgccgtcgggc

SEQ ID NO: 57708 - DNA, 25 bp, Homo sapiens
gccccgggcgggtcgcgccgtcggg

SEQ ID NO: 57709 - DNA, 18 bp, Homo sapiens
ccccgggcgggtcgcgcc

SEQ ID NO: 57710 - DNA, 19 bp, Homo sapiens
ccccgggcgggtcgcgccg

SEQ ID NO: 57711 - DNA, 21 bp, Homo sapiens
ccccgggcgggtcgcgccgtc

SEQ ID NO: 57712 - DNA, 24 bp, Homo sapiens
ccccgggcgggtcgcgccgtcggg

SEQ ID NO: 57713 - DNA, 17 bp, Homo sapiens
cccgggcgggtcgcgcc

SEQ ID NO: 57714 - DNA, 24 bp, Homo sapiens
cccgggcgggtcgcgccgtcgggc

SEQ ID NO: 57715 - DNA, 16 bp, Homo sapiens
ccgggcgggtcgcgcc

SEQ ID NO: 57716 - DNA, 22 bp, Homo sapiens
ccgggcgggtcgcgccgtcggg

SEQ ID NO: 57717 - DNA, 23 bp, Homo sapiens
ccgggcgggtcgcgccgtcgggc

SEQ ID NO: 57718 - DNA, 21 bp, Homo sapiens
cgggcgggtcgcgccgtcggg

SEQ ID NO: 57719 - DNA, 22 bp, Homo sapiens
cgggcgggtcgcgccgtcgggc

SEQ ID NO: 57720 - DNA, 23 bp, Homo sapiens
cgggcgggtcgcgccgtcgggcc

SEQ ID NO: 57721 - DNA, 27 bp, Homo sapiens
cgggcgggtcgcgccgtcgggcccggg

SEQ ID NO: 57722 - DNA, 28 bp, Homo sapiens
cgggcgggtcgcgccgtcgggcccgggg

SEQ ID NO: 57723 - DNA, 16 bp, Homo sapiens
gggtcgcgccgtcggg

SEQ ID NO: 57724 - DNA, 17 bp, Homo sapiens
gggtcgcgccgtcgggc

SEQ ID NO: 57725 - DNA, 18 bp, Homo sapiens
cgcgccgtcgggcccggg

SEQ ID NO: 57726 - DNA, 20 bp, Homo sapiens
cgcgccgtcgggcccggggg

SEQ ID NO: 57727 - DNA, 16 bp, Homo sapiens
cgccgtcgggcccggg

SEQ ID NO: 57728 - DNA, 17 bp, Homo sapiens
cgccgtcgggcccgggg

SEQ ID NO: 57729 - DNA, 18 bp, Homo sapiens
cgccgtcgggcccggggg

SEQ ID NO: 57730 - DNA, 21 bp, Homo sapiens
cgccgtcgggcccgggggagg

SEQ ID NO: 57731 - DNA, 20 bp, Homo sapiens
cccccgaagagggggacggc

SEQ ID NO: 57732 - DNA, 21 bp, Homo sapiens
cgcacggggtcggcggcgacg

SEQ ID NO: 57733 - DNA, 25 bp, Homo sapiens
cgcacggggtcggcggcgacgtcgg

SEQ ID NO: 57734 - DNA, 19 bp, Homo sapiens
gcacggggtcggcggcgac

SEQ ID NO: 57735 - DNA, 20 bp, Homo sapiens
gcacggggtcggcggcgacg

SEQ ID NO: 57736 - DNA, 21 bp, Homo sapiens
gcacggggtcggcggcgacgt

SEQ ID NO: 57737 - DNA, 22 bp, Homo sapiens
gcacggggtcggcggcgacgtc

SEQ ID NO: 57738 - DNA, 24 bp, Homo sapiens
gcacggggtcggcggcgacgtcgg

SEQ ID NO: 57739 - DNA, 19 bp, Homo sapiens
cacggggtcggcggcgacg

SEQ ID NO: 57740 - DNA, 20 bp, Homo sapiens
cacggggtcggcggcgacgt

SEQ ID NO: 57741 - DNA, 21 bp, Homo sapiens
cacggggtcggcggcgacgtc

SEQ ID NO: 57742 - DNA, 16 bp, Homo sapiens
cccgccgcgccgggga

SEQ ID NO: 57743 - DNA, 21 bp, Homo sapiens
agcgcacgtgttaggacccga

SEQ ID NO: 57744 - DNA, 20 bp, Homo sapiens
gcgcacgtgttaggacccga

SEQ ID NO: 57745 - DNA, 19 bp, Homo sapiens
cgcacgtgttaggacccga

SEQ ID NO: 57746 - DNA, 25 bp, Homo sapiens
agggcgaagccagaggaaactctgg

SEQ ID NO: 57747 - DNA, 18 bp, Homo sapiens
ccctccgaagtttccctc

SEQ ID NO: 57748 - DNA, 36 bp, Homo sapiens
tttccctcaggatagctggcgctctcgcagacccga

SEQ ID NO: 57749 - DNA, 32 bp, Homo sapiens; identical to SEQ ID NO: 4475

SEQ ID NO: 57750 - DNA, 33 bp, Homo sapiens; identical to SEQ ID NO: 4476

SEQ ID NO: 57751 - DNA, 31 bp, Homo sapiens; identical to SEQ ID NO: 4479

SEQ ID NO: 57752 - DNA, 30 bp, Homo sapiens; identical to SEQ ID NO: 21011

SEQ ID NO: 57753 - DNA, 29 bp, Homo sapiens
caggatagctggcgctctcgcagacccga

SEQ ID NO: 57754 - DNA, 28 bp, Homo sapiens
aggatagctggcgctctcgcagacccga

SEQ ID NO: 57755 - DNA, 24 bp, Homo sapiens
atagctggcgctctcgcagacccg

SEQ ID NO: 57756 - DNA, 25 bp, Homo sapiens
atagctggcgctctcgcagacccga

SEQ ID NO: 57757 - DNA, 26 bp, Homo sapiens
atagctggcgctctcgcagacccgac

SEQ ID NO: 57758 - DNA, 24 bp, Homo sapiens
tagctggcgctctcgcagacccga

SEQ ID NO: 57759 - DNA, 21 bp, Homo sapiens
gctggcgctctcgcagacccg

SEQ ID NO: 57760 - DNA, 22 bp, Homo sapiens
gctggcgctctcgcagacccga

SEQ ID NO: 57761 - DNA, 43 bp, Homo sapiens
cccgccacgcagttttatccggtaaagcgaatgattagaggtc

SEQ ID NO: 57762 - DNA, 58 bp, Homo sapiens
caggacggtggccatggaagtcggaatccgctaaggagtgtgtaacaactcacctgcc

SEQ ID NO: 57763 - DNA, 23 bp, Homo sapiens
ccgcccacgccccgctccccgcc

SEQ ID NO: 57764 - DNA, 22 bp, Homo sapiens
cgcccacgccccgctccccgcc

SEQ ID NO: 57765 - DNA, 32 bp, Homo sapiens; identical to SEQ ID NO: 4742

SEQ ID NO: 57766 - DNA, 33 bp, Homo sapiens; identical to SEQ ID NO: 4743

SEQ ID NO: 57767 - DNA, 40 bp, Homo sapiens
gtagtagcaaatattcaaacgagaactttgaaggccgaag

SEQ ID NO: 57768 - DNA, 39 bp, Homo sapiens
tagtagcaaatattcaaacgagaactttgaaggccgaag

SEQ ID NO: 57769 - DNA, 38 bp, Homo sapiens
agtagcaaatattcaaacgagaactttgaaggccgaag

SEQ ID NO: 57770 - DNA, 37 bp, Homo sapiens
gtagcaaatattcaaacgagaactttgaaggccgaag

SEQ ID NO: 57771 - DNA, 35 bp, Homo sapiens; identical to SEQ ID NO: 22269

SEQ ID NO: 57772 - DNA, 34 bp, Homo sapiens; identical to SEQ ID NO: 22271

SEQ ID NO: 57773 - DNA, 32 bp, Homo sapiens; identical to SEQ ID NO: 4746

SEQ ID NO: 57774 - DNA, 31 bp, Homo sapiens; identical to SEQ ID NO: 4748

SEQ ID NO: 57775 - DNA, 29 bp, Homo sapiens
tattcaaacgagaactttgaaggccgaag

SEQ ID NO: 57776 - DNA, 28 bp, Homo sapiens
attcaaacgagaactttgaaggccgaag

SEQ ID NO: 57777 - DNA, 26 bp, Homo sapiens
tcaaacgagaactttgaaggccgaag

SEQ ID NO: 57778 - DNA, 25 bp, Homo sapiens
caaacgagaactttgaaggccgaag

SEQ ID NO: 57779 - DNA, 24 bp, Homo sapiens
aaacgagaactttgaaggccgaag

SEQ ID NO: 57780 - DNA, 23 bp, Homo sapiens
aacgagaactttgaaggccgaag

SEQ ID NO: 57781 - DNA, 24 bp, Homo sapiens
aacgagaactttgaaggccgaagt

SEQ ID NO: 57782 - DNA, 43 bp, Homo sapiens; identical to SEQ ID NO: 22434

SEQ ID NO: 57783 - DNA, 22 bp, Homo sapiens
acgagaactttgaaggccgaag

SEQ ID NO: 57784 - DNA, 21 bp, Homo sapiens
cgagaactttgaaggccgaag

SEQ ID NO: 57785 - DNA, 27 bp, Homo sapiens
gtcggtcctgagagatgggcgagcgcc

SEQ ID NO: 57786 - DNA, 47 bp, Homo sapiens
ctcggccgatcgaaagggagtcgggttcagatccccgaatccggagt

SEQ ID NO: 57787 - DNA, 48 bp, Homo sapiens
ctcggccgatcgaaagggagtcgggttcagatccccgaatccggagtg

SEQ ID NO: 57788 - DNA, 29 bp, Homo sapiens
gcgaggcgtccagtgcggtaacgcgaccg

SEQ ID NO: 57789 - DNA, 27 bp, Homo sapiens
gtgcggtaacgcgaccgatcccggaga

SEQ ID NO: 57790 - DNA, 28 bp, Homo sapiens
gtgcggtaacgcgaccgatcccggagaa

SEQ ID NO: 57791 - DNA, 16 bp, Homo sapiens
cggcgggagccccggg

SEQ ID NO: 57792 - DNA, 17 bp, Homo sapiens
cggcgggagccccgggg

SEQ ID NO: 57793 - DNA, 18 bp, Homo sapiens
ccccgagagaggggcccg

SEQ ID NO: 57794 - DNA, 17 bp, Homo sapiens
cccgagagaggggcccg

SEQ ID NO: 57795 - DNA, 18 bp, Homo sapiens
cccgagagaggggcccgt

SEQ ID NO: 57796 - DNA, 22 bp, Homo sapiens
cccgagagaggggcccgtgcct

SEQ ID NO: 57797 - DNA, 23 bp, Homo sapiens
cccgagagaggggcccgtgcctt

SEQ ID NO: 57798 - DNA, 24 bp, Homo sapiens
cccgagagaggggcccgtgccttg

SEQ ID NO: 57799 - DNA, 32 bp, Homo sapiens; identical to SEQ ID NO: 5022

SEQ ID NO: 57800 - DNA, 36 bp, Homo sapiens; identical to SEQ ID NO: 23192

SEQ ID NO: 57801 - DNA, 37 bp, Homo sapiens; identical to SEQ ID NO: 23193

SEQ ID NO: 57802 - DNA, 38 bp, Homo sapiens; identical to SEQ ID NO: 23194

SEQ ID NO: 57803 - DNA, 35 bp, Homo sapiens; identical to SEQ ID NO: 23203

SEQ ID NO: 57804 - DNA, 36 bp, Homo sapiens; identical to SEQ ID NO: 23204

SEQ ID NO: 57805 - DNA, 35 bp, Homo sapiens; identical to SEQ ID NO: 23211

SEQ ID NO: 57806 - DNA, 34 bp, Homo sapiens; identical to SEQ ID NO: 23219

SEQ ID NO: 57807 - DNA, 35 bp, Homo sapiens; identical to SEQ ID NO: 23220

SEQ ID NO: 57808 - DNA, 28 bp, Homo sapiens
cggcggcgtccggtgagctctcgctggc

SEQ ID NO: 57809 - DNA, 29 bp, Homo sapiens
cggcggcgtccggtgagctctcgctggcc

SEQ ID NO: 57810 - DNA, 27 bp, Homo sapiens
ggcggcgtccggtgagctctcgctggc

SEQ ID NO: 57811 - DNA, 29 bp, Homo sapiens
ggcggcgtccggtgagctctcgctggccc

SEQ ID NO: 57812 - DNA, 30 bp, Homo sapiens; identical to SEQ ID NO: 5051

SEQ ID NO: 57813 - DNA, 23 bp, Homo sapiens
gcggcgtccggtgagctctcgct

SEQ ID NO: 57814 - DNA, 27 bp, Homo sapiens
gcggcgtccggtgagctctcgctggcc

SEQ ID NO: 57815 - DNA, 28 bp, Homo sapiens
gcggcgtccggtgagctctcgctggccc

SEQ ID NO: 57816 - DNA, 21 bp, Homo sapiens
tccggtgagctctcgctggcc

SEQ ID NO: 57817 - DNA, 22 bp, Homo sapiens
tccggtgagctctcgctggccc

SEQ ID NO: 57818 - DNA, 19 bp, Homo sapiens
ccggtgagctctcgctggc

SEQ ID NO: 57819 - DNA, 20 bp, Homo sapiens
ccggtgagctctcgctggcc

SEQ ID NO: 57820 - DNA, 21 bp, Homo sapiens
ccggtgagctctcgctggccc

SEQ ID NO: 57821 - DNA, 18 bp, Homo sapiens
cggtgagctctcgctggc

SEQ ID NO: 57822 - DNA, 19 bp, Homo sapiens
ggtgagctctcgctggccc

SEQ ID NO: 57823 - DNA, 32 bp, Homo sapiens; identical to SEQ ID NO: 5183

SEQ ID NO: 57824 - DNA, 24 bp, Homo sapiens
aagggctgggtcggtcgggctggg

SEQ ID NO: 57825 - DNA, 25 bp, Homo sapiens
agggctgggtcggtcgggctggggc

SEQ ID NO: 57826 - DNA, 26 bp, Homo sapiens
agggctgggtcggtcgggctggggcg

SEQ ID NO: 57827 - DNA, 28 bp, Homo sapiens
agggctgggtcggtcgggctggggcgcg

SEQ ID NO: 57828 - DNA, 25 bp, Homo sapiens
cggtcgggctggggcgcgaagcggg

SEQ ID NO: 57829 - DNA, 42 bp, Homo sapiens
cggggctgggcgcgcgccgcggctggacgaggcgccgccgcc

SEQ ID NO: 57830 - DNA, 30 bp, Homo sapiens; identical to SEQ ID NO: 24004

SEQ ID NO: 57831 - DNA, 20 bp, Homo sapiens
cgcggctggacgaggcgccg

SEQ ID NO: 57832 - DNA, 21 bp, Homo sapiens
cgcggctggacgaggcgccgc

SEQ ID NO: 57833 - DNA, 22 bp, Homo sapiens
cgcggctggacgaggcgccgcc

SEQ ID NO: 57834 - DNA, 23 bp, Homo sapiens
cgcggctggacgaggcgccgccg

SEQ ID NO: 57835 - DNA, 24 bp, Homo sapiens
cgcggctggacgaggcgccgccgc

SEQ ID NO: 57836 - DNA, 25 bp, Homo sapiens
cgcggctggacgaggcgccgccgcc

SEQ ID NO: 57837 - DNA, 29 bp, Homo sapiens
cgcggctggacgaggcgccgccgcccccc

SEQ ID NO: 57838 - DNA, 30 bp, Homo sapiens
cgcggctggacgaggcgccgccgccccccc

SEQ ID NO: 57839 - DNA, 31 bp, Homo sapiens
cgcggctggacgaggcgccgccgcccccccc

SEQ ID NO: 57840 - DNA, 40 bp, Homo sapiens
cgcggctggacgaggcgccgccgccccccccacgcccggg

SEQ ID NO: 57841 - DNA, 41 bp, Homo sapiens
cgcggctggacgaggcgccgccgccccccccacgcccgggg

SEQ ID NO: 57842 - DNA, 20 bp, Homo sapiens
ctggacgaggcgccgccgcc

SEQ ID NO: 57843 - DNA, 36 bp, Homo sapiens
ctggacgaggcgccgccgccccccccacgcccgggg

SEQ ID NO: 57844 - DNA, 18 bp, Homo sapiens
ggacgaggcgccgccgcc

SEQ ID NO: 57845 - DNA, 25 bp, Homo sapiens
cgccgccgccccccccacgcccggg

SEQ ID NO: 57846 - DNA, 26 bp, Homo sapiens
cgccgccgccccccccacgcccgggg

SEQ ID NO: 57847 - DNA, 22 bp, Homo sapiens
cgccgccccccccacgcccggg

SEQ ID NO: 57848 - DNA, 23 bp, Homo sapiens
cgccgccccccccacgcccgggg

SEQ ID NO: 57849 - DNA, 25 bp, Homo sapiens
ccccgccccaccccgcgcgcgccgc

SEQ ID NO: 57850 - DNA, 23 bp, Homo sapiens
cccgccccaccccgcgcgcgccg

SEQ ID NO: 57851 - DNA, 24 bp, Homo sapiens
cccgccccaccccgcgcgcgccgc

SEQ ID NO: 57852 - DNA, 25 bp, Homo sapiens
cccgccccaccccgcgcgcgccgct

SEQ ID NO: 57853 - DNA, 28 bp, Homo sapiens
cccgccccaccccgcgcgcgccgctcgc

SEQ ID NO: 57854 - DNA, 23 bp, Homo sapiens
ccgccccaccccgcgcgcgccgc

SEQ ID NO: 57855 - DNA, 22 bp, Homo sapiens
cgccccaccccgcgcgcgccgc

SEQ ID NO: 57856 - DNA, 23 bp, Homo sapiens
cgccccaccccgcgcgcgccgct

SEQ ID NO: 57857 - DNA, 40 bp, Homo sapiens
cgcgtgggggcggcggcggggggagaagggtcggggcggc

SEQ ID NO: 57858 - DNA, 22 bp, Homo sapiens
cggcggcggcccgccgcggggc

SEQ ID NO: 57859 - DNA, 21 bp, Homo sapiens
ggcggcggcccgccgcggggc

SEQ ID NO: 57860 - DNA, 16 bp, Homo sapiens
cggcccgccgcggggc

SEQ ID NO: 57861 - DNA, 17 bp, Homo sapiens
cccgccgcggggccccg

SEQ ID NO: 57862 - DNA, 42 bp, Homo sapiens
cggcggcgggggcacggtcccccgcgaggggggcccgggcac

SEQ ID NO: 57863 - DNA, 26 bp, Homo sapiens
cggtcccccgcgaggggggcccgggc

SEQ ID NO: 57864 - DNA, 20 bp, Homo sapiens
cccccgcgaggggggcccgg

SEQ ID NO: 57865 - DNA, 21 bp, Homo sapiens
cccccgcgaggggggcccggg

SEQ ID NO: 57866 - DNA, 22 bp, Homo sapiens
cccccgcgaggggggcccgggc

SEQ ID NO: 57867 - DNA, 23 bp, Homo sapiens
cccccgcgaggggggcccgggca

SEQ ID NO: 57868 - DNA, 24 bp, Homo sapiens
cccccgcgaggggggcccgggcac

SEQ ID NO: 57869 - DNA, 25 bp, Homo sapiens
cccccgcgaggggggcccgggcacc

SEQ ID NO: 57870 - DNA, 16 bp, Homo sapiens
ccccgcgaggggggcc

SEQ ID NO: 57871 - DNA, 18 bp, Homo sapiens
ccccgcgaggggggcccg

SEQ ID NO: 57872 - DNA, 19 bp, Homo sapiens
ccccgcgaggggggcccgg

SEQ ID NO: 57873 - DNA, 20 bp, Homo sapiens
ccccgcgaggggggcccggg

SEQ ID NO: 57874 - DNA, 21 bp, Homo sapiens
ccccgcgaggggggcccgggc

SEQ ID NO: 57875 - DNA, 22 bp, Homo sapiens
ccccgcgaggggggcccgggca

SEQ ID NO: 57876 - DNA, 23 bp, Homo sapiens
ccccgcgaggggggcccgggcac

SEQ ID NO: 57877 - DNA, 24 bp, Homo sapiens
ccccgcgaggggggcccgggcacc

SEQ ID NO: 57878 - DNA, 16 bp, Homo sapiens
cccgcgaggggggccc

SEQ ID NO: 57879 - DNA, 17 bp, Homo sapiens
cccgcgaggggggcccg

SEQ ID NO: 57880 - DNA, 18 bp, Homo sapiens
cccgcgaggggggcccgg

SEQ ID NO: 57881 - DNA, 19 bp, Homo sapiens
cccgcgaggggggcccggg

SEQ ID NO: 57882 - DNA, 20 bp, Homo sapiens
cccgcgaggggggcccgggc

SEQ ID NO: 57883 - DNA, 21 bp, Homo sapiens
cccgcgaggggggcccgggca

SEQ ID NO: 57884 - DNA, 22 bp, Homo sapiens
cccgcgaggggggcccgggcac

SEQ ID NO: 57885 - DNA, 23 bp, Homo sapiens
cccgcgaggggggcccgggcacc

SEQ ID NO: 57886 - DNA, 24 bp, Homo sapiens
cccgcgaggggggcccgggcaccc

SEQ ID NO: 57887 - DNA, 25 bp, Homo sapiens
cccgcgaggggggcccgggcacccg

SEQ ID NO: 57888 - DNA, 31 bp, Homo sapiens
cccgcgaggggggcccgggcacccggggggc

SEQ ID NO: 57889 - DNA, 18 bp, Homo sapiens
ccgcgaggggggcccggg

SEQ ID NO: 57890 - DNA, 19 bp, Homo sapiens
ccgcgaggggggcccgggc

SEQ ID NO: 57891 - DNA, 20 bp, Homo sapiens
ccgcgaggggggcccgggca

SEQ ID NO: 57892 - DNA, 21 bp, Homo sapiens
ccgcgaggggggcccgggcac

SEQ ID NO: 57893 - DNA, 22 bp, Homo sapiens
ccgcgaggggggcccgggcacc

SEQ ID NO: 57894 - DNA, 17 bp, Homo sapiens
cgcgaggggggcccggg

SEQ ID NO: 57895 - DNA, 18 bp, Homo sapiens
cgcgaggggggcccgggc

SEQ ID NO: 57896 - DNA, 17 bp, Homo sapiens
gcgaggggggcccgggc

SEQ ID NO: 57897 - DNA, 16 bp, Homo sapiens
cgaggggggcccgggc

SEQ ID NO: 57898 - DNA, 44 bp, Homo sapiens
cggggggccggcggcggcggcgactctggacgcgagccgggccc

SEQ ID NO: 57899 - DNA, 35 bp, Homo sapiens
ccggcggcggcggcgactctggacgcgagccgggc

SEQ ID NO: 57900 - DNA, 37 bp, Homo sapiens; identical to SEQ ID NO: 24200

SEQ ID NO: 57901 - DNA, 25 bp, Homo sapiens
cggcggcggcggcgactctggacgc

SEQ ID NO: 57902 - DNA, 26 bp, Homo sapiens
cggcggcggcggcgactctggacgcg

SEQ ID NO: 57903 - DNA, 27 bp, Homo sapiens
cggcggcggcggcgactctggacgcga

SEQ ID NO: 57904 - DNA, 28 bp, Homo sapiens
cggcggcggcggcgactctggacgcgag

SEQ ID NO: 57905 - DNA, 29 bp, Homo sapiens
cggcggcggcggcgactctggacgcgagc

SEQ ID NO: 57906 - DNA, 30 bp, Homo sapiens; identical to SEQ ID NO: 30385

SEQ ID NO: 57907 - DNA, 31 bp, Homo sapiens
cggcggcggcggcgactctggacgcgagccg

SEQ ID NO: 57908 - DNA, 33 bp, Homo sapiens; identical to SEQ ID NO: 24202

SEQ ID NO: 57909 - DNA, 34 bp, Homo sapiens
cggcggcggcggcgactctggacgcgagccgggc

SEQ ID NO: 57910 - DNA, 35 bp, Homo sapiens
cggcggcggcggcgactctggacgcgagccgggcc

SEQ ID NO: 57911 - DNA, 36 bp, Homo sapiens
cggcggcggcggcgactctggacgcgagccgggccc

SEQ ID NO: 57912 - DNA, 37 bp, Homo sapiens
cggcggcggcggcgactctggacgcgagccgggccct

SEQ ID NO: 57913 - DNA, 24 bp, Homo sapiens
ggcggcggcggcgactctggacgc

SEQ ID NO: 57914 - DNA, 25 bp, Homo sapiens
ggcggcggcggcgactctggacgcg

SEQ ID NO: 57915 - DNA, 26 bp, Homo sapiens
ggcggcggcggcgactctggacgcga

SEQ ID NO: 57916 - DNA, 28 bp, Homo sapiens
ggcggcggcggcgactctggacgcgagc

SEQ ID NO: 57917 - DNA, 32 bp, Homo sapiens; identical to SEQ ID NO: 24206

SEQ ID NO: 57918 - DNA, 33 bp, Homo sapiens; identical to SEQ ID NO: 24207

SEQ ID NO: 57919 - DNA, 34 bp, Homo sapiens
ggcggcggcggcgactctggacgcgagccgggcc

SEQ ID NO: 57920 - DNA, 35 bp, Homo sapiens
ggcggcggcggcgactctggacgcgagccgggccc

SEQ ID NO: 57921 - DNA, 36 bp, Homo sapiens
ggcggcggcggcgactctggacgcgagccgggccct

SEQ ID NO: 57922 - DNA, 33 bp, Homo sapiens; identical to SEQ ID NO: 5252

SEQ ID NO: 57923 - DNA, 34 bp, Homo sapiens; identical to SEQ ID NO: 24215

SEQ ID NO: 57924 - DNA, 35 bp, Homo sapiens; identical to SEQ ID NO: 24216

SEQ ID NO: 57925 - DNA, 36 bp, Homo sapiens
gcggcggcggcgactctggacgcgagccgggccctt

SEQ ID NO: 57926 - DNA, 45 bp, Homo sapiens; identical to SEQ ID NO: 24217

SEQ ID NO: 57927 - DNA, 22 bp, Homo sapiens
cggcggcggcgactctggacgc

SEQ ID NO: 57928 - DNA, 23 bp, Homo sapiens
cggcggcggcgactctggacgcg

SEQ ID NO: 57929 - DNA, 24 bp, Homo sapiens
cggcggcggcgactctggacgcga

SEQ ID NO: 57930 - DNA, 26 bp, Homo sapiens
cggcggcggcgactctggacgcgagc

SEQ ID NO: 57931 - DNA, 27 bp, Homo sapiens
cggcggcggcgactctggacgcgagcc

SEQ ID NO: 57932 - DNA, 28 bp, Homo sapiens
cggcggcggcgactctggacgcgagccg

SEQ ID NO: 57933 - DNA, 30 bp, Homo sapiens; identical to SEQ ID NO: 24223

SEQ ID NO: 57934 - DNA, 31 bp, Homo sapiens; identical to SEQ ID NO: 24224

SEQ ID NO: 57935 - DNA, 32 bp, Homo sapiens; identical to SEQ ID NO: 5253

SEQ ID NO: 57936 - DNA, 33 bp, Homo sapiens; identical to SEQ ID NO: 5254

SEQ ID NO: 57937 - DNA, 34 bp, Homo sapiens; identical to SEQ ID NO: 24227

SEQ ID NO: 57938 - DNA, 21 bp, Homo sapiens
ggcggcggcgactctggacgc

SEQ ID NO: 57939 - DNA, 25 bp, Homo sapiens
ggcggcggcgactctggacgcgagc

SEQ ID NO: 57940 - DNA, 27 bp, Homo sapiens
ggcggcggcgactctggacgcgagccg

SEQ ID NO: 57941 - DNA, 29 bp, Homo sapiens
ggcggcggcgactctggacgcgagccggg

SEQ ID NO: 57942 - DNA, 30 bp, Homo sapiens; identical to SEQ ID NO: 50479

SEQ ID NO: 57943 - DNA, 31 bp, Homo sapiens; identical to SEQ ID NO: 24232

SEQ ID NO: 57944 - DNA, 32 bp, Homo sapiens; identical to SEQ ID NO: 5255

SEQ ID NO: 57945 - DNA, 33 bp, Homo sapiens; identical to SEQ ID NO: 5256

SEQ ID NO: 57946 - DNA, 26 bp, Homo sapiens
gcggcggcgactctggacgcgagccg

SEQ ID NO: 57947 - DNA, 30 bp, Homo sapiens; identical to SEQ ID NO: 5257

SEQ ID NO: 57948 - DNA, 31 bp, Homo sapiens; identical to SEQ ID NO: 5258

SEQ ID NO: 57949 - DNA, 32 bp, Homo sapiens; identical to SEQ ID NO: 5259

SEQ ID NO: 57950 - DNA, 19 bp, Homo sapiens
cggcggcgactctggacgc

SEQ ID NO: 57951 - DNA, 23 bp, Homo sapiens
cggcggcgactctggacgcgagc

SEQ ID NO: 57952 - DNA, 27 bp, Homo sapiens
cggcggcgactctggacgcgagccggg

SEQ ID NO: 57953 - DNA, 29 bp, Homo sapiens
cggcggcgactctggacgcgagccgggcc

SEQ ID NO: 57954 - DNA, 30 bp, Homo sapiens; identical to SEQ ID NO: 5260

SEQ ID NO: 57955 - DNA, 31 bp, Homo sapiens; identical to SEQ ID NO: 5261

SEQ ID NO: 57956 - DNA, 22 bp, Homo sapiens
ggcggcgactctggacgcgagc

SEQ ID NO: 57957 - DNA, 28 bp, Homo sapiens
ggcggcgactctggacgcgagccgggcc

SEQ ID NO: 57958 - DNA, 29 bp, Homo sapiens
ggcggcgactctggacgcgagccgggccc

SEQ ID NO: 57959 - DNA, 30 bp, Homo sapiens; identical to SEQ ID NO: 24263

SEQ ID NO: 57960 - DNA, 27 bp, Homo sapiens
gcggcgactctggacgcgagccgggcc

SEQ ID NO: 57961 - DNA, 28 bp, Homo sapiens
gcggcgactctggacgcgagccgggccc

SEQ ID NO: 57962 - DNA, 29 bp, Homo sapiens
gcggcgactctggacgcgagccgggccct

SEQ ID NO: 57963 - DNA, 30 bp, Homo sapiens; identical to SEQ ID NO: 5266

SEQ ID NO: 57964 - DNA, 26 bp, Homo sapiens
cggcgactctggacgcgagccgggcc

SEQ ID NO: 57965 - DNA, 27 bp, Homo sapiens
cggcgactctggacgcgagccgggccc

SEQ ID NO: 57966 - DNA, 28 bp, Homo sapiens
cggcgactctggacgcgagccgggccct

SEQ ID NO: 57967 - DNA, 27 bp, Homo sapiens
ggcgactctggacgcgagccgggccct

SEQ ID NO: 57968 - DNA, 18 bp, Homo sapiens
gcgactctggacgcgagc

SEQ ID NO: 57969 - DNA, 23 bp, Homo sapiens
gcgactctggacgcgagccgggc

SEQ ID NO: 57970 - DNA, 24 bp, Homo sapiens
gcgactctggacgcgagccgggcc

SEQ ID NO: 57971 - DNA, 25 bp, Homo sapiens
gcgactctggacgcgagccgggccc

SEQ ID NO: 57972 - DNA, 26 bp, Homo sapiens
gcgactctggacgcgagccgggccct

SEQ ID NO: 57973 - DNA, 24 bp, Homo sapiens
cgactctggacgcgagccgggccc

SEQ ID NO: 57974 - DNA, 25 bp, Homo sapiens
cgactctggacgcgagccgggccct

SEQ ID NO: 57975 - DNA, 23 bp, Homo sapiens
actctggacgcgagccgggccct

SEQ ID NO: 57976 - DNA, 20 bp, Homo sapiens
ctctggacgcgagccgggcc

SEQ ID NO: 57977 - DNA, 21 bp, Homo sapiens
ctctggacgcgagccgggccc

SEQ ID NO: 57978 - DNA, 19 bp, Homo sapiens
tctggacgcgagccgggcc

SEQ ID NO: 57979 - DNA, 20 bp, Homo sapiens
tctggacgcgagccgggccc

SEQ ID NO: 57980 - DNA, 21 bp, Homo sapiens
tctggacgcgagccgggccct

SEQ ID NO: 57981 - DNA, 18 bp, Homo sapiens
ctggacgcgagccgggcc

SEQ ID NO: 57982 - DNA, 19 bp, Homo sapiens
ctggacgcgagccgggccc

SEQ ID NO: 57983 - DNA, 20 bp, Homo sapiens
ctggacgcgagccgggccct

SEQ ID NO: 57984 - DNA, 30 bp, Homo sapiens; identical to SEQ ID NO: 5285

SEQ ID NO: 57985 - DNA, 16 bp, Homo sapiens
ggacgcgagccgggcc

SEQ ID NO: 57986 - DNA, 29 bp, Homo sapiens
gccgggcccttcccgtggatcgccccagc

SEQ ID NO: 57987 - DNA, 18 bp, Homo sapiens
cccgtggatcgccccagc

SEQ ID NO: 57988 - DNA, 21 bp, Homo sapiens
cccgtggatcgccccagctgc

SEQ ID NO: 57989 - DNA, 17 bp, Homo sapiens
ccgtggatcgccccagc

SEQ ID NO: 57990 - DNA, 19 bp, Homo sapiens
cgccccagctgcggcgggc

SEQ ID NO: 57991 - DNA, 38 bp, Homo sapiens
cgccccagctgcggcgggcgtcgcggccgcccccgggg

SEQ ID NO: 57992 - DNA, 19 bp, Homo sapiens
cggcgggcgtcgcggccgc

SEQ ID NO: 57993 - DNA, 18 bp, Homo sapiens
ggcgggcgtcgcggccgc

SEQ ID NO: 57994 - DNA, 20 bp, Homo sapiens
cgtcgcggccgcccccgggg

SEQ ID NO: 57995 - DNA, 35 bp, Homo sapiens
gtcgcggccgcccccggggagcccggcgggcgccg

SEQ ID NO: 57996 - DNA, 29 bp, Homo sapiens
tcgcggccgcccccggggagcccggcggg

SEQ ID NO: 57997 - DNA, 16 bp, Homo sapiens
cgcggccgcccccggg

SEQ ID NO: 57998 - DNA, 17 bp, Homo sapiens
cgcggccgcccccgggg

SEQ ID NO: 57999 - DNA, 27 bp, Homo sapiens
cgcggccgcccccggggagcccggcgg

SEQ ID NO: 58000 - DNA, 28 bp, Homo sapiens
cgcggccgcccccggggagcccggcggg

SEQ ID NO: 58001 - DNA, 29 bp, Homo sapiens
cgcggccgcccccggggagcccggcgggc

SEQ ID NO: 58002 - DNA, 16 bp, Homo sapiens
gcggccgcccccgggg

SEQ ID NO: 58003 - DNA, 17 bp, Homo sapiens
gcggccgcccccgggga

SEQ ID NO: 58004 - DNA, 27 bp, Homo sapiens
gcggccgcccccggggagcccggcggg

SEQ ID NO: 58005 - DNA, 23 bp, Homo sapiens
cggccgcccccggggagcccggc

SEQ ID NO: 58006 - DNA, 25 bp, Homo sapiens
cggccgcccccggggagcccggcgg

SEQ ID NO: 58007 - DNA, 26 bp, Homo sapiens
cggccgcccccggggagcccggcggg

SEQ ID NO: 58008 - DNA, 27 bp, Homo sapiens
cggccgcccccggggagcccggcgggc

SEQ ID NO: 58009 - DNA, 25 bp, Homo sapiens
ggccgcccccggggagcccggcggg

SEQ ID NO: 58010 - DNA, 30 bp, Homo sapiens
ccgcccccggggagcccggcgggcgccggc

SEQ ID NO: 58011 - DNA, 29 bp, Homo sapiens
cgcccccggggagcccggcgggcgccggc

SEQ ID NO: 58012 - DNA, 21 bp, Homo sapiens
cccccggggagcccggcgggc

SEQ ID NO: 58013 - DNA, 22 bp, Homo sapiens
cccccggggagcccggcgggcg

SEQ ID NO: 58014 - DNA, 20 bp, Homo sapiens
ccccggggagcccggcgggc

SEQ ID NO: 58015 - DNA, 21 bp, Homo sapiens
ccccggggagcccggcgggcg

SEQ ID NO: 58016 - DNA, 26 bp, Homo sapiens
ccccggggagcccggcgggcgccggc

SEQ ID NO: 58017 - DNA, 27 bp, Homo sapiens
ccccggggagcccggcgggcgccggcg

SEQ ID NO: 58018 - DNA, 18 bp, Homo sapiens
cccggggagcccggcggg

SEQ ID NO: 58019 - DNA, 19 bp, Homo sapiens
cccggggagcccggcgggc

SEQ ID NO: 58020 - DNA, 20 bp, Homo sapiens
cccggggagcccggcgggcg

SEQ ID NO: 58021 - DNA, 25 bp, Homo sapiens
cccggggagcccggcgggcgccggc

SEQ ID NO: 58022 - DNA, 26 bp, Homo sapiens
cccggggagcccggcgggcgccggcg

SEQ ID NO: 58023 - DNA, 18 bp, Homo sapiens
ccggggagcccggcgggc

SEQ ID NO: 58024 - DNA, 24 bp, Homo sapiens
ccggggagcccggcgggcgccggc

SEQ ID NO: 58025 - DNA, 16 bp, Homo sapiens
cggggagcccggcggg

SEQ ID NO: 58026 - DNA, 17 bp, Homo sapiens
cggggagcccggcgggc

SEQ ID NO: 58027 - DNA, 23 bp, Homo sapiens
cggggagcccggcgggcgccggc

SEQ ID NO: 58028 - DNA, 16 bp, Homo sapiens
ggggagcccggcgggc

SEQ ID NO: 58029 - DNA, 17 bp, Homo sapiens
cccggcgggcgccggcg

SEQ ID NO: 58030 - DNA, 21 bp, Homo sapiens
cccggcgggcgccggcgcgcc

SEQ ID NO: 58031 - DNA, 22 bp, Homo sapiens
cccggcgggcgccggcgcgccc

SEQ ID NO: 58032 - DNA, 23 bp, Homo sapiens
cccggcgggcgccggcgcgcccc

SEQ ID NO: 58033 - DNA, 24 bp, Homo sapiens
cccggcgggcgccggcgcgccccc

SEQ ID NO: 58034 - DNA, 25 bp, Homo sapiens
cccggcgggcgccggcgcgcccccc

SEQ ID NO: 58035 - DNA, 18 bp, Homo sapiens
cggcgggcgccggcgcgc

SEQ ID NO: 58036 - DNA, 19 bp, Homo sapiens
cggcgggcgccggcgcgcc

SEQ ID NO: 58037 - DNA, 20 bp, Homo sapiens
ccaccccacgtctcgtcgcg

SEQ ID NO: 58038 - DNA, 22 bp, Homo sapiens
ccaccccacgtctcgtcgcgcg

SEQ ID NO: 58039 - DNA, 24 bp, Homo sapiens
acgtctcgtcgcgcgcgcgtccgc

SEQ ID NO: 58040 - DNA, 25 bp, Homo sapiens
acgtctcgtcgcgcgcgcgtccgct

SEQ ID NO: 58041 - DNA, 18 bp, Homo sapiens
cgggcggcggcggtcggc

SEQ ID NO: 58042 - DNA, 33 bp, Homo sapiens
cgggcggcggcggtcggcgggcggcggggcggg

SEQ ID NO: 58043 - DNA, 34 bp, Homo sapiens
cgggcggcggcggtcggcgggcggcggggcgggg

SEQ ID NO: 58044 - DNA, 17 bp, Homo sapiens
gggcggcggcggtcggc

SEQ ID NO: 58045 - DNA, 21 bp, Homo sapiens
gggcggcggcggtcggcgggc

SEQ ID NO: 58046 - DNA, 26 bp, Homo sapiens
cggcggtcggcgggcggcggggcggg

SEQ ID NO: 58047 - DNA, 23 bp, Homo sapiens
cggtcggcgggcggcggggcggg

SEQ ID NO: 58048 - DNA, 24 bp, Homo sapiens
cggtcggcgggcggcggggcgggg

SEQ ID NO: 58049 - DNA, 19 bp, Homo sapiens
cccgccctacccccccggc

SEQ ID NO: 58050 - DNA, 20 bp, Homo sapiens
cccgccctacccccccggcc

SEQ ID NO: 58051 - DNA, 19 bp, Homo sapiens
ccgccctacccccccggcc

SEQ ID NO: 58052 - DNA, 17 bp, Homo sapiens
cgccctacccccccggc

SEQ ID NO: 58053 - DNA, 18 bp, Homo sapiens
cgccctacccccccggcc

SEQ ID NO: 58054 - DNA, 21 bp, Homo sapiens
cgccctacccccccggccccg

SEQ ID NO: 58055 - DNA, 23 bp, Homo sapiens
cgccctacccccccggccccgtc

SEQ ID NO: 58056 - DNA, 19 bp, Homo sapiens
ccccccggccccgtccgcc

SEQ ID NO: 58057 - DNA, 20 bp, Homo sapiens
ccccccggccccgtccgccc

SEQ ID NO: 58058 - DNA, 27 bp, Homo sapiens
ccccggccccgtccgccccccgttccc

SEQ ID NO: 58059 - DNA, 25 bp, Homo sapiens
cccggccccgtccgccccccgttcc

SEQ ID NO: 58060 - DNA, 26 bp, Homo sapiens
cccggccccgtccgccccccgttccc

SEQ ID NO: 58061 - DNA, 27 bp, Homo sapiens
cccggccccgtccgccccccgttcccc

SEQ ID NO: 58062 - DNA, 25 bp, Homo sapiens
ccggccccgtccgccccccgttccc

SEQ ID NO: 58063 - DNA, 26 bp, Homo sapiens
ccggccccgtccgccccccgttcccc

SEQ ID NO: 58064 - DNA, 24 bp, Homo sapiens
cggccccgtccgccccccgttccc

SEQ ID NO: 58065 - DNA, 25 bp, Homo sapiens
cggccccgtccgccccccgttcccc

SEQ ID NO: 58066 - DNA, 17 bp, Homo sapiens
cggcgcgcggcggcggc

SEQ ID NO: 58067 - DNA, 17 bp, Homo sapiens
cccccggggccgcggtt

SEQ ID NO: 58068 - DNA, 18 bp, Homo sapiens
cccccggggccgcggttc

SEQ ID NO: 58069 - DNA, 29 bp, Homo sapiens
cgcggttccgcgcggcgcctcgcctcggc

SEQ ID NO: 58070 - DNA, 21 bp, Homo sapiens
cgcgcggcgcctcgcctcggc

SEQ ID NO: 58071 - DNA, 25 bp, Homo sapiens
cgcgcggcgcctcgcctcggccggc

SEQ ID NO: 58072 - DNA, 20 bp, Homo sapiens
gcgcggcgcctcgcctcggc

SEQ ID NO: 58073 - DNA, 24 bp, Homo sapiens
gcgcggcgcctcgcctcggccggc

SEQ ID NO: 58074 - DNA, 19 bp, Homo sapiens
cgcggcgcctcgcctcggc

SEQ ID NO: 58075 - DNA, 21 bp, Homo sapiens
cgcggcgcctcgcctcggccg

SEQ ID NO: 58076 - DNA, 22 bp, Homo sapiens
cgcggcgcctcgcctcggccgg

SEQ ID NO: 58077 - DNA, 23 bp, Homo sapiens
cgcggcgcctcgcctcggccggc

SEQ ID NO: 58078 - DNA, 24 bp, Homo sapiens
cgcggcgcctcgcctcggccggcg

SEQ ID NO: 58079 - DNA, 17 bp, Homo sapiens
cggcgcctcgcctcggc

SEQ ID NO: 58080 - DNA, 18 bp, Homo sapiens
cggcgcctcgcctcggcc

SEQ ID NO: 58081 - DNA, 21 bp, Homo sapiens
cggcgcctcgcctcggccggc

SEQ ID NO: 58082 - DNA, 42 bp, Homo sapiens; identical to SEQ ID NO: 24810

SEQ ID NO: 58083 - DNA, 44 bp, Homo sapiens; identical to SEQ ID NO: 24811

SEQ ID NO: 58084 - DNA, 28 bp, Homo sapiens
aactggtgcggaccaggggaatccgact

SEQ ID NO: 58085 - DNA, 31 bp, Homo sapiens; identical to SEQ ID NO: 5430

SEQ ID NO: 58086 - DNA, 20 bp, Homo sapiens
actggtgcggaccaggggaa

SEQ ID NO: 58087 - DNA, 21 bp, Homo sapiens
actggtgcggaccaggggaat

SEQ ID NO: 58088 - DNA, 22 bp, Homo sapiens
actggtgcggaccaggggaatc

SEQ ID NO: 58089 - DNA, 23 bp, Homo sapiens
actggtgcggaccaggggaatcc

SEQ ID NO: 58090 - DNA, 24 bp, Homo sapiens
actggtgcggaccaggggaatccg

SEQ ID NO: 58091 - DNA, 25 bp, Homo sapiens
actggtgcggaccaggggaatccga

SEQ ID NO: 58092 - DNA, 27 bp, Homo sapiens
ggtgcggaccaggggaatccgactgtt

SEQ ID NO: 58093 - DNA, 21 bp, Homo sapiens
gaccaggggaatccgactgtt

SEQ ID NO: 58094 - DNA, 22 bp, Homo sapiens
atgtcaaagtgaagaaattcaa

SEQ ID NO: 58095 - DNA, 29 bp, Homo sapiens
atgagaggtgtagaataagtgggaggccc

SEQ ID NO: 58096 - DNA, 28 bp, Homo sapiens
tgagaggtgtagaataagtgggaggccc

SEQ ID NO: 58097 - DNA, 27 bp, Homo sapiens
gagaggtgtagaataagtgggaggccc

SEQ ID NO: 58098 - DNA, 26 bp, Homo sapiens
agaggtgtagaataagtgggaggccc

SEQ ID NO: 58099 - DNA, 25 bp, Homo sapiens
gaggtgtagaataagtgggaggccc

SEQ ID NO: 58100 - DNA, 42 bp, Homo sapiens
ccggcgcccccccggtgtccccgcgaggggcccggggcgggg

SEQ ID NO: 58101 - DNA, 41 bp, Homo sapiens
cggcgcccccccggtgtccccgcgaggggcccggggcgggg

SEQ ID NO: 58102 - DNA, 19 bp, Homo sapiens
ccccgcgaggggcccgggg

SEQ ID NO: 58103 - DNA, 20 bp, Homo sapiens
ccccgcgaggggcccggggc

SEQ ID NO: 58104 - DNA, 24 bp, Homo sapiens
ccccgcgaggggcccggggcgggg

SEQ ID NO: 58105 - DNA, 23 bp, Homo sapiens
cccggggcggggtccgccggccc

SEQ ID NO: 58106 - DNA, 30 bp, Homo sapiens; identical to SEQ ID NO: 5852

SEQ ID NO: 58107 - DNA, 31 bp, Homo sapiens; identical to SEQ ID NO: 26227

SEQ ID NO: 58108 - DNA, 24 bp, Homo sapiens
ggccgccggtgaaataccactact

SEQ ID NO: 58109 - DNA, 28 bp, Homo sapiens
ggccgccggtgaaataccactactctga

SEQ ID NO: 58110 - DNA, 29 bp, Homo sapiens
ggccgccggtgaaataccactactctgat

SEQ ID NO: 58111 - DNA, 23 bp, Homo sapiens
gccgccggtgaaataccactact

SEQ ID NO: 58112 - DNA, 26 bp, Homo sapiens
gccgccggtgaaataccactactctg

SEQ ID NO: 58113 - DNA, 27 bp, Homo sapiens
gccgccggtgaaataccactactctga

SEQ ID NO: 58114 - DNA, 28 bp, Homo sapiens
gccgccggtgaaataccactactctgat

SEQ ID NO: 58115 - DNA, 29 bp, Homo sapiens
gccgccggtgaaataccactactctgatc

SEQ ID NO: 58116 - DNA, 30 bp, Homo sapiens; identical to SEQ ID NO: 5864

SEQ ID NO: 58117 - DNA, 40 bp, Homo sapiens
gccgccggtgaaataccactactctgatcgttttttcact

SEQ ID NO: 58118 - DNA, 33 bp, Homo sapiens; identical to SEQ ID NO: 26289

SEQ ID NO: 58119 - DNA, 36 bp, Homo sapiens; identical to SEQ ID NO: 26331

SEQ ID NO: 58120 - DNA, 35 bp, Homo sapiens; identical to SEQ ID NO: 26342

SEQ ID NO: 58121 - DNA, 25 bp, Homo sapiens
ccgaggggctctcgcttctggcgcc

SEQ ID NO: 58122 - DNA, 34 bp, Homo sapiens; identical to SEQ ID NO: 26359

SEQ ID NO: 58123 - DNA, 37 bp, Homo sapiens; identical to SEQ ID NO: 26362

SEQ ID NO: 58124 - DNA, 35 bp, Homo sapiens; identical to SEQ ID NO: 26374

SEQ ID NO: 58125 - DNA, 33 bp, Homo sapiens; identical to SEQ ID NO: 5885

SEQ ID NO: 58126 - DNA, 34 bp, Homo sapiens; identical to SEQ ID NO: 26382

SEQ ID NO: 58127 - DNA, 35 bp, Homo sapiens; identical to SEQ ID NO: 26383

SEQ ID NO: 58128 - DNA, 36 bp, Homo sapiens
aggggctctcgcttctggcgccaagcgcccggccgc

SEQ ID NO: 58129 - DNA, 33 bp, Homo sapiens; identical to SEQ ID NO: 5886

SEQ ID NO: 58130 - DNA, 34 bp, Homo sapiens
ggggctctcgcttctggcgccaagcgcccggccg

SEQ ID NO: 58131 - DNA, 27 bp, Homo sapiens
tctcgcttctggcgccaagcgcccggc

SEQ ID NO: 58132 - DNA, 25 bp, Homo sapiens
ctcgcttctggcgccaagcgcccgg

SEQ ID NO: 58133 - DNA, 26 bp, Homo sapiens
ctcgcttctggcgccaagcgcccggc

SEQ ID NO: 58134 - DNA, 24 bp, Homo sapiens
cgcttctggcgccaagcgcccggc

SEQ ID NO: 58135 - DNA, 19 bp, Homo sapiens
tggcgccaagcgcccggcc

SEQ ID NO: 58136 - DNA, 24 bp, Homo sapiens
cggccgggcgcgacccgctccggg

SEQ ID NO: 58137 - DNA, 27 bp, Homo sapiens
cggccgggcgcgacccgctccggggac

SEQ ID NO: 58138 - DNA, 23 bp, Homo sapiens
accatctgtgggattatgactga

SEQ ID NO: 58139 - DNA, 23 bp, Homo sapiens
tgtgggattatgactgaacgcct

SEQ ID NO: 58140 - DNA, 40 bp, Homo sapiens; identical to SEQ ID NO: 27768

SEQ ID NO: 58141 - DNA, 41 bp, Homo sapiens
gcagcgccgcggagcctcggttggcctcggatagccggtcc

SEQ ID NO: 58142 - DNA, 42 bp, Homo sapiens
gcagcgccgcggagcctcggttggcctcggatagccggtccc

SEQ ID NO: 58143 - DNA, 44 bp, Homo sapiens
gcagcgccgcggagcctcggttggcctcggatagccggtccccc

SEQ ID NO: 58144 - DNA, 46 bp, Homo sapiens
gcagcgccgcggagcctcggttggcctcggatagccggtcccccgc

SEQ ID NO: 58145 - DNA, 47 bp, Homo sapiens
gcagcgccgcggagcctcggttggcctcggatagccggtcccccgcc

SEQ ID NO: 58146 - DNA, 39 bp, Homo sapiens; identical to SEQ ID NO: 27772

SEQ ID NO: 58147 - DNA, 40 bp, Homo sapiens
cagcgccgcggagcctcggttggcctcggatagccggtcc

SEQ ID NO: 58148 - DNA, 41 bp, Homo sapiens
cagcgccgcggagcctcggttggcctcggatagccggtccc

SEQ ID NO: 58149 - DNA, 42 bp, Homo sapiens
cagcgccgcggagcctcggttggcctcggatagccggtcccc

SEQ ID NO: 58150 - DNA, 43 bp, Homo sapiens
cagcgccgcggagcctcggttggcctcggatagccggtccccc

SEQ ID NO: 58151 - DNA, 44 bp, Homo sapiens
cagcgccgcggagcctcggttggcctcggatagccggtcccccg

SEQ ID NO: 58152 - DNA, 45 bp, Homo sapiens
cagcgccgcggagcctcggttggcctcggatagccggtcccccgc

SEQ ID NO: 58153 - DNA, 46 bp, Homo sapiens
cagcgccgcggagcctcggttggcctcggatagccggtcccccgcc

SEQ ID NO: 58154 - DNA, 42 bp, Homo sapiens
agcgccgcggagcctcggttggcctcggatagccggtccccc

SEQ ID NO: 58155 - DNA, 36 bp, Homo sapiens; identical to SEQ ID NO: 27809

SEQ ID NO: 58156 - DNA, 30 bp, Homo sapiens; identical to SEQ ID NO: 6334

SEQ ID NO: 58157 - DNA, 35 bp, Homo sapiens
ggagcctcggttggcctcggatagccggtcccccg

SEQ ID NO: 58158 - DNA, 36 bp, Homo sapiens
ggagcctcggttggcctcggatagccggtcccccgc

SEQ ID NO: 58159 - DNA, 37 bp, Homo sapiens
ggagcctcggttggcctcggatagccggtcccccgcc

SEQ ID NO: 58160 - DNA, 29 bp, Homo sapiens
gagcctcggttggcctcggatagccggtc

SEQ ID NO: 58161 - DNA, 31 bp, Homo sapiens; identical to SEQ ID NO: 27824

SEQ ID NO: 58162 - DNA, 32 bp, Homo sapiens
gagcctcggttggcctcggatagccggtcccc

SEQ ID NO: 58163 - DNA, 33 bp, Homo sapiens
gagcctcggttggcctcggatagccggtccccc

SEQ ID NO: 58164 - DNA, 34 bp, Homo sapiens; identical to SEQ ID NO: 27825

SEQ ID NO: 58165 - DNA, 35 bp, Homo sapiens
gagcctcggttggcctcggatagccggtcccccgc

SEQ ID NO: 58166 - DNA, 36 bp, Homo sapiens
gagcctcggttggcctcggatagccggtcccccgcc

SEQ ID NO: 58167 - DNA, 30 bp, Homo sapiens; identical to SEQ ID NO: 27830

SEQ ID NO: 58168 - DNA, 31 bp, Homo sapiens
agcctcggttggcctcggatagccggtcccc

SEQ ID NO: 58169 - DNA, 32 bp, Homo sapiens
agcctcggttggcctcggatagccggtccccc

SEQ ID NO: 58170 - DNA, 33 bp, Homo sapiens; identical to SEQ ID NO: 6337

SEQ ID NO: 58171 - DNA, 34 bp, Homo sapiens
agcctcggttggcctcggatagccggtcccccgc

SEQ ID NO: 58172 - DNA, 35 bp, Homo sapiens
agcctcggttggcctcggatagccggtcccccgcc

SEQ ID NO: 58173 - DNA, 22 bp, Homo sapiens
tgtccccgccggcgggccgccc

SEQ ID NO: 58174 - DNA, 18 bp, Homo sapiens
ccccgccggcgggccgcc

SEQ ID NO: 58175 - DNA, 19 bp, Homo sapiens
ccccgccggcgggccgccc

SEQ ID NO: 58176 - DNA, 20 bp, Homo sapiens
ccccgccggcgggccgcccc

SEQ ID NO: 58177 - DNA, 21 bp, Homo sapiens
ccccgccggcgggccgccccc

SEQ ID NO: 58178 - DNA, 22 bp, Homo sapiens
ccccgccggcgggccgcccccc

SEQ ID NO: 58179 - DNA, 23 bp, Homo sapiens
ccccgccggcgggccgccccccc

SEQ ID NO: 58180 - DNA, 24 bp, Homo sapiens
ccccgccggcgggccgcccccccc

SEQ ID NO: 58181 - DNA, 17 bp, Homo sapiens
cccgccggcgggccgcc

SEQ ID NO: 58182 - DNA, 18 bp, Homo sapiens
cccgccggcgggccgccc

SEQ ID NO: 58183 - DNA, 19 bp, Homo sapiens
cccgccggcgggccgcccc

SEQ ID NO: 58184 - DNA, 20 bp, Homo sapiens
cccgccggcgggccgccccc

SEQ ID NO: 58185 - DNA, 21 bp, Homo sapiens
cccgccggcgggccgcccccc

SEQ ID NO: 58186 - DNA, 22 bp, Homo sapiens
cccgccggcgggccgccccccc

SEQ ID NO: 58187 - DNA, 23 bp, Homo sapiens
cccgccggcgggccgcccccccc

SEQ ID NO: 58188 - DNA, 24 bp, Homo sapiens
cccgccggcgggccgcccccccct

SEQ ID NO: 58189 - DNA, 16 bp, Homo sapiens
ccgccggcgggccgcc

SEQ ID NO: 58190 - DNA, 17 bp, Homo sapiens
ccgccggcgggccgccc

SEQ ID NO: 58191 - DNA, 18 bp, Homo sapiens
ccgccggcgggccgcccc

SEQ ID NO: 58192 - DNA, 19 bp, Homo sapiens
ccgccggcgggccgccccc

SEQ ID NO: 58193 - DNA, 20 bp, Homo sapiens
ccgccggcgggccgcccccc

SEQ ID NO: 58194 - DNA, 21 bp, Homo sapiens
ccgccggcgggccgccccccc

SEQ ID NO: 58195 - DNA, 22 bp, Homo sapiens
ccgccggcgggccgcccccccc

SEQ ID NO: 58196 - DNA, 16 bp, Homo sapiens
cgccggcgggccgccc

SEQ ID NO: 58197 - DNA, 17 bp, Homo sapiens
cgccggcgggccgcccc

SEQ ID NO: 58198 - DNA, 18 bp, Homo sapiens
cgccggcgggccgccccc

SEQ ID NO: 58199 - DNA, 19 bp, Homo sapiens
cgccggcgggccgcccccc

SEQ ID NO: 58200 - DNA, 20 bp, Homo sapiens
cgccggcgggccgccccccc

SEQ ID NO: 58201 - DNA, 21 bp, Homo sapiens
cgccggcgggccgcccccccc

SEQ ID NO: 58202 - DNA, 21 bp, Homo sapiens
cccgcgcgcgcgggagggcgc

SEQ ID NO: 58203 - DNA, 22 bp, Homo sapiens
cccgcgcgcgcgggagggcgcg

SEQ ID NO: 58204 - DNA, 20 bp, Homo sapiens
ccccgccgcgcgccgggacc

SEQ ID NO: 58205 - DNA, 29 bp, Homo sapiens
ccccgccgcgcgccgggaccggggtccgg

SEQ ID NO: 58206 - DNA, 23 bp, Homo sapiens
cccgccgcgcgccgggaccgggg

SEQ ID NO: 58207 - DNA, 39 bp, Homo sapiens
ccctcgcccgtcacgcaccgcacgttcgtggggaacctg

SEQ ID NO: 58208 - DNA, 29 bp, Homo sapiens
cgctaaaccattcgtagacgacctgcttc

SEQ ID NO: 58209 - DNA, 27 bp, Homo sapiens
gctaaaccattcgtagacgacctgctt

SEQ ID NO: 58210 - DNA, 28 bp, Homo sapiens
gctaaaccattcgtagacgacctgcttc

SEQ ID NO: 58211 - DNA, 26 bp, Homo sapiens
taaaccattcgtagacgacctgcttc

SEQ ID NO: 58212 - DNA, 24 bp, Homo sapiens
aaaccattcgtagacgacctgctt

SEQ ID NO: 58213 - DNA, 25 bp, Homo sapiens
aaaccattcgtagacgacctgcttc

SEQ ID NO: 58214 - DNA, 23 bp, Homo sapiens
aaccattcgtagacgacctgctt

SEQ ID NO: 58215 - DNA, 24 bp, Homo sapiens
aaccattcgtagacgacctgcttc

SEQ ID NO: 58216 - DNA, 22 bp, Homo sapiens
accattcgtagacgacctgctt

SEQ ID NO: 58217 - DNA, 23 bp, Homo sapiens
accattcgtagacgacctgcttc

SEQ ID NO: 58218 - DNA, 35 bp, Homo sapiens; identical to SEQ ID NO: 28251

SEQ ID NO: 58219 - DNA, 36 bp, Homo sapiens; identical to SEQ ID NO: 28252

SEQ ID NO: 58220 - DNA, 34 bp, Homo sapiens; identical to SEQ ID NO: 28264

SEQ ID NO: 58221 - DNA, 35 bp, Homo sapiens; identical to SEQ ID NO: 28265

SEQ ID NO: 58222 - DNA, 36 bp, Homo sapiens; identical to SEQ ID NO: 28266

SEQ ID NO: 58223 - DNA, 47 bp, Homo sapiens
ccctcgctgcgatctattgaaagtcagccctcgacacaagggtttgt

SEQ ID NO: 58224 - DNA, 36 bp, Homo sapiens; identical to SEQ ID NO: 28409

SEQ ID NO: 58225 - DNA, 44 bp, Homo sapiens; identical to SEQ ID NO: 28412

SEQ ID NO: 58226 - DNA, 45 bp, Homo sapiens; identical to SEQ ID NO: 28413

SEQ ID NO: 58227 - DNA, 35 bp, Homo sapiens
tcgctgcgatctattgaaagtcagccctcgacaca

SEQ ID NO: 58228 - DNA, 43 bp, Homo sapiens; identical to SEQ ID NO: 28424

SEQ ID NO: 58229 - DNA, 44 bp, Homo sapiens; identical to SEQ ID NO: 28425

SEQ ID NO: 58230 - DNA, 34 bp, Homo sapiens
cgctgcgatctattgaaagtcagccctcgacaca

SEQ ID NO: 58231 - DNA, 42 bp, Homo sapiens; identical to SEQ ID NO: 28436

SEQ ID NO: 58232 - DNA, 43 bp, Homo sapiens; identical to SEQ ID NO: 28437

SEQ ID NO: 58233 - DNA, 33 bp, Homo sapiens
gctgcgatctattgaaagtcagccctcgacaca

SEQ ID NO: 58234 - DNA, 41 bp, Homo sapiens; identical to SEQ ID NO: 28443

SEQ ID NO: 58235 - DNA, 42 bp, Homo sapiens; identical to SEQ ID NO: 28444

SEQ ID NO: 58236 - DNA, 39 bp, Homo sapiens
gcgatctattgaaagtcagccctcgacacaagggtttgt

SEQ ID NO: 58237 - DNA, 35 bp, Homo sapiens
tctattgaaagtcagccctcgacacaagggtttgt

SEQ ID NO: 58238 - DNA, 34 bp, Homo sapiens
ctattgaaagtcagccctcgacacaagggtttgt

SEQ ID NO: 58239 - DNA, 24 bp, Homo sapiens
tattgaaagtcagccctcgacaca

SEQ ID NO: 58240 - DNA, 32 bp, Homo sapiens; identical to SEQ ID NO: 6507

SEQ ID NO: 58241 - DNA, 33 bp, Homo sapiens; identical to SEQ ID NO: 6508

SEQ ID NO: 58242 - DNA, 31 bp, Homo sapiens; identical to SEQ ID NO: 6510

SEQ ID NO: 58243 - DNA, 32 bp, Homo sapiens; identical to SEQ ID NO: 6511

SEQ ID NO: 58244 - DNA, 31 bp, Homo sapiens; identical to SEQ ID NO: 6513

SEQ ID NO: 58245 - DNA, 28 bp, Homo sapiens
gaaagtcagccctcgacacaagggtttg

SEQ ID NO: 58246 - DNA, 29 bp, Homo sapiens
gaaagtcagccctcgacacaagggtttgt

SEQ ID NO: 58247 - DNA, 25 bp, Homo sapiens
gtcagccctcgacacaagggtttgt

SEQ ID NO: 58248 - DNA, 23 bp, Homo sapiens
cagccctcgacacaagggtttgt

SEQ ID NO: 58249 - DNA, 22 bp, Homo sapiens
agccctcgacacaagggtttgt

SEQ ID NO: 58250 - DNA, 20 bp, Homo sapiens
ccctcgacacaagggtttgt

SEQ ID NO: 58251 - DNA, 19 bp, Homo sapiens
cctcgacacaagggtttgt

SEQ ID NO: 58252 - DNA, 17 bp, Homo sapiens
ctcgacacaagggtttg

SEQ ID NO: 58253 - DNA, 18 bp, Homo sapiens
ctcgacacaagggtttgt

SEQ ID NO: 58254 - DNA, 16 bp, Homo sapiens
tcgacacaagggtttg

SEQ ID NO: 58255 - DNA, 17 bp, Homo sapiens
tcgacacaagggtttgt

SEQ ID NO: 58256 - DNA, 16 bp, Homo sapiens
cgacacaagggtttgt

SEQ ID NO: 58257 - DNA, 22 bp, Homo sapiens
gtctacggccataccaccctga

SEQ ID NO: 58258 - DNA, 24 bp, Homo sapiens
gtctacggccataccaccctgaac

SEQ ID NO: 58259 - DNA, 25 bp, Homo sapiens
gtctacggccataccaccctgaacg

SEQ ID NO: 58260 - DNA, 29 bp, Homo sapiens
gtctacggccataccaccctgaacgcgcc

SEQ ID NO: 58261 - DNA, 30 bp, Homo sapiens; identical to SEQ ID NO: 8

SEQ ID NO: 58262 - DNA, 31 bp, Homo sapiens; identical to SEQ ID NO: 9

SEQ ID NO: 58263 - DNA, 32 bp, Homo sapiens; identical to SEQ ID NO: 10

SEQ ID NO: 58264 - DNA, 33 bp, Homo sapiens; identical to SEQ ID NO: 11

SEQ ID NO: 58265 - DNA, 34 bp, Homo sapiens; identical to SEQ ID NO: 6542

SEQ ID NO: 58266 - DNA, 35 bp, Homo sapiens; identical to SEQ ID NO: 6543

SEQ ID NO: 58267 - DNA, 36 bp, Homo sapiens; identical to SEQ ID NO: 6544

SEQ ID NO: 58268 - DNA, 37 bp, Homo sapiens; identical to SEQ ID NO: 6545

SEQ ID NO: 58269 - DNA, 38 bp, Homo sapiens; identical to SEQ ID NO: 6546

SEQ ID NO: 58270 - DNA, 39 bp, Homo sapiens; identical to SEQ ID NO: 6547

SEQ ID NO: 58271 - DNA, 40 bp, Homo sapiens; identical to SEQ ID NO: 6548

SEQ ID NO: 58272 - DNA, 41 bp, Homo sapiens; identical to SEQ ID NO: 6549

SEQ ID NO: 58273 - DNA, 42 bp, Homo sapiens; identical to SEQ ID NO: 6550

SEQ ID NO: 58274 - DNA, 25 bp, Homo sapiens
acggccataccaccctgaacgcgcc

SEQ ID NO: 58275 - DNA, 27 bp, Homo sapiens
acggccataccaccctgaacgcgcccg

SEQ ID NO: 58276 - DNA, 28 bp, Homo sapiens
acggccataccaccctgaacgcgcccga

SEQ ID NO: 58277 - DNA, 29 bp, Homo sapiens
acggccataccaccctgaacgcgcccgat

SEQ ID NO: 58278 - DNA, 19 bp, Homo sapiens
ataccaccctgaacgcgcc

SEQ ID NO: 58279 - DNA, 20 bp, Homo sapiens
ataccaccctgaacgcgccc

SEQ ID NO: 58280 - DNA, 21 bp, Homo sapiens
ataccaccctgaacgcgcccg

SEQ ID NO: 58281 - DNA, 22 bp, Homo sapiens
ataccaccctgaacgcgcccga

SEQ ID NO: 58282 - DNA, 19 bp, Homo sapiens
accaccctgaacgcgcccg

SEQ ID NO: 58283 - DNA, 20 bp, Homo sapiens
accaccctgaacgcgcccga

SEQ ID NO: 58284 - DNA, 21 bp, Homo sapiens
accaccctgaacgcgcccgat

SEQ ID NO: 58285 - DNA, 18 bp, Homo sapiens
ccaccctgaacgcgcccg

SEQ ID NO: 58286 - DNA, 19 bp, Homo sapiens
ccaccctgaacgcgcccga

SEQ ID NO: 58287 - DNA, 20 bp, Homo sapiens
ccaccctgaacgcgcccgat

SEQ ID NO: 58288 - DNA, 21 bp, Homo sapiens
ccaccctgaacgcgcccgatc

SEQ ID NO: 58289 - DNA, 17 bp, Homo sapiens
caccctgaacgcgcccg

SEQ ID NO: 58290 - DNA, 18 bp, Homo sapiens
caccctgaacgcgcccga

SEQ ID NO: 58291 - DNA, 16 bp, Homo sapiens
accctgaacgcgcccg

SEQ ID NO: 58292 - DNA, 17 bp, Homo sapiens
accctgaacgcgcccga

SEQ ID NO: 58293 - DNA, 18 bp, Homo sapiens
accctgaacgcgcccgat

SEQ ID NO: 58294 - DNA, 19 bp, Homo sapiens
accctgaacgcgcccgatc

SEQ ID NO: 58295 - DNA, 16 bp, Homo sapiens
ccctgaacgcgcccga

SEQ ID NO: 58296 - DNA, 19 bp, Homo sapiens
tgaacgcgcccgatctcgt

SEQ ID NO: 58297 - DNA, 31 bp, Homo sapiens; identical to SEQ ID NO: 120

SEQ ID NO: 58298 - DNA, 30 bp, Homo sapiens; identical to SEQ ID NO: 121

SEQ ID NO: 58299 - DNA, 28 bp, Homo sapiens
cgcccgatctcgtctgatctcggaagct

SEQ ID NO: 58300 - DNA, 19 bp, Homo sapiens
tcgtctgatctcggaagct

SEQ ID NO: 58301 - DNA, 35 bp, Homo sapiens; identical to SEQ ID NO: 6838

SEQ ID NO: 58302 - DNA, 18 bp, Homo sapiens
cgtctgatctcggaagct

SEQ ID NO: 58303 - DNA, 34 bp, Homo sapiens
cgtctgatctcggaagctaagcagggtcgggcct

SEQ ID NO: 58304 - DNA, 43 bp, Homo sapiens; identical to SEQ ID NO: 6904

SEQ ID NO: 58305 - DNA, 42 bp, Homo sapiens; identical to SEQ ID NO: 6913

SEQ ID NO: 58306 - DNA, 41 bp, Homo sapiens; identical to SEQ ID NO: 6918

SEQ ID NO: 58307 - DNA, 40 bp, Homo sapiens; identical to SEQ ID NO: 6929

SEQ ID NO: 58308 - DNA, 39 bp, Homo sapiens; identical to SEQ ID NO: 6934

SEQ ID NO: 58309 - DNA, 38 bp, Homo sapiens; identical to SEQ ID NO: 6936

SEQ ID NO: 58310 - DNA, 37 bp, Homo sapiens; identical to SEQ ID NO: 6942

SEQ ID NO: 58311 - DNA, 35 bp, Homo sapiens; identical to SEQ ID NO: 56852

SEQ ID NO: 58312 - DNA, 33 bp, Homo sapiens; identical to SEQ ID NO: 151

SEQ ID NO: 58313 - DNA, 55 bp, Homo sapiens
gcctggttagtacttggatgggagaccgcctgggaataccgggtgctgtaggctt

SEQ ID NO: 58314 - DNA, 27 bp, Homo sapiens
tggttagtacttggatgggagaccgcc

SEQ ID NO: 58315 - DNA, 25 bp, Homo sapiens
gttagtacttggatgggagaccgcc

SEQ ID NO: 58316 - DNA, 24 bp, Homo sapiens
ttagtacttggatgggagaccgcc

SEQ ID NO: 58317 - DNA, 23 bp, Homo sapiens
tagtacttggatgggagaccgcc

SEQ ID NO: 58318 - DNA, 47 bp, Homo sapiens
tagtacttggatgggagaccgcctgggaataccgggtgctgtaggct

SEQ ID NO: 58319 - DNA, 48 bp, Homo sapiens; identical to SEQ ID NO: 56856

SEQ ID NO: 58320 - DNA, 22 bp, Homo sapiens
agtacttggatgggagaccgcc

SEQ ID NO: 58321 - DNA, 46 bp, Homo sapiens
agtacttggatgggagaccgcctgggaataccgggtgctgtaggct

SEQ ID NO: 58322 - DNA, 47 bp, Homo sapiens; identical to SEQ ID NO: 6956

SEQ ID NO: 58323 - DNA, 48 bp, Homo sapiens; identical to SEQ ID NO: 56859

SEQ ID NO: 58324 - DNA, 21 bp, Homo sapiens
gtacttggatgggagaccgcc

SEQ ID NO: 58325 - DNA, 45 bp, Homo sapiens; identical to SEQ ID NO: 56861

SEQ ID NO: 58326 - DNA, 46 bp, Homo sapiens; identical to SEQ ID NO: 6963

SEQ ID NO: 58327 - DNA, 47 bp, Homo sapiens; identical to SEQ ID NO: 6964

SEQ ID NO: 58328 - DNA, 20 bp, Homo sapiens
tacttggatgggagaccgcc

SEQ ID NO: 58329 - DNA, 44 bp, Homo sapiens; identical to SEQ ID NO: 56864

SEQ ID NO: 58330 - DNA, 45 bp, Homo sapiens; identical to SEQ ID NO: 6966

SEQ ID NO: 58331 - DNA, 46 bp, Homo sapiens; identical to SEQ ID NO: 6967

SEQ ID NO: 58332 - DNA, 19 bp, Homo sapiens
acttggatgggagaccgcc

SEQ ID NO: 58333 - DNA, 43 bp, Homo sapiens; identical to SEQ ID NO: 56868

SEQ ID NO: 58334 - DNA, 44 bp, Homo sapiens; identical to SEQ ID NO: 6971

SEQ ID NO: 58335 - DNA, 45 bp, Homo sapiens; identical to SEQ ID NO: 6972

SEQ ID NO: 58336 - DNA, 42 bp, Homo sapiens; identical to SEQ ID NO: 56871

SEQ ID NO: 58337 - DNA, 43 bp, Homo sapiens; identical to SEQ ID NO: 6981

SEQ ID NO: 58338 - DNA, 44 bp, Homo sapiens; identical to SEQ ID NO: 6982

SEQ ID NO: 58339 - DNA, 17 bp, Homo sapiens
ttggatgggagaccgcc

SEQ ID NO: 58340 - DNA, 41 bp, Homo sapiens; identical to SEQ ID NO: 56874

SEQ ID NO: 58341 - DNA, 42 bp, Homo sapiens; identical to SEQ ID NO: 6988

SEQ ID NO: 58342 - DNA, 43 bp, Homo sapiens; identical to SEQ ID NO: 56876

SEQ ID NO: 58343 - DNA, 40 bp, Homo sapiens; identical to SEQ ID NO: 56877

SEQ ID NO: 58344 - DNA, 41 bp, Homo sapiens; identical to SEQ ID NO: 56878

SEQ ID NO: 58345 - DNA, 42 bp, Homo sapiens; identical to SEQ ID NO: 56879

SEQ ID NO: 58346 - DNA, 39 bp, Homo sapiens; identical to SEQ ID NO: 56880

SEQ ID NO: 58347 - DNA, 40 bp, Homo sapiens; identical to SEQ ID NO: 6990

SEQ ID NO: 58348 - DNA, 41 bp, Homo sapiens; identical to SEQ ID NO: 56882

SEQ ID NO: 58349 - DNA, 38 bp, Homo sapiens; identical to SEQ ID NO: 6991

SEQ ID NO: 58350 - DNA, 39 bp, Homo sapiens; identical to SEQ ID NO: 6992

SEQ ID NO: 58351 - DNA, 40 bp, Homo sapiens; identical to SEQ ID NO: 6993

SEQ ID NO: 58352 - DNA, 37 bp, Homo sapiens; identical to SEQ ID NO: 6995

SEQ ID NO: 58353 - DNA, 38 bp, Homo sapiens; identical to SEQ ID NO: 6996

SEQ ID NO: 58354 - DNA, 39 bp, Homo sapiens; identical to SEQ ID NO: 6997

SEQ ID NO: 58355 - DNA, 36 bp, Homo sapiens; identical to SEQ ID NO: 6998

SEQ ID NO: 58356 - DNA, 37 bp, Homo sapiens; identical to SEQ ID NO: 6999

SEQ ID NO: 58357 - DNA, 38 bp, Homo sapiens; identical to SEQ ID NO: 7000

SEQ ID NO: 58358 - DNA, 35 bp, Homo sapiens; identical to SEQ ID NO: 7001

SEQ ID NO: 58359 - DNA, 36 bp, Homo sapiens; identical to SEQ ID NO: 7002

SEQ ID NO: 58360 - DNA, 37 bp, Homo sapiens; identical to SEQ ID NO: 7003

SEQ ID NO: 58361 - DNA, 34 bp, Homo sapiens; identical to SEQ ID NO: 7004

SEQ ID NO: 58362 - DNA, 35 bp, Homo sapiens; identical to SEQ ID NO: 7005

SEQ ID NO: 58363 - DNA, 36 bp, Homo sapiens; identical to SEQ ID NO: 7006

SEQ ID NO: 58364 - DNA, 33 bp, Homo sapiens; identical to SEQ ID NO: 165

SEQ ID NO: 58365 - DNA, 34 bp, Homo sapiens; identical to SEQ ID NO: 7008

SEQ ID NO: 58366 - DNA, 35 bp, Homo sapiens; identical to SEQ ID NO: 56898

SEQ ID NO: 58367 - DNA, 32 bp, Homo sapiens; identical to SEQ ID NO: 7009

SEQ ID NO: 58368 - DNA, 33 bp, Homo sapiens; identical to SEQ ID NO: 166

SEQ ID NO: 58369 - DNA, 34 bp, Homo sapiens; identical to SEQ ID NO: 56900

SEQ ID NO: 58370 - DNA, 32 bp, Homo sapiens; identical to SEQ ID NO: 167

SEQ ID NO: 58371 - DNA, 33 bp, Homo sapiens; identical to SEQ ID NO: 168

SEQ ID NO: 58372 - DNA, 30 bp, Homo sapiens; identical to SEQ ID NO: 7014

SEQ ID NO: 58373 - DNA, 31 bp, Homo sapiens; identical to SEQ ID NO: 169

SEQ ID NO: 58374 - DNA, 32 bp, Homo sapiens; identical to SEQ ID NO: 7016

SEQ ID NO: 58375 - DNA, 29 bp, Homo sapiens
ccgcctgggaataccgggtgctgtaggct

SEQ ID NO: 58376 - DNA, 30 bp, Homo sapiens; identical to SEQ ID NO: 171

SEQ ID NO: 58377 - DNA, 31 bp, Homo sapiens; identical to SEQ ID NO: 172

SEQ ID NO: 58378 - DNA, 28 bp, Homo sapiens
cgcctgggaataccgggtgctgtaggct

SEQ ID NO: 58379 - DNA, 29 bp, Homo sapiens
cgcctgggaataccgggtgctgtaggctt

SEQ ID NO: 58380 - DNA, 30 bp, Homo sapiens; identical to SEQ ID NO: 174

SEQ ID NO: 58381 - DNA, 27 bp, Homo sapiens
gcctgggaataccgggtgctgtaggct

SEQ ID NO: 58382 - DNA, 28 bp, Homo sapiens
gcctgggaataccgggtgctgtaggctt

SEQ ID NO: 58383 - DNA, 29 bp, Homo sapiens
gcctgggaataccgggtgctgtaggcttt

SEQ ID NO: 58384 - DNA, 26 bp, Homo sapiens
cctgggaataccgggtgctgtaggct

SEQ ID NO: 58385 - DNA, 27 bp, Homo sapiens
cctgggaataccgggtgctgtaggctt

SEQ ID NO: 58386 - DNA, 28 bp, Homo sapiens
cctgggaataccgggtgctgtaggcttt

SEQ ID NO: 58387 - DNA, 25 bp, Homo sapiens
ctgggaataccgggtgctgtaggct

SEQ ID NO: 58388 - DNA, 26 bp, Homo sapiens
ctgggaataccgggtgctgtaggctt

SEQ ID NO: 58389 - DNA, 27 bp, Homo sapiens
ctgggaataccgggtgctgtaggcttt

SEQ ID NO: 58390 - DNA, 24 bp, Homo sapiens
tgggaataccgggtgctgtaggct

SEQ ID NO: 58391 - DNA, 25 bp, Homo sapiens
tgggaataccgggtgctgtaggctt

SEQ ID NO: 58392 - DNA, 26 bp, Homo sapiens
tgggaataccgggtgctgtaggcttt

SEQ ID NO: 58393 - DNA, 23 bp, Homo sapiens
gggaataccgggtgctgtaggct

SEQ ID NO: 58394 - DNA, 24 bp, Homo sapiens
gggaataccgggtgctgtaggctt

SEQ ID NO: 58395 - DNA, 25 bp, Homo sapiens
gggaataccgggtgctgtaggcttt

SEQ ID NO: 58396 - DNA, 22 bp, Homo sapiens
ggaataccgggtgctgtaggct

SEQ ID NO: 58397 - DNA, 23 bp, Homo sapiens
ggaataccgggtgctgtaggctt

SEQ ID NO: 58398 - DNA, 24 bp, Homo sapiens
ggaataccgggtgctgtaggcttt

SEQ ID NO: 58399 - DNA, 21 bp, Homo sapiens
gaataccgggtgctgtaggct

SEQ ID NO: 58400 - DNA, 22 bp, Homo sapiens
gaataccgggtgctgtaggctt

SEQ ID NO: 58401 - DNA, 23 bp, Homo sapiens
gaataccgggtgctgtaggcttt

SEQ ID NO: 58402 - DNA, 20 bp, Homo sapiens
aataccgggtgctgtaggct

SEQ ID NO: 58403 - DNA, 21 bp, Homo sapiens
aataccgggtgctgtaggctt

SEQ ID NO: 58404 - DNA, 22 bp, Homo sapiens
aataccgggtgctgtaggcttt

SEQ ID NO: 58405 - DNA, 19 bp, Homo sapiens
ataccgggtgctgtaggct

SEQ ID NO: 58406 - DNA, 20 bp, Homo sapiens
ataccgggtgctgtaggctt

SEQ ID NO: 58407 - DNA, 21 bp, Homo sapiens
ataccgggtgctgtaggcttt

SEQ ID NO: 58408 - DNA, 18 bp, Homo sapiens
taccgggtgctgtaggct

SEQ ID NO: 58409 - DNA, 19 bp, Homo sapiens
taccgggtgctgtaggctt

SEQ ID NO: 58410 - DNA, 20 bp, Homo sapiens
taccgggtgctgtaggcttt

SEQ ID NO: 58411 - DNA, 16 bp, Homo sapiens
accgggtgctgtaggc

SEQ ID NO: 58412 - DNA, 17 bp, Homo sapiens
accgggtgctgtaggct

SEQ ID NO: 58413 - DNA, 18 bp, Homo sapiens
accgggtgctgtaggctt

SEQ ID NO: 58414 - DNA, 19 bp, Homo sapiens
accgggtgctgtaggcttt

SEQ ID NO: 58415 - DNA, 16 bp, Homo sapiens
ccgggtgctgtaggct

SEQ ID NO: 58416 - DNA, 17 bp, Homo sapiens
ccgggtgctgtaggctt

SEQ ID NO: 58417 - DNA, 18 bp, Homo sapiens
ccgggtgctgtaggcttt

SEQ ID NO: 58418 - DNA, 16 bp, Homo sapiens
cgggtgctgtaggctt

SEQ ID NO: 58419 - DNA, 17 bp, Homo sapiens
cgggtgctgtaggcttt

SEQ ID NO: 58420 - DNA, 16 bp, Homo sapiens
gggtgctgtaggcttt

SEQ ID NO: 58421 - DNA, 17 bp, Homo sapiens
ataggtttggtcctagc

SEQ ID NO: 58422 - DNA, 32 bp, Homo sapiens; identical to SEQ ID NO: 215

SEQ ID NO: 58423 - DNA, 32 bp, Homo sapiens
cccgttccagtgagttcaccctctaaatcacc

SEQ ID NO: 58424 - DNA, 33 bp, Homo sapiens
cccgttccagtgagttcaccctctaaatcacca

SEQ ID NO: 58425 - DNA, 40 bp, Homo sapiens; identical to SEQ ID NO: 56949

SEQ ID NO: 58426 - DNA, 39 bp, Homo sapiens; identical to SEQ ID NO: 56950

SEQ ID NO: 58427 - DNA, 38 bp, Homo sapiens
ccaataaagctaaaactcacctgagttgtaaaaaactc

SEQ ID NO: 58428 - DNA, 37 bp, Homo sapiens; identical to SEQ ID NO: 7446

SEQ ID NO: 58429 - DNA, 21 bp, Homo sapiens
cacctgagttgtaaaaaactc

SEQ ID NO: 58430 - DNA, 20 bp, Homo sapiens
acctgagttgtaaaaaactc

SEQ ID NO: 58431 - DNA, 37 bp, Homo sapiens; identical to SEQ ID NO: 8780

SEQ ID NO: 58432 - DNA, 34 bp, Homo sapiens; identical to SEQ ID NO: 8784

SEQ ID NO: 58433 - DNA, 30 bp, Homo sapiens; identical to SEQ ID NO: 8792

SEQ ID NO: 58434 - DNA, 20 bp, Homo sapiens
gctaaacctagccccaaacc

SEQ ID NO: 58435 - DNA, 21 bp, Homo sapiens
gctaaacctagccccaaaccc

SEQ ID NO: 58436 - DNA, 22 bp, Homo sapiens
gctaaacctagccccaaaccca

SEQ ID NO: 58437 - DNA, 23 bp, Homo sapiens
gctaaacctagccccaaacccac

SEQ ID NO: 58438 - DNA, 24 bp, Homo sapiens
gctaaacctagccccaaacccact

SEQ ID NO: 58439 - DNA, 30 bp, Homo sapiens; identical to SEQ ID NO: 832

SEQ ID NO: 58440 - DNA, 37 bp, Homo sapiens; identical to SEQ ID NO: 8830

SEQ ID NO: 58441 - DNA, 38 bp, Homo sapiens; identical to SEQ ID NO: 8831

SEQ ID NO: 58442 - DNA, 44 bp, Homo sapiens; identical to SEQ ID NO: 8837

SEQ ID NO: 58443 - DNA, 45 bp, Homo sapiens; identical to SEQ ID NO: 8838

SEQ ID NO: 58444 - DNA, 46 bp, Homo sapiens; identical to SEQ ID NO: 8839

SEQ ID NO: 58445 - DNA, 46 bp, Homo sapiens; identical to SEQ ID NO: 56960

SEQ ID NO: 58446 - DNA, 40 bp, Homo sapiens; identical to SEQ ID NO: 9011

SEQ ID NO: 58447 - DNA, 32 bp, Homo sapiens; identical to SEQ ID NO: 881

SEQ ID NO: 58448 - DNA, 33 bp, Homo sapiens; identical to SEQ ID NO: 882

SEQ ID NO: 58449 - DNA, 30 bp, Homo sapiens; identical to SEQ ID NO: 9095

SEQ ID NO: 58450 - DNA, 27 bp, Homo sapiens
aagtataggcgatagaaattgaaacct

SEQ ID NO: 58451 - DNA, 23 bp, Homo sapiens
ataggcgatagaaattgaaacct

SEQ ID NO: 58452 - DNA, 18 bp, Homo sapiens
cgatagaaattgaaacct

SEQ ID NO: 58453 - DNA, 29 bp, Homo sapiens
cgcataagcctgcgtcagattaaaacact

SEQ ID NO: 58454 - DNA, 31 bp, Homo sapiens; identical to SEQ ID NO: 10671

SEQ ID NO: 58455 - DNA, 30 bp, Homo sapiens; identical to SEQ ID NO: 1525

SEQ ID NO: 58456 - DNA, 31 bp, Homo sapiens; identical to SEQ ID NO: 1526

SEQ ID NO: 58457 - DNA, 29 bp, Homo sapiens
agtgacacatgtttaacggccgcggtacc

SEQ ID NO: 58458 - DNA, 30 bp, Homo sapiens; identical to SEQ ID NO: 1532

SEQ ID NO: 58459 - DNA, 23 bp, Homo sapiens
catgtttaacggccgcggtaccc

SEQ ID NO: 58460 - DNA, 32 bp, Homo sapiens
ccctatggagctttaatttattaatgcaaaca

SEQ ID NO: 58461 - DNA, 34 bp, Homo sapiens
ccctatggagctttaatttattaatgcaaacagt

SEQ ID NO: 58462 - DNA, 37 bp, Homo sapiens
ccctatggagctttaatttattaatgcaaacagtacc

SEQ ID NO: 58463 - DNA, 38 bp, Homo sapiens
ccctatggagctttaatttattaatgcaaacagtacct

SEQ ID NO: 58464 - DNA, 16 bp, Homo sapiens
aaaaatttcggttggg

SEQ ID NO: 58465 - DNA, 21 bp, Homo sapiens
caccagtcaaagcgaactact

SEQ ID NO: 58466 - DNA, 31 bp, Homo sapiens
caacaatagggtttacgacctcgatgttgga

SEQ ID NO: 58467 - DNA, 31 bp, Homo sapiens
cccccgtaaatgatatcatctcaacttagta

SEQ ID NO: 58468 - DNA, 28 bp, Homo sapiens
cccgtaaatgatatcatctcaacttagt

SEQ ID NO: 58469 - DNA, 29 bp, Homo sapiens
cccgtaaatgatatcatctcaacttagta

SEQ ID NO: 58470 - DNA, 30 bp, Homo sapiens; identical to SEQ ID NO: 11786

SEQ ID NO: 58471 - DNA, 31 bp, Homo sapiens; identical to SEQ ID NO: 11787

SEQ ID NO: 58472 - DNA, 32 bp, Homo sapiens; identical to SEQ ID NO: 11788

SEQ ID NO: 58473 - DNA, 34 bp, Homo sapiens; identical to SEQ ID NO: 11789

SEQ ID NO: 58474 - DNA, 37 bp, Homo sapiens; identical to SEQ ID NO: 56970

SEQ ID NO: 58475 - DNA, 27 bp, Homo sapiens
ccgtaaatgatatcatctcaacttagt

SEQ ID NO: 58476 - DNA, 28 bp, Homo sapiens
ccgtaaatgatatcatctcaacttagta

SEQ ID NO: 58477 - DNA, 29 bp, Homo sapiens
ccgtaaatgatatcatctcaacttagtat

SEQ ID NO: 58478 - DNA, 31 bp, Homo sapiens; identical to SEQ ID NO: 11792

SEQ ID NO: 58479 - DNA, 36 bp, Homo sapiens
ccgtaaatgatatcatctcaacttagtattataccc

SEQ ID NO: 58480 - DNA, 36 bp, Homo sapiens
attatacccacacccacccaagaacagggtttgtta

SEQ ID NO: 58481 - DNA, 20 bp, Homo sapiens
cccaagaacagggtttgtta

SEQ ID NO: 58482 - DNA, 18 bp, Homo sapiens
caagaacagggtttgtta

SEQ ID NO: 58483 - DNA, 22 bp, Homo sapiens
cttcgtgatcgatgtggtgacg

SEQ ID NO: 58484 - DNA, 23 bp, Homo sapiens
cttcgtgatcgatgtggtgacgt

SEQ ID NO: 58485 - DNA, 24 bp, Homo sapiens
cttcgtgatcgatgtggtgacgtc

SEQ ID NO: 58486 - DNA, 29 bp, Homo sapiens
cttcgtgatcgatgtggtgacgtcgtgct

SEQ ID NO: 58487 - DNA, 31 bp, Homo sapiens; identical to SEQ ID NO: 1879

SEQ ID NO: 58488 - DNA, 36 bp, Homo sapiens; identical to SEQ ID NO: 11916

SEQ ID NO: 58489 - DNA, 37 bp, Homo sapiens; identical to SEQ ID NO: 11917

SEQ ID NO: 58490 - DNA, 41 bp, Homo sapiens; identical to SEQ ID NO: 11921

SEQ ID NO: 58491 - DNA, 42 bp, Homo sapiens; identical to SEQ ID NO: 11922

SEQ ID NO: 58492 - DNA, 44 bp, Homo sapiens; identical to SEQ ID NO: 11924

SEQ ID NO: 58493 - DNA, 21 bp, Homo sapiens
ttcgtgatcgatgtggtgacg

SEQ ID NO: 58494 - DNA, 19 bp, Homo sapiens
gatgtggtgacgtcgtgct

SEQ ID NO: 58495 - DNA, 21 bp, Homo sapiens
gatgtggtgacgtcgtgctct

SEQ ID NO: 58496 - DNA, 25 bp, Homo sapiens
gatgtggtgacgtcgtgctctcccg

SEQ ID NO: 58497 - DNA, 26 bp, Homo sapiens
gatgtggtgacgtcgtgctctcccgg

SEQ ID NO: 58498 - DNA, 27 bp, Homo sapiens
gatgtggtgacgtcgtgctctcccggg

SEQ ID NO: 58499 - DNA, 31 bp, Homo sapiens; identical to SEQ ID NO: 56988

SEQ ID NO: 58500 - DNA, 32 bp, Homo sapiens; identical to SEQ ID NO: 56989

SEQ ID NO: 58501 - DNA, 33 bp, Homo sapiens
gatgtggtgacgtcgtgctctcccgggccgggt

SEQ ID NO: 58502 - DNA, 35 bp, Homo sapiens; identical to SEQ ID NO: 56990

SEQ ID NO: 58503 - DNA, 36 bp, Homo sapiens; identical to SEQ ID NO: 56991

SEQ ID NO: 58504 - DNA, 37 bp, Homo sapiens; identical to SEQ ID NO: 56992

SEQ ID NO: 58505 - DNA, 38 bp, Homo sapiens; identical to SEQ ID NO: 56993

SEQ ID NO: 58506 - DNA, 39 bp, Homo sapiens
gatgtggtgacgtcgtgctctcccgggccgggtccgagc

SEQ ID NO: 58507 - DNA, 42 bp, Homo sapiens; identical to SEQ ID NO: 56994

SEQ ID NO: 58508 - DNA, 43 bp, Homo sapiens; identical to SEQ ID NO: 56995

SEQ ID NO: 58509 - DNA, 44 bp, Homo sapiens; identical to SEQ ID NO: 56996

SEQ ID NO: 58510 - DNA, 45 bp, Homo sapiens; identical to SEQ ID NO: 56997

SEQ ID NO: 58511 - DNA, 46 bp, Homo sapiens; identical to SEQ ID NO: 56998

SEQ ID NO: 58512 - DNA, 48 bp, Homo sapiens
gatgtggtgacgtcgtgctctcccgggccgggtccgagccgcgacggg

SEQ ID NO: 58513 - DNA, 51 bp, Homo sapiens; identical to SEQ ID NO: 56999

SEQ ID NO: 58514 - DNA, 52 bp, Homo sapiens
gatgtggtgacgtcgtgctctcccgggccgggtccgagccgcgacgggcgag

SEQ ID NO: 58515 - DNA, 20 bp, Homo sapiens
ccccccgagcggctcaccgg

SEQ ID NO: 58516 - DNA, 21 bp, Homo sapiens
ccccccgagcggctcaccggc

SEQ ID NO: 58517 - DNA, 16 bp, Homo sapiens
tacctggttgatcctg

SEQ ID NO: 58518 - DNA, 17 bp, Homo sapiens
tacctggttgatcctgc

SEQ ID NO: 58519 - DNA, 18 bp, Homo sapiens
tacctggttgatcctgcc

SEQ ID NO: 58520 - DNA, 19 bp, Homo sapiens
tacctggttgatcctgcca

SEQ ID NO: 58521 - DNA, 24 bp, Homo sapiens
tacctggttgatcctgccagtagc

SEQ ID NO: 58522 - DNA, 35 bp, Homo sapiens; identical to SEQ ID NO: 12071

SEQ ID NO: 58523 - DNA, 37 bp, Homo sapiens; identical to SEQ ID NO: 12073

SEQ ID NO: 58524 - DNA, 43 bp, Homo sapiens; identical to SEQ ID NO: 12078

SEQ ID NO: 58525 - DNA, 44 bp, Homo sapiens; identical to SEQ ID NO: 12079

SEQ ID NO: 58526 - DNA, 18 bp, Homo sapiens
atgcttgtctcaaagatt

SEQ ID NO: 58527 - DNA, 40 bp, Homo sapiens
aatggctcattaaatcagttatggttcctttggtcgctcg

SEQ ID NO: 58528 - DNA, 39 bp, Homo sapiens
atggctcattaaatcagttatggttcctttggtcgctcg

SEQ ID NO: 58529 - DNA, 40 bp, Homo sapiens
atggctcattaaatcagttatggttcctttggtcgctcgc

SEQ ID NO: 58530 - DNA, 41 bp, Homo sapiens
atggctcattaaatcagttatggttcctttggtcgctcgct

SEQ ID NO: 58531 - DNA, 35 bp, Homo sapiens
gctcattaaatcagttatggttcctttggtcgctc

SEQ ID NO: 58532 - DNA, 36 bp, Homo sapiens; identical to SEQ ID NO: 57008

SEQ ID NO: 58533 - DNA, 37 bp, Homo sapiens
gctcattaaatcagttatggttcctttggtcgctcgc

SEQ ID NO: 58534 - DNA, 34 bp, Homo sapiens
ctcattaaatcagttatggttcctttggtcgctc

SEQ ID NO: 58535 - DNA, 35 bp, Homo sapiens
ctcattaaatcagttatggttcctttggtcgctcg

SEQ ID NO: 58536 - DNA, 33 bp, Homo sapiens; identical to SEQ ID NO: 12260

SEQ ID NO: 58537 - DNA, 34 bp, Homo sapiens; identical to SEQ ID NO: 57009

SEQ ID NO: 58538 - DNA, 33 bp, Homo sapiens; identical to SEQ ID NO: 1991

SEQ ID NO: 58539 - DNA, 31 bp, Homo sapiens; identical to SEQ ID NO: 1992

SEQ ID NO: 58540 - DNA, 32 bp, Homo sapiens; identical to SEQ ID NO: 1993

SEQ ID NO: 58541 - DNA, 29 bp, Homo sapiens
aaatcagttatggttcctttggtcgctcg

SEQ ID NO: 58542 - DNA, 30 bp, Homo sapiens; identical to SEQ ID NO: 1997

SEQ ID NO: 58543 - DNA, 31 bp, Homo sapiens; identical to SEQ ID NO: 1998

SEQ ID NO: 58544 - DNA, 32 bp, Homo sapiens; identical to SEQ ID NO: 1999

SEQ ID NO: 58545 - DNA, 33 bp, Homo sapiens; identical to SEQ ID NO: 2000

SEQ ID NO: 58546 - DNA, 28 bp, Homo sapiens
aatcagttatggttcctttggtcgctcg

SEQ ID NO: 58547 - DNA, 29 bp, Homo sapiens
aatcagttatggttcctttggtcgctcgc

SEQ ID NO: 58548 - DNA, 30 bp, Homo sapiens; identical to SEQ ID NO: 2001

SEQ ID NO: 58549 - DNA, 26 bp, Homo sapiens
tcagttatggttcctttggtcgctcg

SEQ ID NO: 58550 - DNA, 24 bp, Homo sapiens
agttatggttcctttggtcgctcg

SEQ ID NO: 58551 - DNA, 25 bp, Homo sapiens
agttatggttcctttggtcgctcgc

SEQ ID NO: 58552 - DNA, 26 bp, Homo sapiens
agttatggttcctttggtcgctcgct

SEQ ID NO: 58553 - DNA, 27 bp, Homo sapiens
agttatggttcctttggtcgctcgctc

SEQ ID NO: 58554 - DNA, 28 bp, Homo sapiens
agttatggttcctttggtcgctcgctcc

SEQ ID NO: 58555 - DNA, 17 bp, Homo sapiens
gttcctttggtcgctcg

SEQ ID NO: 58556 - DNA, 19 bp, Homo sapiens
gttcctttggtcgctcgct

SEQ ID NO: 58557 - DNA, 20 bp, Homo sapiens
gttcctttggtcgctcgctc

SEQ ID NO: 58558 - DNA, 21 bp, Homo sapiens
gttcctttggtcgctcgctcc

SEQ ID NO: 58559 - DNA, 20 bp, Homo sapiens
tggtcgctcgctcctctcct

SEQ ID NO: 58560 - DNA, 45 bp, Homo sapiens; identical to SEQ ID NO: 12466

SEQ ID NO: 58561 - DNA, 48 bp, Homo sapiens
tctcctacttggataactgtggtaattctagagctaatacatgccgac

SEQ ID NO: 58562 - DNA, 59 bp, Homo sapiens
tctcctacttggataactgtggtaattctagagctaatacatgccgacgggcgctgacc

SEQ ID NO: 58563 - DNA, 18 bp, Homo sapiens
ctcctacttggataactg

SEQ ID NO: 58564 - DNA, 44 bp, Homo sapiens; identical to SEQ ID NO: 12474

SEQ ID NO: 58565 - DNA, 45 bp, Homo sapiens
ctcctacttggataactgtggtaattctagagctaatacatgccg

SEQ ID NO: 58566 - DNA, 47 bp, Homo sapiens
ctcctacttggataactgtggtaattctagagctaatacatgccgac

SEQ ID NO: 58567 - DNA, 43 bp, Homo sapiens; identical to SEQ ID NO: 12482

SEQ ID NO: 58568 - DNA, 44 bp, Homo sapiens
tcctacttggataactgtggtaattctagagctaatacatgccg

SEQ ID NO: 58569 - DNA, 46 bp, Homo sapiens
tcctacttggataactgtggtaattctagagctaatacatgccgac

SEQ ID NO: 58570 - DNA, 42 bp, Homo sapiens; identical to SEQ ID NO: 12493

SEQ ID NO: 58571 - DNA, 43 bp, Homo sapiens; identical to SEQ ID NO: 57022

SEQ ID NO: 58572 - DNA, 44 bp, Homo sapiens; identical to SEQ ID NO: 57023

SEQ ID NO: 58573 - DNA, 45 bp, Homo sapiens; identical to SEQ ID NO: 12494

SEQ ID NO: 58574 - DNA, 41 bp, Homo sapiens; identical to SEQ ID NO: 12502

SEQ ID NO: 58575 - DNA, 42 bp, Homo sapiens; identical to SEQ ID NO: 57025

SEQ ID NO: 58576 - DNA, 43 bp, Homo sapiens; identical to SEQ ID NO: 57026

SEQ ID NO: 58577 - DNA, 44 bp, Homo sapiens
ctacttggataactgtggtaattctagagctaatacatgccgac

SEQ ID NO: 58578 - DNA, 40 bp, Homo sapiens; identical to SEQ ID NO: 12511

SEQ ID NO: 58579 - DNA, 41 bp, Homo sapiens; identical to SEQ ID NO: 57028

SEQ ID NO: 58580 - DNA, 42 bp, Homo sapiens
tacttggataactgtggtaattctagagctaatacatgccga

SEQ ID NO: 58581 - DNA, 43 bp, Homo sapiens; identical to SEQ ID NO: 12512

SEQ ID NO: 58582 - DNA, 40 bp, Homo sapiens
acttggataactgtggtaattctagagctaatacatgccg

SEQ ID NO: 58583 - DNA, 18 bp, Homo sapiens
gataactgtggtaattct

SEQ ID NO: 58584 - DNA, 21 bp, Homo sapiens
aactgtggtaattctagagct

SEQ ID NO: 58585 - DNA, 31 bp, Homo sapiens; identical to SEQ ID NO: 2120

SEQ ID NO: 58586 - DNA, 44 bp, Homo sapiens
actgtggtaattctagagctaatacatgccgacgggcgctgacc

SEQ ID NO: 58587 - DNA, 41 bp, Homo sapiens
gtggtaattctagagctaatacatgccgacgggcgctgacc

SEQ ID NO: 58588 - DNA, 42 bp, Homo sapiens
gtggtaattctagagctaatacatgccgacgggcgctgaccc

SEQ ID NO: 58589 - DNA, 37 bp, Homo sapiens
taattctagagctaatacatgccgacgggcgctgacc

SEQ ID NO: 58590 - DNA, 36 bp, Homo sapiens
aattctagagctaatacatgccgacgggcgctgacc

SEQ ID NO: 58591 - DNA, 35 bp, Homo sapiens
attctagagctaatacatgccgacgggcgctgacc

SEQ ID NO: 58592 - DNA, 39 bp, Homo sapiens
attctagagctaatacatgccgacgggcgctgaccccct

SEQ ID NO: 58593 - DNA, 33 bp, Homo sapiens
tctagagctaatacatgccgacgggcgctgacc

SEQ ID NO: 58594 - DNA, 34 bp, Homo sapiens
tctagagctaatacatgccgacgggcgctgaccc

SEQ ID NO: 58595 - DNA, 37 bp, Homo sapiens
tctagagctaatacatgccgacgggcgctgaccccct

SEQ ID NO: 58596 - DNA, 38 bp, Homo sapiens
tctagagctaatacatgccgacgggcgctgaccccctt

SEQ ID NO: 58597 - DNA, 25 bp, Homo sapiens
gctgacccccttcgcgggggggatg

SEQ ID NO: 58598 - DNA, 24 bp, Homo sapiens
ctgacccccttcgcgggggggatg

SEQ ID NO: 58599 - DNA, 17 bp, Homo sapiens
ccccttcgcggggggga

SEQ ID NO: 58600 - DNA, 36 bp, Homo sapiens
cccttcgcgggggggatgcgtgcatttatcagatca

SEQ ID NO: 58601 - DNA, 39 bp, Homo sapiens
cccttcgcgggggggatgcgtgcatttatcagatcaaaa

SEQ ID NO: 58602 - DNA, 25 bp, Homo sapiens
aaaaccaacccggtcagcccctctc

SEQ ID NO: 58603 - DNA, 26 bp, Homo sapiens
aaaaccaacccggtcagcccctctcc

SEQ ID NO: 58604 - DNA, 27 bp, Homo sapiens
aaaaccaacccggtcagcccctctccg

SEQ ID NO: 58605 - DNA, 21 bp, Homo sapiens
cccggtcagcccctctccggc

SEQ ID NO: 58606 - DNA, 22 bp, Homo sapiens
cccggtcagcccctctccggcc

SEQ ID NO: 58607 - DNA, 25 bp, Homo sapiens
cccggtcagcccctctccggccccg

SEQ ID NO: 58608 - DNA, 20 bp, Homo sapiens
ccggtcagcccctctccggc

SEQ ID NO: 58609 - DNA, 21 bp, Homo sapiens
ccggtcagcccctctccggcc

SEQ ID NO: 58610 - DNA, 39 bp, Homo sapiens; identical to SEQ ID NO: 57033

SEQ ID NO: 58611 - DNA, 19 bp, Homo sapiens
cggtcagcccctctccggc

SEQ ID NO: 58612 - DNA, 20 bp, Homo sapiens
cggtcagcccctctccggcc

SEQ ID NO: 58613 - DNA, 29 bp, Homo sapiens
ccctctccggccccggccggggggcgggc

SEQ ID NO: 58614 - DNA, 20 bp, Homo sapiens
tccggccccggccggggggc

SEQ ID NO: 58615 - DNA, 19 bp, Homo sapiens
ccggccccggccggggggc

SEQ ID NO: 58616 - DNA, 18 bp, Homo sapiens
cggccccggccggggggc

SEQ ID NO: 58617 - DNA, 22 bp, Homo sapiens
cggccccggccggggggcgggc

SEQ ID NO: 58618 - DNA, 26 bp, Homo sapiens
gccccggccggggggcgggcgccggc

SEQ ID NO: 58619 - DNA, 27 bp, Homo sapiens
gccccggccggggggcgggcgccggcg

SEQ ID NO: 58620 - DNA, 29 bp, Homo sapiens
gccccggccggggggcgggcgccggcggc

SEQ ID NO: 58621 - DNA, 18 bp, Homo sapiens
cggccggggggcgggcgc

SEQ ID NO: 58622 - DNA, 19 bp, Homo sapiens
cggggggcgggcgccggcg

SEQ ID NO: 58623 - DNA, 47 bp, Homo sapiens
ggcgccggcggctttggtgactctagataacctcgggccgatcgcac

SEQ ID NO: 58624 - DNA, 43 bp, Homo sapiens
ccggcggctttggtgactctagataacctcgggccgatcgcac

SEQ ID NO: 58625 - DNA, 41 bp, Homo sapiens; identical to SEQ ID NO: 57036

SEQ ID NO: 58626 - DNA, 40 bp, Homo sapiens
gcggctttggtgactctagataacctcgggccgatcgcac

SEQ ID NO: 58627 - DNA, 39 bp, Homo sapiens; identical to SEQ ID NO: 57037

SEQ ID NO: 58628 - DNA, 38 bp, Homo sapiens; identical to SEQ ID NO: 12749

SEQ ID NO: 58629 - DNA, 39 bp, Homo sapiens; identical to SEQ ID NO: 12750

SEQ ID NO: 58630 - DNA, 40 bp, Homo sapiens; identical to SEQ ID NO: 57040

SEQ ID NO: 58631 - DNA, 41 bp, Homo sapiens; identical to SEQ ID NO: 12751

SEQ ID NO: 58632 - DNA, 42 bp, Homo sapiens; identical to SEQ ID NO: 57042

SEQ ID NO: 58633 - DNA, 43 bp, Homo sapiens; identical to SEQ ID NO: 57043

SEQ ID NO: 58634 - DNA, 26 bp, Homo sapiens
gctttggtgactctagataacctcgg

SEQ ID NO: 58635 - DNA, 37 bp, Homo sapiens; identical to SEQ ID NO: 12761

SEQ ID NO: 58636 - DNA, 39 bp, Homo sapiens
gctttggtgactctagataacctcgggccgatcgcacgc

SEQ ID NO: 58637 - DNA, 40 bp, Homo sapiens; identical to SEQ ID NO: 57046

SEQ ID NO: 58638 - DNA, 41 bp, Homo sapiens
gctttggtgactctagataacctcgggccgatcgcacgccc

SEQ ID NO: 58639 - DNA, 42 bp, Homo sapiens
gctttggtgactctagataacctcgggccgatcgcacgcccc

SEQ ID NO: 58640 - DNA, 36 bp, Homo sapiens; identical to SEQ ID NO: 12767

SEQ ID NO: 58641 - DNA, 37 bp, Homo sapiens; identical to SEQ ID NO: 12768

SEQ ID NO: 58642 - DNA, 40 bp, Homo sapiens; identical to SEQ ID NO: 57049

SEQ ID NO: 58643 - DNA, 41 bp, Homo sapiens; identical to SEQ ID NO: 57050

SEQ ID NO: 58644 - DNA, 35 bp, Homo sapiens; identical to SEQ ID NO: 57051

SEQ ID NO: 58645 - DNA, 37 bp, Homo sapiens
tttggtgactctagataacctcgggccgatcgcacgc

SEQ ID NO: 58646 - DNA, 40 bp, Homo sapiens
tttggtgactctagataacctcgggccgatcgcacgcccc

SEQ ID NO: 58647 - DNA, 33 bp, Homo sapiens; identical to SEQ ID NO: 2162

SEQ ID NO: 58648 - DNA, 35 bp, Homo sapiens
tggtgactctagataacctcgggccgatcgcacgc

SEQ ID NO: 58649 - DNA, 31 bp, Homo sapiens; identical to SEQ ID NO: 2175

SEQ ID NO: 58650 - DNA, 30 bp, Homo sapiens; identical to SEQ ID NO: 2179

SEQ ID NO: 58651 - DNA, 32 bp, Homo sapiens; identical to SEQ ID NO: 2181

SEQ ID NO: 58652 - DNA, 16 bp, Homo sapiens
ctcgggccgatcgcac

SEQ ID NO: 58653 - DNA, 40 bp, Homo sapiens
gccccccgtggcggcgacgacccattcgaacgtctgccct

SEQ ID NO: 58654 - DNA, 24 bp, Homo sapiens
cgacgacccattcgaacgtctgcc

SEQ ID NO: 58655 - DNA, 25 bp, Homo sapiens
cgacgacccattcgaacgtctgccc

SEQ ID NO: 58656 - DNA, 26 bp, Homo sapiens
cgacgacccattcgaacgtctgccct

SEQ ID NO: 58657 - DNA, 22 bp, Homo sapiens
acgacccattcgaacgtctgcc

SEQ ID NO: 58658 - DNA, 23 bp, Homo sapiens
acgacccattcgaacgtctgccc

SEQ ID NO: 58659 - DNA, 24 bp, Homo sapiens
acgacccattcgaacgtctgccct

SEQ ID NO: 58660 - DNA, 19 bp, Homo sapiens
acccattcgaacgtctgcc

SEQ ID NO: 58661 - DNA, 16 bp, Homo sapiens
cattcgaacgtctgcc

SEQ ID NO: 58662 - DNA, 17 bp, Homo sapiens
cattcgaacgtctgccc

SEQ ID NO: 58663 - DNA, 18 bp, Homo sapiens
cattcgaacgtctgccct

SEQ ID NO: 58664 - DNA, 20 bp, Homo sapiens
tttcgatggtagtcgccgtg

SEQ ID NO: 58665 - DNA, 21 bp, Homo sapiens
tttcgatggtagtcgccgtgc

SEQ ID NO: 58666 - DNA, 22 bp, Homo sapiens
ttcgatggtagtcgccgtgcct

SEQ ID NO: 58667 - DNA, 30 bp, Homo sapiens; identical to SEQ ID NO: 2272

SEQ ID NO: 58668 - DNA, 22 bp, Homo sapiens
attccggagagggagcctgaga

SEQ ID NO: 58669 - DNA, 29 bp, Homo sapiens
attccggagagggagcctgagaaacggct

SEQ ID NO: 58670 - DNA, 28 bp, Homo sapiens
ccactcccgacccggggaggtagtgacg

SEQ ID NO: 58671 - DNA, 27 bp, Homo sapiens
cactcccgacccggggaggtagtgacg

SEQ ID NO: 58672 - DNA, 28 bp, Homo sapiens
cactcccgacccggggaggtagtgacga

SEQ ID NO: 58673 - DNA, 26 bp, Homo sapiens
actcccgacccggggaggtagtgacg

SEQ ID NO: 58674 - DNA, 27 bp, Homo sapiens
actcccgacccggggaggtagtgacga

SEQ ID NO: 58675 - DNA, 18 bp, Homo sapiens
cccgacccggggaggtag

SEQ ID NO: 58676 - DNA, 23 bp, Homo sapiens
cccgacccggggaggtagtgacg

SEQ ID NO: 58677 - DNA, 24 bp, Homo sapiens
cccgacccggggaggtagtgacga

SEQ ID NO: 58678 - DNA, 35 bp, Homo sapiens
cccgacccggggaggtagtgacgaaaaataacaat

SEQ ID NO: 58679 - DNA, 42 bp, Homo sapiens
cccgacccggggaggtagtgacgaaaaataacaatacaggac

SEQ ID NO: 58680 - DNA, 43 bp, Homo sapiens; identical to SEQ ID NO: 13262

SEQ ID NO: 58681 - DNA, 45 bp, Homo sapiens
cccgacccggggaggtagtgacgaaaaataacaatacaggactct

SEQ ID NO: 58682 - DNA, 46 bp, Homo sapiens
cccgacccggggaggtagtgacgaaaaataacaatacaggactctt

SEQ ID NO: 58683 - DNA, 47 bp, Homo sapiens
cccgacccggggaggtagtgacgaaaaataacaatacaggactcttt

SEQ ID NO: 58684 - DNA, 19 bp, Homo sapiens
cccggggaggtagtgacga

SEQ ID NO: 58685 - DNA, 32 bp, Homo sapiens; identical to SEQ ID NO: 2311

SEQ ID NO: 58686 - DNA, 34 bp, Homo sapiens
gaggtagtgacgaaaaataacaatacaggactct

SEQ ID NO: 58687 - DNA, 35 bp, Homo sapiens
gaggtagtgacgaaaaataacaatacaggactctt

SEQ ID NO: 58688 - DNA, 36 bp, Homo sapiens
gaggtagtgacgaaaaataacaatacaggactcttt

SEQ ID NO: 58689 - DNA, 31 bp, Homo sapiens; identical to SEQ ID NO: 2312

SEQ ID NO: 58690 - DNA, 33 bp, Homo sapiens
aggtagtgacgaaaaataacaatacaggactct

SEQ ID NO: 58691 - DNA, 30 bp, Homo sapiens; identical to SEQ ID NO: 2313

SEQ ID NO: 58692 - DNA, 32 bp, Homo sapiens
ggtagtgacgaaaaataacaatacaggactct

SEQ ID NO: 58693 - DNA, 33 bp, Homo sapiens
ggtagtgacgaaaaataacaatacaggactctt

SEQ ID NO: 58694 - DNA, 34 bp, Homo sapiens
ggtagtgacgaaaaataacaatacaggactcttt

SEQ ID NO: 58695 - DNA, 31 bp, Homo sapiens
gtagtgacgaaaaataacaatacaggactct

SEQ ID NO: 58696 - DNA, 27 bp, Homo sapiens
tagtgacgaaaaataacaatacaggac

SEQ ID NO: 58697 - DNA, 28 bp, Homo sapiens
tagtgacgaaaaataacaatacaggact

SEQ ID NO: 58698 - DNA, 30 bp, Homo sapiens; identical to SEQ ID NO: 13336

SEQ ID NO: 58699 - DNA, 31 bp, Homo sapiens
tagtgacgaaaaataacaatacaggactctt

SEQ ID NO: 58700 - DNA, 32 bp, Homo sapiens
tagtgacgaaaaataacaatacaggactcttt

SEQ ID NO: 58701 - DNA, 26 bp, Homo sapiens
agtgacgaaaaataacaatacaggac

SEQ ID NO: 58702 - DNA, 27 bp, Homo sapiens
agtgacgaaaaataacaatacaggact

SEQ ID NO: 58703 - DNA, 29 bp, Homo sapiens
agtgacgaaaaataacaatacaggactct

SEQ ID NO: 58704 - DNA, 30 bp, Homo sapiens
agtgacgaaaaataacaatacaggactctt

SEQ ID NO: 58705 - DNA, 31 bp, Homo sapiens
agtgacgaaaaataacaatacaggactcttt

SEQ ID NO: 58706 - DNA, 28 bp, Homo sapiens
gtgacgaaaaataacaatacaggactct

SEQ ID NO: 58707 - DNA, 27 bp, Homo sapiens
tgacgaaaaataacaatacaggactct

SEQ ID NO: 58708 - DNA, 26 bp, Homo sapiens
gacgaaaaataacaatacaggactct

SEQ ID NO: 58709 - DNA, 27 bp, Homo sapiens
gacgaaaaataacaatacaggactctt

SEQ ID NO: 58710 - DNA, 25 bp, Homo sapiens
acgaaaaataacaatacaggactct

SEQ ID NO: 58711 - DNA, 20 bp, Homo sapiens
aaaaataacaatacaggact

SEQ ID NO: 58712 - DNA, 22 bp, Homo sapiens
aaaaataacaatacaggactct

SEQ ID NO: 58713 - DNA, 23 bp, Homo sapiens
aaaaataacaatacaggactctt

SEQ ID NO: 58714 - DNA, 24 bp, Homo sapiens
aaaaataacaatacaggactcttt

SEQ ID NO: 58715 - DNA, 38 bp, Homo sapiens; identical to SEQ ID NO: 57060

SEQ ID NO: 58716 - DNA, 24 bp, Homo sapiens
aacaatacaggactctttcgaggc

SEQ ID NO: 58717 - DNA, 23 bp, Homo sapiens
acaatacaggactctttcgaggc

SEQ ID NO: 58718 - DNA, 30 bp, Homo sapiens; identical to SEQ ID NO: 13417

SEQ ID NO: 58719 - DNA, 19 bp, Homo sapiens
tctttcgaggccctgtaat

SEQ ID NO: 58720 - DNA, 18 bp, Homo sapiens
ctttcgaggccctgtaat

SEQ ID NO: 58721 - DNA, 17 bp, Homo sapiens
tttcgaggccctgtaat

SEQ ID NO: 58722 - DNA, 16 bp, Homo sapiens
ttcgaggccctgtaat

SEQ ID NO: 58723 - DNA, 38 bp, Homo sapiens; identical to SEQ ID NO: 57063

SEQ ID NO: 58724 - DNA, 28 bp, Homo sapiens
cactttaaatcctttaacgaggatccat

SEQ ID NO: 58725 - DNA, 31 bp, Homo sapiens; identical to SEQ ID NO: 2424

SEQ ID NO: 58726 - DNA, 29 bp, Homo sapiens
aaagttgctgcagttaaaaagctcgtagt

SEQ ID NO: 58727 - DNA, 43 bp, Homo sapiens
aaagttgctgcagttaaaaagctcgtagttggatcttgggagc

SEQ ID NO: 58728 - DNA, 29 bp, Homo sapiens
gttaaaaagctcgtagttggatcttggga

SEQ ID NO: 58729 - DNA, 30 bp, Homo sapiens; identical to SEQ ID NO: 35647

SEQ ID NO: 58730 - DNA, 31 bp, Homo sapiens; identical to SEQ ID NO: 13648

SEQ ID NO: 58731 - DNA, 38 bp, Homo sapiens
gttaaaaagctcgtagttggatcttgggagcgggcggg

SEQ ID NO: 58732 - DNA, 41 bp, Homo sapiens
gttaaaaagctcgtagttggatcttgggagcgggcgggcgg

SEQ ID NO: 58733 - DNA, 42 bp, Homo sapiens
gttaaaaagctcgtagttggatcttgggagcgggcgggcggt

SEQ ID NO: 58734 - DNA, 43 bp, Homo sapiens
gttaaaaagctcgtagttggatcttgggagcgggcgggcggtc

SEQ ID NO: 58735 - DNA, 33 bp, Homo sapiens
tcgtagttggatcttgggagcgggcgggcggtc

SEQ ID NO: 58736 - DNA, 28 bp, Homo sapiens
gttggatcttgggagcgggcgggcggtc

SEQ ID NO: 58737 - DNA, 17 bp, Homo sapiens
cgggcgggcggtccgcc

SEQ ID NO: 58738 - DNA, 34 bp, Homo sapiens
gggcgggcggtccgccgcgaggcgagccaccgcc

SEQ ID NO: 58739 - DNA, 31 bp, Homo sapiens; identical to SEQ ID NO: 57065

SEQ ID NO: 58740 - DNA, 38 bp, Homo sapiens
gccgcgaggcgagccaccgcccgtccccgccccttgcc

SEQ ID NO: 58741 - DNA, 31 bp, Homo sapiens
cgtccccgccccttgcctctcggcgccccct

SEQ ID NO: 58742 - DNA, 33 bp, Homo sapiens
cgtccccgccccttgcctctcggcgccccctcg

SEQ ID NO: 58743 - DNA, 38 bp, Homo sapiens
cgtccccgccccttgcctctcggcgccccctcgatgct

SEQ ID NO: 58744 - DNA, 25 bp, Homo sapiens
ctctcggcgccccctcgatgctctt

SEQ ID NO: 58745 - DNA, 18 bp, Homo sapiens
cccgcggggcccgaagcg

SEQ ID NO: 58746 - DNA, 20 bp, Homo sapiens
cccgcggggcccgaagcgtt

SEQ ID NO: 58747 - DNA, 45 bp, Homo sapiens
cgaagcgtttactttgaaaaaattagagtgttcaaagcaggcccg

SEQ ID NO: 58748 - DNA, 44 bp, Homo sapiens; identical to SEQ ID NO: 57068

SEQ ID NO: 58749 - DNA, 43 bp, Homo sapiens
aagcgtttactttgaaaaaattagagtgttcaaagcaggcccg

SEQ ID NO: 58750 - DNA, 42 bp, Homo sapiens
agcgtttactttgaaaaaattagagtgttcaaagcaggcccg

SEQ ID NO: 58751 - DNA, 40 bp, Homo sapiens
cgtttactttgaaaaaattagagtgttcaaagcaggcccg

SEQ ID NO: 58752 - DNA, 36 bp, Homo sapiens
tactttgaaaaaattagagtgttcaaagcaggcccg

SEQ ID NO: 58753 - DNA, 32 bp, Homo sapiens; identical to SEQ ID NO: 13787

SEQ ID NO: 58754 - DNA, 26 bp, Homo sapiens
aaattagagtgttcaaagcaggcccg

SEQ ID NO: 58755 - DNA, 16 bp, Homo sapiens
gttcaaagcaggcccg

SEQ ID NO: 58756 - DNA, 36 bp, Homo sapiens; identical to SEQ ID NO: 13840

SEQ ID NO: 58757 - DNA, 35 bp, Homo sapiens; identical to SEQ ID NO: 13842

SEQ ID NO: 58758 - DNA, 33 bp, Homo sapiens; identical to SEQ ID NO: 13847

SEQ ID NO: 58759 - DNA, 30 bp, Homo sapiens; identical to SEQ ID NO: 13855

SEQ ID NO: 58760 - DNA, 29 bp, Homo sapiens
agccgcctggataccgcagctaggaataa

SEQ ID NO: 58761 - DNA, 44 bp, Homo sapiens
agccgcctggataccgcagctaggaataatggaataggaccgcg

SEQ ID NO: 58762 - DNA, 28 bp, Homo sapiens
gccgcctggataccgcagctaggaataa

SEQ ID NO: 58763 - DNA, 27 bp, Homo sapiens
ccgcctggataccgcagctaggaataa

SEQ ID NO: 58764 - DNA, 26 bp, Homo sapiens
cgcctggataccgcagctaggaataa

SEQ ID NO: 58765 - DNA, 25 bp, Homo sapiens
gcctggataccgcagctaggaataa

SEQ ID NO: 58766 - DNA, 22 bp, Homo sapiens
tggataccgcagctaggaataa

SEQ ID NO: 58767 - DNA, 21 bp, Homo sapiens
ggataccgcagctaggaataa

SEQ ID NO: 58768 - DNA, 17 bp, Homo sapiens
accgcagctaggaataa

SEQ ID NO: 58769 - DNA, 16 bp, Homo sapiens
ccgcagctaggaataa

SEQ ID NO: 58770 - DNA, 24 bp, Homo sapiens
aataatggaataggaccgcggttc

SEQ ID NO: 58771 - DNA, 18 bp, Homo sapiens
ggaataggaccgcggttc

SEQ ID NO: 58772 - DNA, 32 bp, Homo sapiens; identical to SEQ ID NO: 2453

SEQ ID NO: 58773 - DNA, 29 bp, Homo sapiens
cgcggttctattttgttggttttcggaac

SEQ ID NO: 58774 - DNA, 31 bp, Homo sapiens; identical to SEQ ID NO: 2455

SEQ ID NO: 58775 - DNA, 28 bp, Homo sapiens
gcggttctattttgttggttttcggaac

SEQ ID NO: 58776 - DNA, 30 bp, Homo sapiens; identical to SEQ ID NO: 13907

SEQ ID NO: 58777 - DNA, 27 bp, Homo sapiens
cggttctattttgttggttttcggaac

SEQ ID NO: 58778 - DNA, 29 bp, Homo sapiens
cggttctattttgttggttttcggaactg

SEQ ID NO: 58779 - DNA, 26 bp, Homo sapiens
ggttctattttgttggttttcggaac

SEQ ID NO: 58780 - DNA, 26 bp, Homo sapiens
gttctattttgttggttttcggaact

SEQ ID NO: 58781 - DNA, 33 bp, Homo sapiens; identical to SEQ ID NO: 13945

SEQ ID NO: 58782 - DNA, 22 bp, Homo sapiens
gttggttttcggaactgaggcc

SEQ ID NO: 58783 - DNA, 46 bp, Homo sapiens; identical to SEQ ID NO: 14043

SEQ ID NO: 58784 - DNA, 45 bp, Homo sapiens; identical to SEQ ID NO: 14047

SEQ ID NO: 58785 - DNA, 44 bp, Homo sapiens; identical to SEQ ID NO: 14049

SEQ ID NO: 58786 - DNA, 30 bp, Homo sapiens; identical to SEQ ID NO: 2488

SEQ ID NO: 58787 - DNA, 27 bp, Homo sapiens
aaattcttggaccggcgcaagacggac

SEQ ID NO: 58788 - DNA, 26 bp, Homo sapiens
aattcttggaccggcgcaagacggac

SEQ ID NO: 58789 - DNA, 25 bp, Homo sapiens
attcttggaccggcgcaagacggac

SEQ ID NO: 58790 - DNA, 18 bp, Homo sapiens
ttggaccggcgcaagacg

SEQ ID NO: 58791 - DNA, 16 bp, Homo sapiens
cggcgcaagacggacc

SEQ ID NO: 58792 - DNA, 28 bp, Homo sapiens
ttcattaatcaagaacgaaagtcggagg

SEQ ID NO: 58793 - DNA, 18 bp, Homo sapiens
aagaacgaaagtcggagg

SEQ ID NO: 58794 - DNA, 21 bp, Homo sapiens
aagaacgaaagtcggaggttc

SEQ ID NO: 58795 - DNA, 22 bp, Homo sapiens
aagaacgaaagtcggaggttcg

SEQ ID NO: 58796 - DNA, 26 bp, Homo sapiens
aagaacgaaagtcggaggttcgaaga

SEQ ID NO: 58797 - DNA, 31 bp, Homo sapiens; identical to SEQ ID NO: 2585

SEQ ID NO: 58798 - DNA, 20 bp, Homo sapiens
agaacgaaagtcggaggttc

SEQ ID NO: 58799 - DNA, 21 bp, Homo sapiens
agaacgaaagtcggaggttcg

SEQ ID NO: 58800 - DNA, 25 bp, Homo sapiens
agaacgaaagtcggaggttcgaaga

SEQ ID NO: 58801 - DNA, 30 bp, Homo sapiens; identical to SEQ ID NO: 2595

SEQ ID NO: 58802 - DNA, 20 bp, Homo sapiens
gaacgaaagtcggaggttcg

SEQ ID NO: 58803 - DNA, 19 bp, Homo sapiens
aacgaaagtcggaggttcg

SEQ ID NO: 58804 - DNA, 23 bp, Homo sapiens
aacgaaagtcggaggttcgaaga

SEQ ID NO: 58805 - DNA, 28 bp, Homo sapiens
aacgaaagtcggaggttcgaagacgatc

SEQ ID NO: 58806 - DNA, 18 bp, Homo sapiens
acgaaagtcggaggttcg

SEQ ID NO: 58807 - DNA, 21 bp, Homo sapiens
acgaaagtcggaggttcgaag

SEQ ID NO: 58808 - DNA, 22 bp, Homo sapiens
acgaaagtcggaggttcgaaga

SEQ ID NO: 58809 - DNA, 27 bp, Homo sapiens
acgaaagtcggaggttcgaagacgatc

SEQ ID NO: 58810 - DNA, 30 bp, Homo sapiens; identical to SEQ ID NO: 14428

SEQ ID NO: 58811 - DNA, 17 bp, Homo sapiens
aaagtcggaggttcgaa

SEQ ID NO: 58812 - DNA, 18 bp, Homo sapiens
aaagtcggaggttcgaag

SEQ ID NO: 58813 - DNA, 19 bp, Homo sapiens
aaagtcggaggttcgaaga

SEQ ID NO: 58814 - DNA, 20 bp, Homo sapiens
aaagtcggaggttcgaagac

SEQ ID NO: 58815 - DNA, 21 bp, Homo sapiens
aaagtcggaggttcgaagacg

SEQ ID NO: 58816 - DNA, 24 bp, Homo sapiens
aaagtcggaggttcgaagacgatc

SEQ ID NO: 58817 - DNA, 25 bp, Homo sapiens
aaagtcggaggttcgaagacgatca

SEQ ID NO: 58818 - DNA, 27 bp, Homo sapiens
aaagtcggaggttcgaagacgatcaga

SEQ ID NO: 58819 - DNA, 29 bp, Homo sapiens
aaagtcggaggttcgaagacgatcagata

SEQ ID NO: 58820 - DNA, 31 bp, Homo sapiens; identical to SEQ ID NO: 2641

SEQ ID NO: 58821 - DNA, 18 bp, Homo sapiens
aagtcggaggttcgaaga

SEQ ID NO: 58822 - DNA, 23 bp, Homo sapiens
aagtcggaggttcgaagacgatc

SEQ ID NO: 58823 - DNA, 16 bp, Homo sapiens
gtcggaggttcgaaga

SEQ ID NO: 58824 - DNA, 21 bp, Homo sapiens
gtcggaggttcgaagacgatc

SEQ ID NO: 58825 - DNA, 20 bp, Homo sapiens
tcggaggttcgaagacgatc

SEQ ID NO: 58826 - DNA, 19 bp, Homo sapiens
cggaggttcgaagacgatc

SEQ ID NO: 58827 - DNA, 21 bp, Homo sapiens
agataccgtcgtagttccgac

SEQ ID NO: 58828 - DNA, 17 bp, Homo sapiens
ggcgatgcggcggcgtt

SEQ ID NO: 58829 - DNA, 18 bp, Homo sapiens
atgacccgccgggcagct

SEQ ID NO: 58830 - DNA, 26 bp, Homo sapiens
atgacccgccgggcagcttccgggaa

SEQ ID NO: 58831 - DNA, 29 bp, Homo sapiens
atgacccgccgggcagcttccgggaaacc

SEQ ID NO: 58832 - DNA, 17 bp, Homo sapiens
tgacccgccgggcagct

SEQ ID NO: 58833 - DNA, 25 bp, Homo sapiens
tgacccgccgggcagcttccgggaa

SEQ ID NO: 58834 - DNA, 20 bp, Homo sapiens
cccgccgggcagcttccggg

SEQ ID NO: 58835 - DNA, 21 bp, Homo sapiens
cccgccgggcagcttccggga

SEQ ID NO: 58836 - DNA, 22 bp, Homo sapiens
cccgccgggcagcttccgggaa

SEQ ID NO: 58837 - DNA, 25 bp, Homo sapiens
cccgccgggcagcttccgggaaacc

SEQ ID NO: 58838 - DNA, 29 bp, Homo sapiens
cccgccgggcagcttccgggaaaccaaag

SEQ ID NO: 58839 - DNA, 41 bp, Homo sapiens; identical to SEQ ID NO: 14912

SEQ ID NO: 58840 - DNA, 41 bp, Homo sapiens
aattgacggaagggcaccaccaggagtggagcctgcggctt

SEQ ID NO: 58841 - DNA, 23 bp, Homo sapiens
caccaggagtggagcctgcggct

SEQ ID NO: 58842 - DNA, 22 bp, Homo sapiens
accaggagtggagcctgcggct

SEQ ID NO: 58843 - DNA, 23 bp, Homo sapiens
accaggagtggagcctgcggctt

SEQ ID NO: 58844 - DNA, 22 bp, Homo sapiens
ccaggagtggagcctgcggctt

SEQ ID NO: 58845 - DNA, 20 bp, Homo sapiens
aggagtggagcctgcggctt

SEQ ID NO: 58846 - DNA, 16 bp, Homo sapiens
gtggagcctgcggctt

SEQ ID NO: 58847 - DNA, 28 bp, Homo sapiens
aacacgggaaacctcacccggcccggac

SEQ ID NO: 58848 - DNA, 25 bp, Homo sapiens
acgggaaacctcacccggcccggac

SEQ ID NO: 58849 - DNA, 24 bp, Homo sapiens
cgggaaacctcacccggcccggac

SEQ ID NO: 58850 - DNA, 23 bp, Homo sapiens
gggaaacctcacccggcccggac

SEQ ID NO: 58851 - DNA, 22 bp, Homo sapiens
ggaaacctcacccggcccggac

SEQ ID NO: 58852 - DNA, 25 bp, Homo sapiens
ggaaacctcacccggcccggacacg

SEQ ID NO: 58853 - DNA, 35 bp, Homo sapiens; identical to SEQ ID NO: 15083

SEQ ID NO: 58854 - DNA, 21 bp, Homo sapiens
gaaacctcacccggcccggac

SEQ ID NO: 58855 - DNA, 24 bp, Homo sapiens
gaaacctcacccggcccggacacg

SEQ ID NO: 58856 - DNA, 20 bp, Homo sapiens
aaacctcacccggcccggac

SEQ ID NO: 58857 - DNA, 23 bp, Homo sapiens
aaacctcacccggcccggacacg

SEQ ID NO: 58858 - DNA, 19 bp, Homo sapiens
aacctcacccggcccggac

SEQ ID NO: 58859 - DNA, 22 bp, Homo sapiens
aacctcacccggcccggacacg

SEQ ID NO: 58860 - DNA, 18 bp, Homo sapiens
acctcacccggcccggac

SEQ ID NO: 58861 - DNA, 21 bp, Homo sapiens
acctcacccggcccggacacg

SEQ ID NO: 58862 - DNA, 17 bp, Homo sapiens
cctcacccggcccggac

SEQ ID NO: 58863 - DNA, 20 bp, Homo sapiens
cctcacccggcccggacacg

SEQ ID NO: 58864 - DNA, 19 bp, Homo sapiens
ctcacccggcccggacacg

SEQ ID NO: 58865 - DNA, 18 bp, Homo sapiens
tcacccggcccggacacg

SEQ ID NO: 58866 - DNA, 17 bp, Homo sapiens
cacccggcccggacacg

SEQ ID NO: 58867 - DNA, 18 bp, Homo sapiens
cccggcccggacacggac

SEQ ID NO: 58868 - DNA, 16 bp, Homo sapiens
cggcccggacacggac

SEQ ID NO: 58869 - DNA, 21 bp, Homo sapiens
ccggacacggacaggattgac

SEQ ID NO: 58870 - DNA, 22 bp, Homo sapiens
ccggacacggacaggattgaca

SEQ ID NO: 58871 - DNA, 40 bp, Homo sapiens; identical to SEQ ID NO: 15487

SEQ ID NO: 58872 - DNA, 34 bp, Homo sapiens; identical to SEQ ID NO: 15525

SEQ ID NO: 58873 - DNA, 36 bp, Homo sapiens; identical to SEQ ID NO: 15527

SEQ ID NO: 58874 - DNA, 39 bp, Homo sapiens; identical to SEQ ID NO: 15530

SEQ ID NO: 58875 - DNA, 40 bp, Homo sapiens; identical to SEQ ID NO: 15531

SEQ ID NO: 58876 - DNA, 54 bp, Homo sapiens; identical to SEQ ID NO: 57092

SEQ ID NO: 58877 - DNA, 33 bp, Homo sapiens; identical to SEQ ID NO: 2994

SEQ ID NO: 58878 - DNA, 26 bp, Homo sapiens
gataacgaacgagactctggcatgct

SEQ ID NO: 58879 - DNA, 18 bp, Homo sapiens
aacgaacgagactctggc

SEQ ID NO: 58880 - DNA, 19 bp, Homo sapiens
aacgaacgagactctggca

SEQ ID NO: 58881 - DNA, 21 bp, Homo sapiens
aacgaacgagactctggcatg

SEQ ID NO: 58882 - DNA, 23 bp, Homo sapiens
aacgaacgagactctggcatgct

SEQ ID NO: 58883 - DNA, 41 bp, Homo sapiens; identical to SEQ ID NO: 15765

SEQ ID NO: 58884 - DNA, 42 bp, Homo sapiens; identical to SEQ ID NO: 15766

SEQ ID NO: 58885 - DNA, 17 bp, Homo sapiens
acgaacgagactctggc

SEQ ID NO: 58886 - DNA, 18 bp, Homo sapiens
acgaacgagactctggca

SEQ ID NO: 58887 - DNA, 19 bp, Homo sapiens
acgaacgagactctggcat

SEQ ID NO: 58888 - DNA, 20 bp, Homo sapiens
acgaacgagactctggcatg

SEQ ID NO: 58889 - DNA, 21 bp, Homo sapiens
acgaacgagactctggcatgc

SEQ ID NO: 58890 - DNA, 22 bp, Homo sapiens
acgaacgagactctggcatgct

SEQ ID NO: 58891 - DNA, 23 bp, Homo sapiens
acgaacgagactctggcatgcta

SEQ ID NO: 58892 - DNA, 26 bp, Homo sapiens
acgaacgagactctggcatgctaact

SEQ ID NO: 58893 - DNA, 33 bp, Homo sapiens; identical to SEQ ID NO: 3131

SEQ ID NO: 58894 - DNA, 40 bp, Homo sapiens; identical to SEQ ID NO: 15795

SEQ ID NO: 58895 - DNA, 41 bp, Homo sapiens; identical to SEQ ID NO: 15796

SEQ ID NO: 58896 - DNA, 42 bp, Homo sapiens; identical to SEQ ID NO: 15797

SEQ ID NO: 58897 - DNA, 17 bp, Homo sapiens
cgaacgagactctggca

SEQ ID NO: 58898 - DNA, 39 bp, Homo sapiens; identical to SEQ ID NO: 15825

SEQ ID NO: 58899 - DNA, 18 bp, Homo sapiens
gaacgagactctggcatg

SEQ ID NO: 58900 - DNA, 20 bp, Homo sapiens
gaacgagactctggcatgct

SEQ ID NO: 58901 - DNA, 21 bp, Homo sapiens
gaacgagactctggcatgcta

SEQ ID NO: 58902 - DNA, 24 bp, Homo sapiens
gaacgagactctggcatgctaact

SEQ ID NO: 58903 - DNA, 38 bp, Homo sapiens; identical to SEQ ID NO: 15852

SEQ ID NO: 58904 - DNA, 16 bp, Homo sapiens
aacgagactctggcat

SEQ ID NO: 58905 - DNA, 17 bp, Homo sapiens
aacgagactctggcatg

SEQ ID NO: 58906 - DNA, 18 bp, Homo sapiens
aacgagactctggcatgc

SEQ ID NO: 58907 - DNA, 19 bp, Homo sapiens
aacgagactctggcatgct

SEQ ID NO: 58908 - DNA, 20 bp, Homo sapiens
aacgagactctggcatgcta

SEQ ID NO: 58909 - DNA, 21 bp, Homo sapiens
aacgagactctggcatgctaa

SEQ ID NO: 58910 - DNA, 22 bp, Homo sapiens
aacgagactctggcatgctaac

SEQ ID NO: 58911 - DNA, 23 bp, Homo sapiens
aacgagactctggcatgctaact

SEQ ID NO: 58912 - DNA, 24 bp, Homo sapiens
aacgagactctggcatgctaacta

SEQ ID NO: 58913 - DNA, 26 bp, Homo sapiens
aacgagactctggcatgctaactagt

SEQ ID NO: 58914 - DNA, 27 bp, Homo sapiens
aacgagactctggcatgctaactagtt

SEQ ID NO: 58915 - DNA, 30 bp, Homo sapiens; identical to SEQ ID NO: 3180

SEQ ID NO: 58916 - DNA, 32 bp, Homo sapiens; identical to SEQ ID NO: 3182

SEQ ID NO: 58917 - DNA, 33 bp, Homo sapiens; identical to SEQ ID NO: 3183

SEQ ID NO: 58918 - DNA, 35 bp, Homo sapiens; identical to SEQ ID NO: 15877

SEQ ID NO: 58919 - DNA, 36 bp, Homo sapiens; identical to SEQ ID NO: 15878

SEQ ID NO: 58920 - DNA, 37 bp, Homo sapiens; identical to SEQ ID NO: 15879

SEQ ID NO: 58921 - DNA, 38 bp, Homo sapiens; identical to SEQ ID NO: 15880

SEQ ID NO: 58922 - DNA, 16 bp, Homo sapiens
acgagactctggcatg

SEQ ID NO: 58923 - DNA, 17 bp, Homo sapiens
acgagactctggcatgc

SEQ ID NO: 58924 - DNA, 18 bp, Homo sapiens
acgagactctggcatgct

SEQ ID NO: 58925 - DNA, 19 bp, Homo sapiens
acgagactctggcatgcta

SEQ ID NO: 58926 - DNA, 21 bp, Homo sapiens
acgagactctggcatgctaac

SEQ ID NO: 58927 - DNA, 22 bp, Homo sapiens
acgagactctggcatgctaact

SEQ ID NO: 58928 - DNA, 26 bp, Homo sapiens
acgagactctggcatgctaactagtt

SEQ ID NO: 58929 - DNA, 29 bp, Homo sapiens
acgagactctggcatgctaactagttacg

SEQ ID NO: 58930 - DNA, 36 bp, Homo sapiens; identical to SEQ ID NO: 15907

SEQ ID NO: 58931 - DNA, 34 bp, Homo sapiens; identical to SEQ ID NO: 57102

SEQ ID NO: 58932 - DNA, 20 bp, Homo sapiens
gcgacccccgagcggtcggc

SEQ ID NO: 58933 - DNA, 23 bp, Homo sapiens
gcgacccccgagcggtcggcgtc

SEQ ID NO: 58934 - DNA, 24 bp, Homo sapiens
gcgacccccgagcggtcggcgtcc

SEQ ID NO: 58935 - DNA, 19 bp, Homo sapiens
cgacccccgagcggtcggc

SEQ ID NO: 58936 - DNA, 21 bp, Homo sapiens
gacccccgagcggtcggcgtc

SEQ ID NO: 58937 - DNA, 22 bp, Homo sapiens
gacccccgagcggtcggcgtcc

SEQ ID NO: 58938 - DNA, 20 bp, Homo sapiens
acccccgagcggtcggcgtc

SEQ ID NO: 58939 - DNA, 21 bp, Homo sapiens
acccccgagcggtcggcgtcc

SEQ ID NO: 58940 - DNA, 19 bp, Homo sapiens
cccccgagcggtcggcgtc

SEQ ID NO: 58941 - DNA, 20 bp, Homo sapiens
cccccgagcggtcggcgtcc

SEQ ID NO: 58942 - DNA, 27 bp, Homo sapiens
cccccgagcggtcggcgtcccccaact

SEQ ID NO: 58943 - DNA, 16 bp, Homo sapiens
ccccgagcggtcggcg

SEQ ID NO: 58944 - DNA, 18 bp, Homo sapiens
cccgagcggtcggcgtcc

SEQ ID NO: 58945 - DNA, 21 bp, Homo sapiens
cccgagcggtcggcgtccccc

SEQ ID NO: 58946 - DNA, 25 bp, Homo sapiens
cccgagcggtcggcgtcccccaact

SEQ ID NO: 58947 - DNA, 16 bp, Homo sapiens
cgagcggtcggcgtcc

SEQ ID NO: 58948 - DNA, 17 bp, Homo sapiens
cgagcggtcggcgtccc

SEQ ID NO: 58949 - DNA, 16 bp, Homo sapiens
gagcggtcggcgtccc

SEQ ID NO: 58950 - DNA, 16 bp, Homo sapiens
agcggtcggcgtcccc

SEQ ID NO: 58951 - DNA, 17 bp, Homo sapiens
agcggtcggcgtccccc

SEQ ID NO: 58952 - DNA, 19 bp, Homo sapiens
ataacaggtctgtgatgcc

SEQ ID NO: 58953 - DNA, 16 bp, Homo sapiens
acaggtctgtgatgcc

SEQ ID NO: 58954 - DNA, 28 bp, Homo sapiens
gctacactgactggctcagcgtgtgcct

SEQ ID NO: 58955 - DNA, 21 bp, Homo sapiens
ctgactggctcagcgtgtgcc

SEQ ID NO: 58956 - DNA, 17 bp, Homo sapiens
caccgcccgtcgctact

SEQ ID NO: 58957 - DNA, 45 bp, Homo sapiens
gattggatggtttagtgaggccctcggatcggccccgccggggtc

SEQ ID NO: 58958 - DNA, 48 bp, Homo sapiens
gattggatggtttagtgaggccctcggatcggccccgccggggtcggc

SEQ ID NO: 58959 - DNA, 30 bp, Homo sapiens; identical to SEQ ID NO: 16896

SEQ ID NO: 58960 - DNA, 41 bp, Homo sapiens
ggatggtttagtgaggccctcggatcggccccgccggggtc

SEQ ID NO: 58961 - DNA, 44 bp, Homo sapiens
ggatggtttagtgaggccctcggatcggccccgccggggtcggc

SEQ ID NO: 58962 - DNA, 29 bp, Homo sapiens
gatggtttagtgaggccctcggatcggcc

SEQ ID NO: 58963 - DNA, 42 bp, Homo sapiens
atggtttagtgaggccctcggatcggccccgccggggtcggc

SEQ ID NO: 58964 - DNA, 41 bp, Homo sapiens
tggtttagtgaggccctcggatcggccccgccggggtcggc

SEQ ID NO: 58965 - DNA, 40 bp, Homo sapiens
ggtttagtgaggccctcggatcggccccgccggggtcggc

SEQ ID NO: 58966 - DNA, 39 bp, Homo sapiens
gtttagtgaggccctcggatcggccccgccggggtcggc

SEQ ID NO: 58967 - DNA, 38 bp, Homo sapiens
tttagtgaggccctcggatcggccccgccggggtcggc

SEQ ID NO: 58968 - DNA, 37 bp, Homo sapiens; identical to SEQ ID NO: 57104

SEQ ID NO: 58969 - DNA, 36 bp, Homo sapiens
tagtgaggccctcggatcggccccgccggggtcggc

SEQ ID NO: 58970 - DNA, 35 bp, Homo sapiens; identical to SEQ ID NO: 16909

SEQ ID NO: 58971 - DNA, 34 bp, Homo sapiens
gtgaggccctcggatcggccccgccggggtcggc

SEQ ID NO: 58972 - DNA, 32 bp, Homo sapiens
gaggccctcggatcggccccgccggggtcggc

SEQ ID NO: 58973 - DNA, 28 bp, Homo sapiens
ccctcggatcggccccgccggggtcggc

SEQ ID NO: 58974 - DNA, 21 bp, Homo sapiens
cctcggatcggccccgccggg

SEQ ID NO: 58975 - DNA, 24 bp, Homo sapiens
cctcggatcggccccgccggggtc

SEQ ID NO: 58976 - DNA, 25 bp, Homo sapiens
cctcggatcggccccgccggggtcg

SEQ ID NO: 58977 - DNA, 27 bp, Homo sapiens
cctcggatcggccccgccggggtcggc

SEQ ID NO: 58978 - DNA, 21 bp, Homo sapiens
ctcggatcggccccgccgggg

SEQ ID NO: 58979 - DNA, 22 bp, Homo sapiens
ctcggatcggccccgccggggt

SEQ ID NO: 58980 - DNA, 23 bp, Homo sapiens
ctcggatcggccccgccggggtc

SEQ ID NO: 58981 - DNA, 26 bp, Homo sapiens
ctcggatcggccccgccggggtcggc

SEQ ID NO: 58982 - DNA, 27 bp, Homo sapiens
ctcggatcggccccgccggggtcggcc

SEQ ID NO: 58983 - DNA, 28 bp, Homo sapiens
ctcggatcggccccgccggggtcggccc

SEQ ID NO: 58984 - DNA, 22 bp, Homo sapiens
tcggatcggccccgccggggtc

SEQ ID NO: 58985 - DNA, 25 bp, Homo sapiens
tcggatcggccccgccggggtcggc

SEQ ID NO: 58986 - DNA, 21 bp, Homo sapiens
cggatcggccccgccggggtc

SEQ ID NO: 58987 - DNA, 24 bp, Homo sapiens
cggatcggccccgccggggtcggc

SEQ ID NO: 58988 - DNA, 23 bp, Homo sapiens
ggatcggccccgccggggtcggc

SEQ ID NO: 58989 - DNA, 20 bp, Homo sapiens
tcggccccgccggggtcggc

SEQ ID NO: 58990 - DNA, 16 bp, Homo sapiens
cggccccgccggggtc

SEQ ID NO: 58991 - DNA, 19 bp, Homo sapiens
cggccccgccggggtcggc

SEQ ID NO: 58992 - DNA, 20 bp, Homo sapiens
cggccccgccggggtcggcc

SEQ ID NO: 58993 - DNA, 21 bp, Homo sapiens
cggccccgccggggtcggccc

SEQ ID NO: 58994 - DNA, 18 bp, Homo sapiens
ggccccgccggggtcggc

SEQ ID NO: 58995 - DNA, 19 bp, Homo sapiens
ggccccgccggggtcggcc

SEQ ID NO: 58996 - DNA, 17 bp, Homo sapiens
gccccgccggggtcggc

SEQ ID NO: 58997 - DNA, 18 bp, Homo sapiens
gccccgccggggtcggcc

SEQ ID NO: 58998 - DNA, 19 bp, Homo sapiens
gccccgccggggtcggccc

SEQ ID NO: 58999 - DNA, 16 bp, Homo sapiens
ccccgccggggtcggc

SEQ ID NO: 59000 - DNA, 17 bp, Homo sapiens
ccccgccggggtcggcc

SEQ ID NO: 59001 - DNA, 18 bp, Homo sapiens
ccccgccggggtcggccc

SEQ ID NO: 59002 - DNA, 16 bp, Homo sapiens
cccgccggggtcggcc

SEQ ID NO: 59003 - DNA, 17 bp, Homo sapiens
cccgccggggtcggccc

SEQ ID NO: 59004 - DNA, 17 bp, Homo sapiens
cacggccctggcggagc

SEQ ID NO: 59005 - DNA, 16 bp, Homo sapiens
acggccctggcggagc

SEQ ID NO: 59006 - DNA, 17 bp, Homo sapiens
acggccctggcggagcg

SEQ ID NO: 59007 - DNA, 18 bp, Homo sapiens
acggccctggcggagcgc

SEQ ID NO: 59008 - DNA, 19 bp, Homo sapiens
acggccctggcggagcgct

SEQ ID NO: 59009 - DNA, 23 bp, Homo sapiens
acggccctggcggagcgctgaga

SEQ ID NO: 59010 - DNA, 24 bp, Homo sapiens
acggccctggcggagcgctgagaa

SEQ ID NO: 59011 - DNA, 25 bp, Homo sapiens
acggccctggcggagcgctgagaag

SEQ ID NO: 59012 - DNA, 26 bp, Homo sapiens
acggccctggcggagcgctgagaaga

SEQ ID NO: 59013 - DNA, 27 bp, Homo sapiens
acggccctggcggagcgctgagaagac

SEQ ID NO: 59014 - DNA, 28 bp, Homo sapiens
acggccctggcggagcgctgagaagacg

SEQ ID NO: 59015 - DNA, 32 bp, Homo sapiens; identical to SEQ ID NO: 3449

SEQ ID NO: 59016 - DNA, 33 bp, Homo sapiens; identical to SEQ ID NO: 16974

SEQ ID NO: 59017 - DNA, 34 bp, Homo sapiens; identical to SEQ ID NO: 16975

SEQ ID NO: 59018 - DNA, 35 bp, Homo sapiens; identical to SEQ ID NO: 16976

SEQ ID NO: 59019 - DNA, 36 bp, Homo sapiens; identical to SEQ ID NO: 16977

SEQ ID NO: 59020 - DNA, 38 bp, Homo sapiens; identical to SEQ ID NO: 57131

SEQ ID NO: 59021 - DNA, 39 bp, Homo sapiens; identical to SEQ ID NO: 16978

SEQ ID NO: 59022 - DNA, 40 bp, Homo sapiens; identical to SEQ ID NO: 16979

SEQ ID NO: 59023 - DNA, 41 bp, Homo sapiens; identical to SEQ ID NO: 16980

SEQ ID NO: 59024 - DNA, 42 bp, Homo sapiens; identical to SEQ ID NO: 16981

SEQ ID NO: 59025 - DNA, 43 bp, Homo sapiens; identical to SEQ ID NO: 16982

SEQ ID NO: 59026 - DNA, 44 bp, Homo sapiens; identical to SEQ ID NO: 16983

SEQ ID NO: 59027 - DNA, 45 bp, Homo sapiens; identical to SEQ ID NO: 16984

SEQ ID NO: 59028 - DNA, 47 bp, Homo sapiens; identical to SEQ ID NO: 16985

SEQ ID NO: 59029 - DNA, 16 bp, Homo sapiens
cggccctggcggagcg

SEQ ID NO: 59030 - DNA, 17 bp, Homo sapiens
cggccctggcggagcgc

SEQ ID NO: 59031 - DNA, 18 bp, Homo sapiens
cggccctggcggagcgct

SEQ ID NO: 59032 - DNA, 22 bp, Homo sapiens
cggccctggcggagcgctgaga

SEQ ID NO: 59033 - DNA, 25 bp, Homo sapiens
cggccctggcggagcgctgagaaga

SEQ ID NO: 59034 - DNA, 27 bp, Homo sapiens
cggccctggcggagcgctgagaagacg

SEQ ID NO: 59035 - DNA, 30 bp, Homo sapiens; identical to SEQ ID NO: 16998

SEQ ID NO: 59036 - DNA, 33 bp, Homo sapiens; identical to SEQ ID NO: 3458

SEQ ID NO: 59037 - DNA, 34 bp, Homo sapiens
cggccctggcggagcgctgagaagacggtcgaac

SEQ ID NO: 59038 - DNA, 35 bp, Homo sapiens
cggccctggcggagcgctgagaagacggtcgaact

SEQ ID NO: 59039 - DNA, 38 bp, Homo sapiens
cggccctggcggagcgctgagaagacggtcgaacttga

SEQ ID NO: 59040 - DNA, 40 bp, Homo sapiens; identical to SEQ ID NO: 17002

SEQ ID NO: 59041 - DNA, 41 bp, Homo sapiens; identical to SEQ ID NO: 17003

SEQ ID NO: 59042 - DNA, 43 bp, Homo sapiens; identical to SEQ ID NO: 17005

SEQ ID NO: 59043 - DNA, 44 bp, Homo sapiens; identical to SEQ ID NO: 17006

SEQ ID NO: 59044 - DNA, 29 bp, Homo sapiens
ggccctggcggagcgctgagaagacggtc

SEQ ID NO: 59045 - DNA, 34 bp, Homo sapiens
ggccctggcggagcgctgagaagacggtcgaact

SEQ ID NO: 59046 - DNA, 37 bp, Homo sapiens; identical to SEQ ID NO: 57145

SEQ ID NO: 59047 - DNA, 39 bp, Homo sapiens; identical to SEQ ID NO: 17015

SEQ ID NO: 59048 - DNA, 43 bp, Homo sapiens; identical to SEQ ID NO: 17016

SEQ ID NO: 59049 - DNA, 45 bp, Homo sapiens
ggccctggcggagcgctgagaagacggtcgaacttgactatctag

SEQ ID NO: 59050 - DNA, 36 bp, Homo sapiens; identical to SEQ ID NO: 57148

SEQ ID NO: 59051 - DNA, 38 bp, Homo sapiens; identical to SEQ ID NO: 57149

SEQ ID NO: 59052 - DNA, 41 bp, Homo sapiens
gccctggcggagcgctgagaagacggtcgaacttgactatc

SEQ ID NO: 59053 - DNA, 42 bp, Homo sapiens; identical to SEQ ID NO: 57150

SEQ ID NO: 59054 - DNA, 44 bp, Homo sapiens
gccctggcggagcgctgagaagacggtcgaacttgactatctag

SEQ ID NO: 59055 - DNA, 46 bp, Homo sapiens
gccctggcggagcgctgagaagacggtcgaacttgactatctagag

SEQ ID NO: 59056 - DNA, 37 bp, Homo sapiens
ccctggcggagcgctgagaagacggtcgaacttgact

SEQ ID NO: 59057 - DNA, 23 bp, Homo sapiens
agcgctgagaagacggtcgaact

SEQ ID NO: 59058 - DNA, 26 bp, Homo sapiens
agcgctgagaagacggtcgaacttga

SEQ ID NO: 59059 - DNA, 32 bp, Homo sapiens; identical to SEQ ID NO: 3464

SEQ ID NO: 59060 - DNA, 34 bp, Homo sapiens; identical to SEQ ID NO: 57153

SEQ ID NO: 59061 - DNA, 36 bp, Homo sapiens
agcgctgagaagacggtcgaacttgactatctagag

SEQ ID NO: 59062 - DNA, 22 bp, Homo sapiens
gcgctgagaagacggtcgaact

SEQ ID NO: 59063 - DNA, 25 bp, Homo sapiens
gcgctgagaagacggtcgaacttga

SEQ ID NO: 59064 - DNA, 31 bp, Homo sapiens; identical to SEQ ID NO: 3465

SEQ ID NO: 59065 - DNA, 32 bp, Homo sapiens; identical to SEQ ID NO: 17063

SEQ ID NO: 59066 - DNA, 33 bp, Homo sapiens; identical to SEQ ID NO: 17064

SEQ ID NO: 59067 - DNA, 34 bp, Homo sapiens; identical to SEQ ID NO: 57156

SEQ ID NO: 59068 - DNA, 35 bp, Homo sapiens; identical to SEQ ID NO: 57157

SEQ ID NO: 59069 - DNA, 36 bp, Homo sapiens
gcgctgagaagacggtcgaacttgactatctagagg

SEQ ID NO: 59070 - DNA, 37 bp, Homo sapiens
gcgctgagaagacggtcgaacttgactatctagagga

SEQ ID NO: 59071 - DNA, 40 bp, Homo sapiens
gcgctgagaagacggtcgaacttgactatctagaggaagt

SEQ ID NO: 59072 - DNA, 29 bp, Homo sapiens
cgctgagaagacggtcgaacttgactatc

SEQ ID NO: 59073 - DNA, 30 bp, Homo sapiens; identical to SEQ ID NO: 3466

SEQ ID NO: 59074 - DNA, 32 bp, Homo sapiens; identical to SEQ ID NO: 17071

SEQ ID NO: 59075 - DNA, 34 bp, Homo sapiens
cgctgagaagacggtcgaacttgactatctagag

SEQ ID NO: 59076 - DNA, 26 bp, Homo sapiens
gctgagaagacggtcgaacttgacta

SEQ ID NO: 59077 - DNA, 28 bp, Homo sapiens
gctgagaagacggtcgaacttgactatc

SEQ ID NO: 59078 - DNA, 29 bp, Homo sapiens
gctgagaagacggtcgaacttgactatct

SEQ ID NO: 59079 - DNA, 31 bp, Homo sapiens; identical to SEQ ID NO: 17079

SEQ ID NO: 59080 - DNA, 32 bp, Homo sapiens
gctgagaagacggtcgaacttgactatctaga

SEQ ID NO: 59081 - DNA, 33 bp, Homo sapiens; identical to SEQ ID NO: 17080

SEQ ID NO: 59082 - DNA, 24 bp, Homo sapiens
ctgagaagacggtcgaacttgact

SEQ ID NO: 59083 - DNA, 27 bp, Homo sapiens
ctgagaagacggtcgaacttgactatc

SEQ ID NO: 59084 - DNA, 28 bp, Homo sapiens
ctgagaagacggtcgaacttgactatct

SEQ ID NO: 59085 - DNA, 30 bp, Homo sapiens; identical to SEQ ID NO: 3481

SEQ ID NO: 59086 - DNA, 33 bp, Homo sapiens; identical to SEQ ID NO: 3482

SEQ ID NO: 59087 - DNA, 23 bp, Homo sapiens
tgagaagacggtcgaacttgact

SEQ ID NO: 59088 - DNA, 27 bp, Homo sapiens
tgagaagacggtcgaacttgactatct

SEQ ID NO: 59089 - DNA, 16 bp, Homo sapiens
gagaagacggtcgaac

SEQ ID NO: 59090 - DNA, 17 bp, Homo sapiens
gagaagacggtcgaact

SEQ ID NO: 59091 - DNA, 20 bp, Homo sapiens
gagaagacggtcgaacttga

SEQ ID NO: 59092 - DNA, 22 bp, Homo sapiens
gagaagacggtcgaacttgact

SEQ ID NO: 59093 - DNA, 23 bp, Homo sapiens
gagaagacggtcgaacttgacta

SEQ ID NO: 59094 - DNA, 25 bp, Homo sapiens
gagaagacggtcgaacttgactatc

SEQ ID NO: 59095 - DNA, 26 bp, Homo sapiens
gagaagacggtcgaacttgactatct

SEQ ID NO: 59096 - DNA, 28 bp, Homo sapiens
gagaagacggtcgaacttgactatctag

SEQ ID NO: 59097 - DNA, 32 bp, Homo sapiens; identical to SEQ ID NO: 3502

SEQ ID NO: 59098 - DNA, 35 bp, Homo sapiens; identical to SEQ ID NO: 17123

SEQ ID NO: 59099 - DNA, 21 bp, Homo sapiens
agaagacggtcgaacttgact

SEQ ID NO: 59100 - DNA, 27 bp, Homo sapiens
agaagacggtcgaacttgactatctag

SEQ ID NO: 59101 - DNA, 20 bp, Homo sapiens
gaagacggtcgaacttgact

SEQ ID NO: 59102 - DNA, 19 bp, Homo sapiens
aagacggtcgaacttgact

SEQ ID NO: 59103 - DNA, 25 bp, Homo sapiens
aagacggtcgaacttgactatctag

SEQ ID NO: 59104 - DNA, 20 bp, Homo sapiens
acggtcgaacttgactatct

SEQ ID NO: 59105 - DNA, 52 bp, Homo sapiens
aagtaaaagtcgtaacaaggtttccgtaggtgaacctgcggaaggatcatta

SEQ ID NO: 59106 - DNA, 51 bp, Homo sapiens
agtaaaagtcgtaacaaggtttccgtaggtgaacctgcggaaggatcatta

SEQ ID NO: 59107 - DNA, 50 bp, Homo sapiens; identical to SEQ ID NO: 57167

SEQ ID NO: 59108 - DNA, 49 bp, Homo sapiens; identical to SEQ ID NO: 57168

SEQ ID NO: 59109 - DNA, 48 bp, Homo sapiens; identical to SEQ ID NO: 57169

SEQ ID NO: 59110 - DNA, 47 bp, Homo sapiens
aaagtcgtaacaaggtttccgtaggtgaacctgcggaaggatcatta

SEQ ID NO: 59111 - DNA, 45 bp, Homo sapiens
agtcgtaacaaggtttccgtaggtgaacctgcggaaggatcatta

SEQ ID NO: 59112 - DNA, 44 bp, Homo sapiens; identical to SEQ ID NO: 57170

SEQ ID NO: 59113 - DNA, 43 bp, Homo sapiens; identical to SEQ ID NO: 57171

SEQ ID NO: 59114 - DNA, 42 bp, Homo sapiens; identical to SEQ ID NO: 57172

SEQ ID NO: 59115 - DNA, 44 bp, Homo sapiens
cgtaacaaggtttccgtaggtgaacctgcggaaggatcattaac

SEQ ID NO: 59116 - DNA, 39 bp, Homo sapiens; identical to SEQ ID NO: 57173

SEQ ID NO: 59117 - DNA, 40 bp, Homo sapiens; identical to SEQ ID NO: 57174

SEQ ID NO: 59118 - DNA, 41 bp, Homo sapiens; identical to SEQ ID NO: 57175

SEQ ID NO: 59119 - DNA, 43 bp, Homo sapiens; identical to SEQ ID NO: 57176

SEQ ID NO: 59120 - DNA, 44 bp, Homo sapiens
gtaacaaggtttccgtaggtgaacctgcggaaggatcattaacg

SEQ ID NO: 59121 - DNA, 40 bp, Homo sapiens; identical to SEQ ID NO: 57177

SEQ ID NO: 59122 - DNA, 39 bp, Homo sapiens; identical to SEQ ID NO: 57178

SEQ ID NO: 59123 - DNA, 38 bp, Homo sapiens; identical to SEQ ID NO: 57179

SEQ ID NO: 59124 - DNA, 36 bp, Homo sapiens; identical to SEQ ID NO: 57180

SEQ ID NO: 59125 - DNA, 35 bp, Homo sapiens; identical to SEQ ID NO: 57181

SEQ ID NO: 59126 - DNA, 33 bp, Homo sapiens; identical to SEQ ID NO: 17216

SEQ ID NO: 59127 - DNA, 32 bp, Homo sapiens; identical to SEQ ID NO: 3525

SEQ ID NO: 59128 - DNA, 29 bp, Homo sapiens
ccgtaggtgaacctgcggaaggatcatta

SEQ ID NO: 59129 - DNA, 28 bp, Homo sapiens
cgtaggtgaacctgcggaaggatcatta

SEQ ID NO: 59130 - DNA, 27 bp, Homo sapiens
gtaggtgaacctgcggaaggatcatta

SEQ ID NO: 59131 - DNA, 26 bp, Homo sapiens
taggtgaacctgcggaaggatcatta

SEQ ID NO: 59132 - DNA, 24 bp, Homo sapiens
ggtgaacctgcggaaggatcatta

SEQ ID NO: 59133 - DNA, 18 bp, Homo sapiens
cctgcggaaggatcatta

SEQ ID NO: 59134 - DNA, 17 bp, Homo sapiens
ctgcggaaggatcatta

SEQ ID NO: 59135 - DNA, 16 bp, Homo sapiens
tgcggaaggatcatta

SEQ ID NO: 59136 - DNA, 17 bp, Homo sapiens
gaaggatcattaacgga

SEQ ID NO: 59137 - DNA, 19 bp, Homo sapiens
gaaggatcattaacggagc

SEQ ID NO: 59138 - DNA, 20 bp, Homo sapiens
gaaggatcattaacggagcc

SEQ ID NO: 59139 - DNA, 18 bp, Homo sapiens
cgcgcggcggcggcggcg

SEQ ID NO: 59140 - DNA, 17 bp, Homo sapiens
cccggcggccgtcgcgc

SEQ ID NO: 59141 - DNA, 19 bp, Homo sapiens
cccggcggccgtcgcgcgc

SEQ ID NO: 59142 - DNA, 20 bp, Homo sapiens
cccggcggccgtcgcgcgcc

SEQ ID NO: 59143 - DNA, 24 bp, Homo sapiens
tcgacctcgtacgactcttagcgg

SEQ ID NO: 59144 - DNA, 43 bp, Homo sapiens; identical to SEQ ID NO: 17297

SEQ ID NO: 59145 - DNA, 22 bp, Homo sapiens
gacctcgtacgactcttagcgg

SEQ ID NO: 59146 - DNA, 42 bp, Homo sapiens; identical to SEQ ID NO: 17298

SEQ ID NO: 59147 - DNA, 21 bp, Homo sapiens
acctcgtacgactcttagcgg

SEQ ID NO: 59148 - DNA, 41 bp, Homo sapiens; identical to SEQ ID NO: 17300

SEQ ID NO: 59149 - DNA, 20 bp, Homo sapiens
cctcgtacgactcttagcgg

SEQ ID NO: 59150 - DNA, 40 bp, Homo sapiens; identical to SEQ ID NO: 17303

SEQ ID NO: 59151 - DNA, 17 bp, Homo sapiens
ctcgtacgactcttagc

SEQ ID NO: 59152 - DNA, 18 bp, Homo sapiens
ctcgtacgactcttagcg

SEQ ID NO: 59153 - DNA, 19 bp, Homo sapiens
ctcgtacgactcttagcgg

SEQ ID NO: 59154 - DNA, 37 bp, Homo sapiens; identical to SEQ ID NO: 17316

SEQ ID NO: 59155 - DNA, 39 bp, Homo sapiens; identical to SEQ ID NO: 17317

SEQ ID NO: 59156 - DNA, 16 bp, Homo sapiens
tcgtacgactcttagc

SEQ ID NO: 59157 - DNA, 17 bp, Homo sapiens
tcgtacgactcttagcg

SEQ ID NO: 59158 - DNA, 18 bp, Homo sapiens
tcgtacgactcttagcgg

SEQ ID NO: 59159 - DNA, 24 bp, Homo sapiens
tcgtacgactcttagcggtggatc

SEQ ID NO: 59160 - DNA, 27 bp, Homo sapiens
tcgtacgactcttagcggtggatcact

SEQ ID NO: 59161 - DNA, 31 bp, Homo sapiens; identical to SEQ ID NO: 17329

SEQ ID NO: 59162 - DNA, 32 bp, Homo sapiens; identical to SEQ ID NO: 3555

SEQ ID NO: 59163 - DNA, 36 bp, Homo sapiens; identical to SEQ ID NO: 17332

SEQ ID NO: 59164 - DNA, 38 bp, Homo sapiens; identical to SEQ ID NO: 17334

SEQ ID NO: 59165 - DNA, 40 bp, Homo sapiens; identical to SEQ ID NO: 57207

SEQ ID NO: 59166 - DNA, 42 bp, Homo sapiens; identical to SEQ ID NO: 57208

SEQ ID NO: 59167 - DNA, 17 bp, Homo sapiens
cgtacgactcttagcgg

SEQ ID NO: 59168 - DNA, 35 bp, Homo sapiens; identical to SEQ ID NO: 17346

SEQ ID NO: 59169 - DNA, 37 bp, Homo sapiens; identical to SEQ ID NO: 17348

SEQ ID NO: 59170 - DNA, 16 bp, Homo sapiens
gtacgactcttagcgg

SEQ ID NO: 59171 - DNA, 17 bp, Homo sapiens
gtacgactcttagcggt

SEQ ID NO: 59172 - DNA, 29 bp, Homo sapiens
gtacgactcttagcggtggatcactcggc

SEQ ID NO: 59173 - DNA, 34 bp, Homo sapiens
gtacgactcttagcggtggatcactcggctcgtg

SEQ ID NO: 59174 - DNA, 36 bp, Homo sapiens; identical to SEQ ID NO: 57213

SEQ ID NO: 59175 - DNA, 35 bp, Homo sapiens
tacgactcttagcggtggatcactcggctcgtgcg

SEQ ID NO: 59176 - DNA, 27 bp, Homo sapiens
acgactcttagcggtggatcactcggc

SEQ ID NO: 59177 - DNA, 28 bp, Homo sapiens
acgactcttagcggtggatcactcggct

SEQ ID NO: 59178 - DNA, 34 bp, Homo sapiens
acgactcttagcggtggatcactcggctcgtgcg

SEQ ID NO: 59179 - DNA, 16 bp, Homo sapiens
cgactcttagcggtgg

SEQ ID NO: 59180 - DNA, 17 bp, Homo sapiens
cgactcttagcggtgga

SEQ ID NO: 59181 - DNA, 18 bp, Homo sapiens
cgactcttagcggtggat

SEQ ID NO: 59182 - DNA, 19 bp, Homo sapiens
cgactcttagcggtggatc

SEQ ID NO: 59183 - DNA, 22 bp, Homo sapiens
cgactcttagcggtggatcact

SEQ ID NO: 59184 - DNA, 25 bp, Homo sapiens
cgactcttagcggtggatcactcgg

SEQ ID NO: 59185 - DNA, 26 bp, Homo sapiens
cgactcttagcggtggatcactcggc

SEQ ID NO: 59186 - DNA, 27 bp, Homo sapiens
cgactcttagcggtggatcactcggct

SEQ ID NO: 59187 - DNA, 28 bp, Homo sapiens
cgactcttagcggtggatcactcggctc

SEQ ID NO: 59188 - DNA, 29 bp, Homo sapiens
cgactcttagcggtggatcactcggctcg

SEQ ID NO: 59189 - DNA, 30 bp, Homo sapiens; identical to SEQ ID NO: 3579

SEQ ID NO: 59190 - DNA, 31 bp, Homo sapiens; identical to SEQ ID NO: 3580

SEQ ID NO: 59191 - DNA, 32 bp, Homo sapiens; identical to SEQ ID NO: 3581

SEQ ID NO: 59192 - DNA, 33 bp, Homo sapiens; identical to SEQ ID NO: 3582

SEQ ID NO: 59193 - DNA, 34 bp, Homo sapiens; identical to SEQ ID NO: 17395

SEQ ID NO: 59194 - DNA, 35 bp, Homo sapiens; identical to SEQ ID NO: 17396

SEQ ID NO: 59195 - DNA, 36 bp, Homo sapiens; identical to SEQ ID NO: 17397

SEQ ID NO: 59196 - DNA, 37 bp, Homo sapiens; identical to SEQ ID NO: 17398

SEQ ID NO: 59197 - DNA, 38 bp, Homo sapiens; identical to SEQ ID NO: 17399

SEQ ID NO: 59198 - DNA, 39 bp, Homo sapiens; identical to SEQ ID NO: 17400

SEQ ID NO: 59199 - DNA, 17 bp, Homo sapiens
gactcttagcggtggat

SEQ ID NO: 59200 - DNA, 18 bp, Homo sapiens
gactcttagcggtggatc

SEQ ID NO: 59201 - DNA, 21 bp, Homo sapiens
gactcttagcggtggatcact

SEQ ID NO: 59202 - DNA, 24 bp, Homo sapiens
gactcttagcggtggatcactcgg

SEQ ID NO: 59203 - DNA, 25 bp, Homo sapiens
gactcttagcggtggatcactcggc

SEQ ID NO: 59204 - DNA, 26 bp, Homo sapiens
gactcttagcggtggatcactcggct

SEQ ID NO: 59205 - DNA, 27 bp, Homo sapiens
gactcttagcggtggatcactcggctc

SEQ ID NO: 59206 - DNA, 28 bp, Homo sapiens
gactcttagcggtggatcactcggctcg

SEQ ID NO: 59207 - DNA, 29 bp, Homo sapiens
gactcttagcggtggatcactcggctcgt

SEQ ID NO: 59208 - DNA, 30 bp, Homo sapiens; identical to SEQ ID NO: 3590

SEQ ID NO: 59209 - DNA, 32 bp, Homo sapiens; identical to SEQ ID NO: 3591

SEQ ID NO: 59210 - DNA, 34 bp, Homo sapiens; identical to SEQ ID NO: 17421

SEQ ID NO: 59211 - DNA, 36 bp, Homo sapiens; identical to SEQ ID NO: 17422

SEQ ID NO: 59212 - DNA, 16 bp, Homo sapiens
actcttagcggtggat

SEQ ID NO: 59213 - DNA, 17 bp, Homo sapiens
actcttagcggtggatc

SEQ ID NO: 59214 - DNA, 20 bp, Homo sapiens
actcttagcggtggatcact

SEQ ID NO: 59215 - DNA, 24 bp, Homo sapiens
actcttagcggtggatcactcggc

SEQ ID NO: 59216 - DNA, 25 bp, Homo sapiens
actcttagcggtggatcactcggct

SEQ ID NO: 59217 - DNA, 23 bp, Homo sapiens
ctcttagcggtggatcactcggc

SEQ ID NO: 59218 - DNA, 24 bp, Homo sapiens
ctcttagcggtggatcactcggct

SEQ ID NO: 59219 - DNA, 22 bp, Homo sapiens
tcttagcggtggatcactcggc

SEQ ID NO: 59220 - DNA, 16 bp, Homo sapiens
cggtggatcactcggc

SEQ ID NO: 59221 - DNA, 17 bp, Homo sapiens
cggtggatcactcggct

SEQ ID NO: 59222 - DNA, 27 bp, Homo sapiens
cggtggatcactcggctcgtgcgtcga

SEQ ID NO: 59223 - DNA, 28 bp, Homo sapiens
cggtggatcactcggctcgtgcgtcgat

SEQ ID NO: 59224 - DNA, 22 bp, Homo sapiens
tcactcggctcgtgcgtcgatg

SEQ ID NO: 59225 - DNA, 20 bp, Homo sapiens
actcggctcgtgcgtcgatg

SEQ ID NO: 59226 - DNA, 17 bp, Homo sapiens
aagaacgcagctagctg

SEQ ID NO: 59227 - DNA, 42 bp, Homo sapiens; identical to SEQ ID NO: 57239

SEQ ID NO: 59228 - DNA, 43 bp, Homo sapiens; identical to SEQ ID NO: 57240

SEQ ID NO: 59229 - DNA, 19 bp, Homo sapiens
gcagctagctgcgagaatt

SEQ ID NO: 59230 - DNA, 31 bp, Homo sapiens; identical to SEQ ID NO: 3612

SEQ ID NO: 59231 - DNA, 35 bp, Homo sapiens
gcagctagctgcgagaattaatgtgaattgcagga

SEQ ID NO: 59232 - DNA, 36 bp, Homo sapiens; identical to SEQ ID NO: 17525

SEQ ID NO: 59233 - DNA, 37 bp, Homo sapiens; identical to SEQ ID NO: 17526

SEQ ID NO: 59234 - DNA, 35 bp, Homo sapiens
cagctagctgcgagaattaatgtgaattgcaggac

SEQ ID NO: 59235 - DNA, 27 bp, Homo sapiens
tgcgagaattaatgtgaattgcaggac

SEQ ID NO: 59236 - DNA, 26 bp, Homo sapiens
gcgagaattaatgtgaattgcaggac

SEQ ID NO: 59237 - DNA, 25 bp, Homo sapiens
cgagaattaatgtgaattgcaggac

SEQ ID NO: 59238 - DNA, 26 bp, Homo sapiens
cgagaattaatgtgaattgcaggaca

SEQ ID NO: 59239 - DNA, 24 bp, Homo sapiens
gagaattaatgtgaattgcaggac

SEQ ID NO: 59240 - DNA, 25 bp, Homo sapiens
gagaattaatgtgaattgcaggaca

SEQ ID NO: 59241 - DNA, 23 bp, Homo sapiens
agaattaatgtgaattgcaggac

SEQ ID NO: 59242 - DNA, 24 bp, Homo sapiens
agaattaatgtgaattgcaggaca

SEQ ID NO: 59243 - DNA, 22 bp, Homo sapiens
gaattaatgtgaattgcaggac

SEQ ID NO: 59244 - DNA, 23 bp, Homo sapiens
gaattaatgtgaattgcaggaca

SEQ ID NO: 59245 - DNA, 21 bp, Homo sapiens
aattaatgtgaattgcaggac

SEQ ID NO: 59246 - DNA, 22 bp, Homo sapiens
aattaatgtgaattgcaggaca

SEQ ID NO: 59247 - DNA, 24 bp, Homo sapiens
aattaatgtgaattgcaggacaca

SEQ ID NO: 59248 - DNA, 20 bp, Homo sapiens
attaatgtgaattgcaggac

SEQ ID NO: 59249 - DNA, 21 bp, Homo sapiens
attaatgtgaattgcaggaca

SEQ ID NO: 59250 - DNA, 23 bp, Homo sapiens
attaatgtgaattgcaggacaca

SEQ ID NO: 59251 - DNA, 19 bp, Homo sapiens
ttaatgtgaattgcaggac

SEQ ID NO: 59252 - DNA, 20 bp, Homo sapiens
ttaatgtgaattgcaggaca

SEQ ID NO: 59253 - DNA, 22 bp, Homo sapiens
ttaatgtgaattgcaggacaca

SEQ ID NO: 59254 - DNA, 18 bp, Homo sapiens
taatgtgaattgcaggac

SEQ ID NO: 59255 - DNA, 19 bp, Homo sapiens
taatgtgaattgcaggaca

SEQ ID NO: 59256 - DNA, 21 bp, Homo sapiens
taatgtgaattgcaggacaca

SEQ ID NO: 59257 - DNA, 18 bp, Homo sapiens
aatgtgaattgcaggaca

SEQ ID NO: 59258 - DNA, 17 bp, Homo sapiens
atgtgaattgcaggaca

SEQ ID NO: 59259 - DNA, 46 bp, Homo sapiens; identical to SEQ ID NO: 17667

SEQ ID NO: 59260 - DNA, 45 bp, Homo sapiens; identical to SEQ ID NO: 17730

SEQ ID NO: 59261 - DNA, 43 bp, Homo sapiens; identical to SEQ ID NO: 17742

SEQ ID NO: 59262 - DNA, 44 bp, Homo sapiens; identical to SEQ ID NO: 17743

SEQ ID NO: 59263 - DNA, 41 bp, Homo sapiens; identical to SEQ ID NO: 17760

SEQ ID NO: 59264 - DNA, 42 bp, Homo sapiens; identical to SEQ ID NO: 17761

SEQ ID NO: 59265 - DNA, 43 bp, Homo sapiens; identical to SEQ ID NO: 17762

SEQ ID NO: 59266 - DNA, 39 bp, Homo sapiens; identical to SEQ ID NO: 17777

SEQ ID NO: 59267 - DNA, 40 bp, Homo sapiens; identical to SEQ ID NO: 17778

SEQ ID NO: 59268 - DNA, 41 bp, Homo sapiens; identical to SEQ ID NO: 17779

SEQ ID NO: 59269 - DNA, 42 bp, Homo sapiens; identical to SEQ ID NO: 17780

SEQ ID NO: 59270 - DNA, 39 bp, Homo sapiens; identical to SEQ ID NO: 17793

SEQ ID NO: 59271 - DNA, 40 bp, Homo sapiens; identical to SEQ ID NO: 17794

SEQ ID NO: 59272 - DNA, 41 bp, Homo sapiens; identical to SEQ ID NO: 17795

SEQ ID NO: 59273 - DNA, 42 bp, Homo sapiens; identical to SEQ ID NO: 17796

SEQ ID NO: 59274 - DNA, 73 bp, Homo sapiens; identical to SEQ ID NO: 57272

SEQ ID NO: 59275 - DNA, 34 bp, Homo sapiens; identical to SEQ ID NO: 17839

SEQ ID NO: 59276 - DNA, 34 bp, Homo sapiens; identical to SEQ ID NO: 17848

SEQ ID NO: 59277 - DNA, 27 bp, Homo sapiens
gacacttcgaacgcacttgcggccccg

SEQ ID NO: 59278 - DNA, 28 bp, Homo sapiens
gacacttcgaacgcacttgcggccccgg

SEQ ID NO: 59279 - DNA, 30 bp, Homo sapiens; identical to SEQ ID NO: 3706

SEQ ID NO: 59280 - DNA, 31 bp, Homo sapiens; identical to SEQ ID NO: 3707

SEQ ID NO: 59281 - DNA, 27 bp, Homo sapiens
cttcgaacgcacttgcggccccgggtt

SEQ ID NO: 59282 - DNA, 25 bp, Homo sapiens
tcgaacgcacttgcggccccgggtt

SEQ ID NO: 59283 - DNA, 18 bp, Homo sapiens
aacgcacttgcggccccg

SEQ ID NO: 59284 - DNA, 54 bp, Homo sapiens; identical to SEQ ID NO: 57276

SEQ ID NO: 59285 - DNA, 53 bp, Homo sapiens; identical to SEQ ID NO: 57277

SEQ ID NO: 59286 - DNA, 52 bp, Homo sapiens; identical to SEQ ID NO: 57278

SEQ ID NO: 59287 - DNA, 51 bp, Homo sapiens; identical to SEQ ID NO: 57279

SEQ ID NO: 59288 - DNA, 50 bp, Homo sapiens; identical to SEQ ID NO: 57280

SEQ ID NO: 59289 - DNA, 51 bp, Homo sapiens
cacttgcggccccgggttcctcccggggctacgcctgtctgagcgtcgctt

SEQ ID NO: 59290 - DNA, 49 bp, Homo sapiens; identical to SEQ ID NO: 57281

SEQ ID NO: 59291 - DNA, 50 bp, Homo sapiens; identical to SEQ ID NO: 57282

SEQ ID NO: 59292 - DNA, 47 bp, Homo sapiens
cttgcggccccgggttcctcccggggctacgcctgtctgagcgtcgc

SEQ ID NO: 59293 - DNA, 48 bp, Homo sapiens; identical to SEQ ID NO: 57283

SEQ ID NO: 59294 - DNA, 49 bp, Homo sapiens; identical to SEQ ID NO: 57284

SEQ ID NO: 59295 - DNA, 47 bp, Homo sapiens; identical to SEQ ID NO: 17967

SEQ ID NO: 59296 - DNA, 48 bp, Homo sapiens; identical to SEQ ID NO: 57286

SEQ ID NO: 59297 - DNA, 46 bp, Homo sapiens; identical to SEQ ID NO: 17968

SEQ ID NO: 59298 - DNA, 47 bp, Homo sapiens; identical to SEQ ID NO: 57288

SEQ ID NO: 59299 - DNA, 45 bp, Homo sapiens; identical to SEQ ID NO: 17969

SEQ ID NO: 59300 - DNA, 46 bp, Homo sapiens; identical to SEQ ID NO: 57290

SEQ ID NO: 59301 - DNA, 44 bp, Homo sapiens; identical to SEQ ID NO: 17970

SEQ ID NO: 59302 - DNA, 40 bp, Homo sapiens; identical to SEQ ID NO: 57292

SEQ ID NO: 59303 - DNA, 41 bp, Homo sapiens; identical to SEQ ID NO: 57293

SEQ ID NO: 59304 - DNA, 39 bp, Homo sapiens; identical to SEQ ID NO: 57294

SEQ ID NO: 59305 - DNA, 38 bp, Homo sapiens; identical to SEQ ID NO: 57295

SEQ ID NO: 59306 - DNA, 37 bp, Homo sapiens
gggttcctcccggggctacgcctgtctgagcgtcgct

SEQ ID NO: 59307 - DNA, 36 bp, Homo sapiens; identical to SEQ ID NO: 17981

SEQ ID NO: 59308 - DNA, 30 bp, Homo sapiens; identical to SEQ ID NO: 17983

SEQ ID NO: 59309 - DNA, 35 bp, Homo sapiens; identical to SEQ ID NO: 17987

SEQ ID NO: 59310 - DNA, 34 bp, Homo sapiens; identical to SEQ ID NO: 17993

SEQ ID NO: 59311 - DNA, 32 bp, Homo sapiens; identical to SEQ ID NO: 18000

SEQ ID NO: 59312 - DNA, 33 bp, Homo sapiens; identical to SEQ ID NO: 3741

SEQ ID NO: 59313 - DNA, 34 bp, Homo sapiens; identical to SEQ ID NO: 18002

SEQ ID NO: 59314 - DNA, 32 bp, Homo sapiens; identical to SEQ ID NO: 3743

SEQ ID NO: 59315 - DNA, 33 bp, Homo sapiens; identical to SEQ ID NO: 18007

SEQ ID NO: 59316 - DNA, 31 bp, Homo sapiens; identical to SEQ ID NO: 3747

SEQ ID NO: 59317 - DNA, 32 bp, Homo sapiens; identical to SEQ ID NO: 3748

SEQ ID NO: 59318 - DNA, 24 bp, Homo sapiens
tcccggggctacgcctgtctgagc

SEQ ID NO: 59319 - DNA, 27 bp, Homo sapiens
tcccggggctacgcctgtctgagcgtc

SEQ ID NO: 59320 - DNA, 28 bp, Homo sapiens
tcccggggctacgcctgtctgagcgtcg

SEQ ID NO: 59321 - DNA, 29 bp, Homo sapiens
tcccggggctacgcctgtctgagcgtcgc

SEQ ID NO: 59322 - DNA, 30 bp, Homo sapiens; identical to SEQ ID NO: 3754

SEQ ID NO: 59323 - DNA, 31 bp, Homo sapiens; identical to SEQ ID NO: 3755

SEQ ID NO: 59324 - DNA, 21 bp, Homo sapiens
cccggggctacgcctgtctga

SEQ ID NO: 59325 - DNA, 22 bp, Homo sapiens
cccggggctacgcctgtctgag

SEQ ID NO: 59326 - DNA, 23 bp, Homo sapiens
cccggggctacgcctgtctgagc

SEQ ID NO: 59327 - DNA, 25 bp, Homo sapiens
cccggggctacgcctgtctgagcgt

SEQ ID NO: 59328 - DNA, 26 bp, Homo sapiens
cccggggctacgcctgtctgagcgtc

SEQ ID NO: 59329 - DNA, 27 bp, Homo sapiens
cccggggctacgcctgtctgagcgtcg

SEQ ID NO: 59330 - DNA, 28 bp, Homo sapiens
cccggggctacgcctgtctgagcgtcgc

SEQ ID NO: 59331 - DNA, 29 bp, Homo sapiens
cccggggctacgcctgtctgagcgtcgct

SEQ ID NO: 59332 - DNA, 30 bp, Homo sapiens; identical to SEQ ID NO: 3762

SEQ ID NO: 59333 - DNA, 22 bp, Homo sapiens
ccggggctacgcctgtctgagc

SEQ ID NO: 59334 - DNA, 24 bp, Homo sapiens
ccggggctacgcctgtctgagcgt

SEQ ID NO: 59335 - DNA, 25 bp, Homo sapiens
ccggggctacgcctgtctgagcgtc

SEQ ID NO: 59336 - DNA, 26 bp, Homo sapiens
ccggggctacgcctgtctgagcgtcg

SEQ ID NO: 59337 - DNA, 27 bp, Homo sapiens
ccggggctacgcctgtctgagcgtcgc

SEQ ID NO: 59338 - DNA, 28 bp, Homo sapiens
ccggggctacgcctgtctgagcgtcgct

SEQ ID NO: 59339 - DNA, 29 bp, Homo sapiens
ccggggctacgcctgtctgagcgtcgctt

SEQ ID NO: 59340 - DNA, 20 bp, Homo sapiens
cggggctacgcctgtctgag

SEQ ID NO: 59341 - DNA, 21 bp, Homo sapiens
cggggctacgcctgtctgagc

SEQ ID NO: 59342 - DNA, 22 bp, Homo sapiens
cggggctacgcctgtctgagcg

SEQ ID NO: 59343 - DNA, 23 bp, Homo sapiens
cggggctacgcctgtctgagcgt

SEQ ID NO: 59344 - DNA, 24 bp, Homo sapiens
cggggctacgcctgtctgagcgtc

SEQ ID NO: 59345 - DNA, 25 bp, Homo sapiens
cggggctacgcctgtctgagcgtcg

SEQ ID NO: 59346 - DNA, 26 bp, Homo sapiens
cggggctacgcctgtctgagcgtcgc

SEQ ID NO: 59347 - DNA, 27 bp, Homo sapiens
cggggctacgcctgtctgagcgtcgct

SEQ ID NO: 59348 - DNA, 28 bp, Homo sapiens
cggggctacgcctgtctgagcgtcgctt

SEQ ID NO: 59349 - DNA, 25 bp, Homo sapiens
ggggctacgcctgtctgagcgtcgc

SEQ ID NO: 59350 - DNA, 26 bp, Homo sapiens
ggggctacgcctgtctgagcgtcgct

SEQ ID NO: 59351 - DNA, 27 bp, Homo sapiens
ggggctacgcctgtctgagcgtcgctt

SEQ ID NO: 59352 - DNA, 20 bp, Homo sapiens
gggctacgcctgtctgagcg

SEQ ID NO: 59353 - DNA, 22 bp, Homo sapiens
gggctacgcctgtctgagcgtc

SEQ ID NO: 59354 - DNA, 23 bp, Homo sapiens
gggctacgcctgtctgagcgtcg

SEQ ID NO: 59355 - DNA, 24 bp, Homo sapiens
gggctacgcctgtctgagcgtcgc

SEQ ID NO: 59356 - DNA, 25 bp, Homo sapiens
gggctacgcctgtctgagcgtcgct

SEQ ID NO: 59357 - DNA, 26 bp, Homo sapiens
gggctacgcctgtctgagcgtcgctt

SEQ ID NO: 59358 - DNA, 17 bp, Homo sapiens
ggctacgcctgtctgag

SEQ ID NO: 59359 - DNA, 19 bp, Homo sapiens
ggctacgcctgtctgagcg

SEQ ID NO: 59360 - DNA, 21 bp, Homo sapiens
ggctacgcctgtctgagcgtc

SEQ ID NO: 59361 - DNA, 22 bp, Homo sapiens
ggctacgcctgtctgagcgtcg

SEQ ID NO: 59362 - DNA, 23 bp, Homo sapiens
ggctacgcctgtctgagcgtcgc

SEQ ID NO: 59363 - DNA, 24 bp, Homo sapiens
ggctacgcctgtctgagcgtcgct

SEQ ID NO: 59364 - DNA, 18 bp, Homo sapiens
gctacgcctgtctgagcg

SEQ ID NO: 59365 - DNA, 23 bp, Homo sapiens
gctacgcctgtctgagcgtcgct

SEQ ID NO: 59366 - DNA, 21 bp, Homo sapiens
ctacgcctgtctgagcgtcgc

SEQ ID NO: 59367 - DNA, 22 bp, Homo sapiens
ctacgcctgtctgagcgtcgct

SEQ ID NO: 59368 - DNA, 23 bp, Homo sapiens
ctacgcctgtctgagcgtcgctt

SEQ ID NO: 59369 - DNA, 20 bp, Homo sapiens
tacgcctgtctgagcgtcgc

SEQ ID NO: 59370 - DNA, 21 bp, Homo sapiens
tacgcctgtctgagcgtcgct

SEQ ID NO: 59371 - DNA, 22 bp, Homo sapiens
tacgcctgtctgagcgtcgctt

SEQ ID NO: 59372 - DNA, 20 bp, Homo sapiens
acgcctgtctgagcgtcgct

SEQ ID NO: 59373 - DNA, 21 bp, Homo sapiens
acgcctgtctgagcgtcgctt

SEQ ID NO: 59374 - DNA, 17 bp, Homo sapiens
cgcctgtctgagcgtcg

SEQ ID NO: 59375 - DNA, 18 bp, Homo sapiens
cgcctgtctgagcgtcgc

SEQ ID NO: 59376 - DNA, 19 bp, Homo sapiens
cgcctgtctgagcgtcgct

SEQ ID NO: 59377 - DNA, 20 bp, Homo sapiens
cgcctgtctgagcgtcgctt

SEQ ID NO: 59378 - DNA, 17 bp, Homo sapiens
gcctgtctgagcgtcgc

SEQ ID NO: 59379 - DNA, 18 bp, Homo sapiens
gcctgtctgagcgtcgct

SEQ ID NO: 59380 - DNA, 19 bp, Homo sapiens
gcctgtctgagcgtcgctt

SEQ ID NO: 59381 - DNA, 16 bp, Homo sapiens
cctgtctgagcgtcgc

SEQ ID NO: 59382 - DNA, 17 bp, Homo sapiens
cctgtctgagcgtcgct

SEQ ID NO: 59383 - DNA, 18 bp, Homo sapiens
cctgtctgagcgtcgctt

SEQ ID NO: 59384 - DNA, 16 bp, Homo sapiens
ctgtctgagcgtcgct

SEQ ID NO: 59385 - DNA, 17 bp, Homo sapiens
ctgtctgagcgtcgctt

SEQ ID NO: 59386 - DNA, 16 bp, Homo sapiens
tgtctgagcgtcgctt

SEQ ID NO: 59387 - DNA, 24 bp, Homo sapiens
cccggtcgccgcggttcgccgccc

SEQ ID NO: 59388 - DNA, 25 bp, Homo sapiens
cccggtcgccgcggttcgccgcccg

SEQ ID NO: 59389 - DNA, 26 bp, Homo sapiens
cccggtcgccgcggttcgccgcccgc

SEQ ID NO: 59390 - DNA, 18 bp, Homo sapiens
acgcgacctcagatcaga

SEQ ID NO: 59391 - DNA, 20 bp, Homo sapiens
acgcgacctcagatcagacg

SEQ ID NO: 59392 - DNA, 21 bp, Homo sapiens
acgcgacctcagatcagacgt

SEQ ID NO: 59393 - DNA, 24 bp, Homo sapiens
acgcgacctcagatcagacgtggc

SEQ ID NO: 59394 - DNA, 28 bp, Homo sapiens
acgcgacctcagatcagacgtggcgacc

SEQ ID NO: 59395 - DNA, 29 bp, Homo sapiens
acgcgacctcagatcagacgtggcgaccc

SEQ ID NO: 59396 - DNA, 30 bp, Homo sapiens; identical to SEQ ID NO: 3848

SEQ ID NO: 59397 - DNA, 31 bp, Homo sapiens; identical to SEQ ID NO: 3849

SEQ ID NO: 59398 - DNA, 32 bp, Homo sapiens; identical to SEQ ID NO: 3850

SEQ ID NO: 59399 - DNA, 34 bp, Homo sapiens; identical to SEQ ID NO: 18226

SEQ ID NO: 59400 - DNA, 35 bp, Homo sapiens; identical to SEQ ID NO: 18227

SEQ ID NO: 59401 - DNA, 36 bp, Homo sapiens; identical to SEQ ID NO: 18228

SEQ ID NO: 59402 - DNA, 37 bp, Homo sapiens; identical to SEQ ID NO: 18229

SEQ ID NO: 59403 - DNA, 38 bp, Homo sapiens; identical to SEQ ID NO: 18230

SEQ ID NO: 59404 - DNA, 40 bp, Homo sapiens; identical to SEQ ID NO: 18232

SEQ ID NO: 59405 - DNA, 41 bp, Homo sapiens; identical to SEQ ID NO: 18233

SEQ ID NO: 59406 - DNA, 42 bp, Homo sapiens; identical to SEQ ID NO: 18234

SEQ ID NO: 59407 - DNA, 43 bp, Homo sapiens; identical to SEQ ID NO: 18235

SEQ ID NO: 59408 - DNA, 17 bp, Homo sapiens
cgcgacctcagatcaga

SEQ ID NO: 59409 - DNA, 18 bp, Homo sapiens
cgcgacctcagatcagac

SEQ ID NO: 59410 - DNA, 19 bp, Homo sapiens
cgcgacctcagatcagacg

SEQ ID NO: 59411 - DNA, 20 bp, Homo sapiens
cgcgacctcagatcagacgt

SEQ ID NO: 59412 - DNA, 21 bp, Homo sapiens
cgcgacctcagatcagacgtg

SEQ ID NO: 59413 - DNA, 22 bp, Homo sapiens
cgcgacctcagatcagacgtgg

SEQ ID NO: 59414 - DNA, 23 bp, Homo sapiens
cgcgacctcagatcagacgtggc

SEQ ID NO: 59415 - DNA, 24 bp, Homo sapiens
cgcgacctcagatcagacgtggcg

SEQ ID NO: 59416 - DNA, 25 bp, Homo sapiens
cgcgacctcagatcagacgtggcga

SEQ ID NO: 59417 - DNA, 26 bp, Homo sapiens
cgcgacctcagatcagacgtggcgac

SEQ ID NO: 59418 - DNA, 27 bp, Homo sapiens
cgcgacctcagatcagacgtggcgacc

SEQ ID NO: 59419 - DNA, 28 bp, Homo sapiens
cgcgacctcagatcagacgtggcgaccc

SEQ ID NO: 59420 - DNA, 29 bp, Homo sapiens
cgcgacctcagatcagacgtggcgacccg

SEQ ID NO: 59421 - DNA, 30 bp, Homo sapiens; identical to SEQ ID NO: 3865

SEQ ID NO: 59422 - DNA, 31 bp, Homo sapiens; identical to SEQ ID NO: 3866

SEQ ID NO: 59423 - DNA, 32 bp, Homo sapiens; identical to SEQ ID NO: 3867

SEQ ID NO: 59424 - DNA, 33 bp, Homo sapiens; identical to SEQ ID NO: 3868

SEQ ID NO: 59425 - DNA, 34 bp, Homo sapiens; identical to SEQ ID NO: 18258

SEQ ID NO: 59426 - DNA, 35 bp, Homo sapiens; identical to SEQ ID NO: 18259

SEQ ID NO: 59427 - DNA, 36 bp, Homo sapiens; identical to SEQ ID NO: 18260

SEQ ID NO: 59428 - DNA, 37 bp, Homo sapiens; identical to SEQ ID NO: 18261

SEQ ID NO: 59429 - DNA, 38 bp, Homo sapiens; identical to SEQ ID NO: 18262

SEQ ID NO: 59430 - DNA, 39 bp, Homo sapiens; identical to SEQ ID NO: 18263

SEQ ID NO: 59431 - DNA, 40 bp, Homo sapiens; identical to SEQ ID NO: 18264

SEQ ID NO: 59432 - DNA, 41 bp, Homo sapiens; identical to SEQ ID NO: 18265

SEQ ID NO: 59433 - DNA, 42 bp, Homo sapiens; identical to SEQ ID NO: 18266

SEQ ID NO: 59434 - DNA, 43 bp, Homo sapiens; identical to SEQ ID NO: 18267

SEQ ID NO: 59435 - DNA, 44 bp, Homo sapiens; identical to SEQ ID NO: 18268

SEQ ID NO: 59436 - DNA, 45 bp, Homo sapiens; identical to SEQ ID NO: 18269

SEQ ID NO: 59437 - DNA, 46 bp, Homo sapiens; identical to SEQ ID NO: 18270

SEQ ID NO: 59438 - DNA, 18 bp, Homo sapiens
gcgacctcagatcagacg

SEQ ID NO: 59439 - DNA, 20 bp, Homo sapiens
gcgacctcagatcagacgtg

SEQ ID NO: 59440 - DNA, 21 bp, Homo sapiens
gcgacctcagatcagacgtgg

SEQ ID NO: 59441 - DNA, 22 bp, Homo sapiens
gcgacctcagatcagacgtggc

SEQ ID NO: 59442 - DNA, 23 bp, Homo sapiens
gcgacctcagatcagacgtggcg

SEQ ID NO: 59443 - DNA, 28 bp, Homo sapiens
gcgacctcagatcagacgtggcgacccg

SEQ ID NO: 59444 - DNA, 29 bp, Homo sapiens
gcgacctcagatcagacgtggcgacccgc

SEQ ID NO: 59445 - DNA, 35 bp, Homo sapiens; identical to SEQ ID NO: 18288

SEQ ID NO: 59446 - DNA, 21 bp, Homo sapiens
cgacctcagatcagacgtggc

SEQ ID NO: 59447 - DNA, 22 bp, Homo sapiens
cgacctcagatcagacgtggcg

SEQ ID NO: 59448 - DNA, 25 bp, Homo sapiens
cgacctcagatcagacgtggcgacc

SEQ ID NO: 59449 - DNA, 27 bp, Homo sapiens
cgacctcagatcagacgtggcgacccg

SEQ ID NO: 59450 - DNA, 23 bp, Homo sapiens
gacctcagatcagacgtggcgac

SEQ ID NO: 59451 - DNA, 22 bp, Homo sapiens
acctcagatcagacgtggcgac

SEQ ID NO: 59452 - DNA, 23 bp, Homo sapiens
acctcagatcagacgtggcgacc

SEQ ID NO: 59453 - DNA, 18 bp, Homo sapiens
cctcagatcagacgtggc

SEQ ID NO: 59454 - DNA, 17 bp, Homo sapiens
ctcagatcagacgtggc

SEQ ID NO: 59455 - DNA, 18 bp, Homo sapiens
agcggaggagaagaaact

SEQ ID NO: 59456 - DNA, 36 bp, Homo sapiens
agtgaacagggaagagcccagcgccgaatccccgcc

SEQ ID NO: 59457 - DNA, 37 bp, Homo sapiens
agtgaacagggaagagcccagcgccgaatccccgccc

SEQ ID NO: 59458 - DNA, 34 bp, Homo sapiens
tgaacagggaagagcccagcgccgaatccccgcc

SEQ ID NO: 59459 - DNA, 35 bp, Homo sapiens
tgaacagggaagagcccagcgccgaatccccgccc

SEQ ID NO: 59460 - DNA, 27 bp, Homo sapiens
ggaagagcccagcgccgaatccccgcc

SEQ ID NO: 59461 - DNA, 28 bp, Homo sapiens
ggaagagcccagcgccgaatccccgccc

SEQ ID NO: 59462 - DNA, 25 bp, Homo sapiens
gaagagcccagcgccgaatccccgc

SEQ ID NO: 59463 - DNA, 26 bp, Homo sapiens
gaagagcccagcgccgaatccccgcc

SEQ ID NO: 59464 - DNA, 27 bp, Homo sapiens
gaagagcccagcgccgaatccccgccc

SEQ ID NO: 59465 - DNA, 28 bp, Homo sapiens
gaagagcccagcgccgaatccccgcccc

SEQ ID NO: 59466 - DNA, 21 bp, Homo sapiens
gagcccagcgccgaatccccg

SEQ ID NO: 59467 - DNA, 22 bp, Homo sapiens
gagcccagcgccgaatccccgc

SEQ ID NO: 59468 - DNA, 23 bp, Homo sapiens
gagcccagcgccgaatccccgcc

SEQ ID NO: 59469 - DNA, 24 bp, Homo sapiens
gagcccagcgccgaatccccgccc

SEQ ID NO: 59470 - DNA, 22 bp, Homo sapiens
agcccagcgccgaatccccgcc

SEQ ID NO: 59471 - DNA, 25 bp, Homo sapiens
cccgccccgcggcggggcgcgggac

SEQ ID NO: 59472 - DNA, 23 bp, Homo sapiens
cgccccgcggcggggcgcgggac

SEQ ID NO: 59473 - DNA, 22 bp, Homo sapiens
gccccgcggcggggcgcgggac

SEQ ID NO: 59474 - DNA, 34 bp, Homo sapiens
ccgcggcggggcgcgggacatgtggcgtacggaa

SEQ ID NO: 59475 - DNA, 35 bp, Homo sapiens
ccgcggcggggcgcgggacatgtggcgtacggaag

SEQ ID NO: 59476 - DNA, 36 bp, Homo sapiens
ccgcggcggggcgcgggacatgtggcgtacggaaga

SEQ ID NO: 59477 - DNA, 37 bp, Homo sapiens
ccgcggcggggcgcgggacatgtggcgtacggaagac

SEQ ID NO: 59478 - DNA, 38 bp, Homo sapiens; identical to SEQ ID NO: 57407

SEQ ID NO: 59479 - DNA, 39 bp, Homo sapiens
ccgcggcggggcgcgggacatgtggcgtacggaagaccc

SEQ ID NO: 59480 - DNA, 41 bp, Homo sapiens
ccgcggcggggcgcgggacatgtggcgtacggaagacccgc

SEQ ID NO: 59481 - DNA, 42 bp, Homo sapiens; identical to SEQ ID NO: 57408

SEQ ID NO: 59482 - DNA, 18 bp, Homo sapiens
cgcggcggggcgcgggac

SEQ ID NO: 59483 - DNA, 33 bp, Homo sapiens; identical to SEQ ID NO: 4008

SEQ ID NO: 59484 - DNA, 34 bp, Homo sapiens
cgcggcggggcgcgggacatgtggcgtacggaag

SEQ ID NO: 59485 - DNA, 35 bp, Homo sapiens; identical to SEQ ID NO: 57409

SEQ ID NO: 59486 - DNA, 36 bp, Homo sapiens
cgcggcggggcgcgggacatgtggcgtacggaagac

SEQ ID NO: 59487 - DNA, 37 bp, Homo sapiens
cgcggcggggcgcgggacatgtggcgtacggaagacc

SEQ ID NO: 59488 - DNA, 40 bp, Homo sapiens
cgcggcggggcgcgggacatgtggcgtacggaagacccgc

SEQ ID NO: 59489 - DNA, 41 bp, Homo sapiens
cgcggcggggcgcgggacatgtggcgtacggaagacccgct

SEQ ID NO: 59490 - DNA, 46 bp, Homo sapiens
cgcggcggggcgcgggacatgtggcgtacggaagacccgctccccg

SEQ ID NO: 59491 - DNA, 47 bp, Homo sapiens
cgcggcggggcgcgggacatgtggcgtacggaagacccgctccccgg

SEQ ID NO: 59492 - DNA, 48 bp, Homo sapiens
cgcggcggggcgcgggacatgtggcgtacggaagacccgctccccggc

SEQ ID NO: 59493 - DNA, 49 bp, Homo sapiens
cgcggcggggcgcgggacatgtggcgtacggaagacccgctccccggcg

SEQ ID NO: 59494 - DNA, 34 bp, Homo sapiens
gcggcggggcgcgggacatgtggcgtacggaaga

SEQ ID NO: 59495 - DNA, 28 bp, Homo sapiens
gcgcgggacatgtggcgtacggaagacc

SEQ ID NO: 59496 - DNA, 25 bp, Homo sapiens
cgcgggacatgtggcgtacggaaga

SEQ ID NO: 59497 - DNA, 26 bp, Homo sapiens
cgcgggacatgtggcgtacggaagac

SEQ ID NO: 59498 - DNA, 27 bp, Homo sapiens
cgcgggacatgtggcgtacggaagacc

SEQ ID NO: 59499 - DNA, 30 bp, Homo sapiens; identical to SEQ ID NO: 4015

SEQ ID NO: 59500 - DNA, 36 bp, Homo sapiens
cgcgggacatgtggcgtacggaagacccgctccccg

SEQ ID NO: 59501 - DNA, 39 bp, Homo sapiens
cgcgggacatgtggcgtacggaagacccgctccccggcg

SEQ ID NO: 59502 - DNA, 29 bp, Homo sapiens
cgggacatgtggcgtacggaagacccgct

SEQ ID NO: 59503 - DNA, 26 bp, Homo sapiens
ggacatgtggcgtacggaagacccgc

SEQ ID NO: 59504 - DNA, 29 bp, Homo sapiens
gtacggaagacccgctccccggcgccgct

SEQ ID NO: 59505 - DNA, 20 bp, Homo sapiens
cggaagacccgctccccggc

SEQ ID NO: 59506 - DNA, 22 bp, Homo sapiens
cggaagacccgctccccggcgc

SEQ ID NO: 59507 - DNA, 23 bp, Homo sapiens
cggaagacccgctccccggcgcc

SEQ ID NO: 59508 - DNA, 24 bp, Homo sapiens
cggaagacccgctccccggcgccg

SEQ ID NO: 59509 - DNA, 25 bp, Homo sapiens
cggaagacccgctccccggcgccgc

SEQ ID NO: 59510 - DNA, 26 bp, Homo sapiens
cggaagacccgctccccggcgccgct

SEQ ID NO: 59511 - DNA, 27 bp, Homo sapiens
cggaagacccgctccccggcgccgctc

SEQ ID NO: 59512 - DNA, 28 bp, Homo sapiens
cggaagacccgctccccggcgccgctcg

SEQ ID NO: 59513 - DNA, 58 bp, Homo sapiens; identical to SEQ ID NO: 57419

SEQ ID NO: 59514 - DNA, 59 bp, Homo sapiens; identical to SEQ ID NO: 57420

SEQ ID NO: 59515 - DNA, 21 bp, Homo sapiens
ggaagacccgctccccggcgc

SEQ ID NO: 59516 - DNA, 22 bp, Homo sapiens
ggaagacccgctccccggcgcc

SEQ ID NO: 59517 - DNA, 23 bp, Homo sapiens
ggaagacccgctccccggcgccg

SEQ ID NO: 59518 - DNA, 25 bp, Homo sapiens
ggaagacccgctccccggcgccgct

SEQ ID NO: 59519 - DNA, 16 bp, Homo sapiens
gacccgctccccggcg

SEQ ID NO: 59520 - DNA, 17 bp, Homo sapiens
gacccgctccccggcgc

SEQ ID NO: 59521 - DNA, 18 bp, Homo sapiens
gacccgctccccggcgcc

SEQ ID NO: 59522 - DNA, 19 bp, Homo sapiens
gacccgctccccggcgccg

SEQ ID NO: 59523 - DNA, 21 bp, Homo sapiens
gacccgctccccggcgccgct

SEQ ID NO: 59524 - DNA, 16 bp, Homo sapiens
acccgctccccggcgc

SEQ ID NO: 59525 - DNA, 17 bp, Homo sapiens
acccgctccccggcgcc

SEQ ID NO: 59526 - DNA, 18 bp, Homo sapiens
acccgctccccggcgccg

SEQ ID NO: 59527 - DNA, 20 bp, Homo sapiens
acccgctccccggcgccgct

SEQ ID NO: 59528 - DNA, 16 bp, Homo sapiens
cccgctccccggcgcc

SEQ ID NO: 59529 - DNA, 17 bp, Homo sapiens
cccgctccccggcgccg

SEQ ID NO: 59530 - DNA, 18 bp, Homo sapiens
cccgctccccggcgccgc

SEQ ID NO: 59531 - DNA, 19 bp, Homo sapiens
cccgctccccggcgccgct

SEQ ID NO: 59532 - DNA, 45 bp, Homo sapiens
ccccggcgccgctcgtggggggcccaagtccttctgatcgaggcc

SEQ ID NO: 59533 - DNA, 46 bp, Homo sapiens
ccccggcgccgctcgtggggggcccaagtccttctgatcgaggccc

SEQ ID NO: 59534 - DNA, 34 bp, Homo sapiens
gctcgtggggggcccaagtccttctgatcgaggc

SEQ ID NO: 59535 - DNA, 35 bp, Homo sapiens
gctcgtggggggcccaagtccttctgatcgaggcc

SEQ ID NO: 59536 - DNA, 36 bp, Homo sapiens
gctcgtggggggcccaagtccttctgatcgaggccc

SEQ ID NO: 59537 - DNA, 33 bp, Homo sapiens; identical to SEQ ID NO: 4023

SEQ ID NO: 59538 - DNA, 34 bp, Homo sapiens
ctcgtggggggcccaagtccttctgatcgaggcc

SEQ ID NO: 59539 - DNA, 35 bp, Homo sapiens
ctcgtggggggcccaagtccttctgatcgaggccc

SEQ ID NO: 59540 - DNA, 33 bp, Homo sapiens; identical to SEQ ID NO: 4026

SEQ ID NO: 59541 - DNA, 34 bp, Homo sapiens; identical to SEQ ID NO: 18783

SEQ ID NO: 59542 - DNA, 32 bp, Homo sapiens; identical to SEQ ID NO: 4029

SEQ ID NO: 59543 - DNA, 33 bp, Homo sapiens; identical to SEQ ID NO: 18788

SEQ ID NO: 59544 - DNA, 31 bp, Homo sapiens; identical to SEQ ID NO: 4033

SEQ ID NO: 59545 - DNA, 32 bp, Homo sapiens; identical to SEQ ID NO: 4034

SEQ ID NO: 59546 - DNA, 33 bp, Homo sapiens; identical to SEQ ID NO: 57436

SEQ ID NO: 59547 - DNA, 29 bp, Homo sapiens
tggggggcccaagtccttctgatcgaggc

SEQ ID NO: 59548 - DNA, 30 bp, Homo sapiens; identical to SEQ ID NO: 4038

SEQ ID NO: 59549 - DNA, 31 bp, Homo sapiens; identical to SEQ ID NO: 4039

SEQ ID NO: 59550 - DNA, 27 bp, Homo sapiens
ggggcccaagtccttctgatcgaggcc

SEQ ID NO: 59551 - DNA, 26 bp, Homo sapiens
gggcccaagtccttctgatcgaggcc

SEQ ID NO: 59552 - DNA, 24 bp, Homo sapiens
gcccaagtccttctgatcgaggcc

SEQ ID NO: 59553 - DNA, 25 bp, Homo sapiens
gcccaagtccttctgatcgaggccc

SEQ ID NO: 59554 - DNA, 23 bp, Homo sapiens
cccaagtccttctgatcgaggcc

SEQ ID NO: 59555 - DNA, 24 bp, Homo sapiens
cccaagtccttctgatcgaggccc

SEQ ID NO: 59556 - DNA, 22 bp, Homo sapiens
ccaagtccttctgatcgaggcc

SEQ ID NO: 59557 - DNA, 23 bp, Homo sapiens
ccaagtccttctgatcgaggccc

SEQ ID NO: 59558 - DNA, 21 bp, Homo sapiens
caagtccttctgatcgaggcc

SEQ ID NO: 59559 - DNA, 22 bp, Homo sapiens
caagtccttctgatcgaggccc

SEQ ID NO: 59560 - DNA, 20 bp, Homo sapiens
aagtccttctgatcgaggcc

SEQ ID NO: 59561 - DNA, 21 bp, Homo sapiens
aagtccttctgatcgaggccc

SEQ ID NO: 59562 - DNA, 19 bp, Homo sapiens
agtccttctgatcgaggcc

SEQ ID NO: 59563 - DNA, 20 bp, Homo sapiens
agtccttctgatcgaggccc

SEQ ID NO: 59564 - DNA, 17 bp, Homo sapiens
tccttctgatcgaggcc

SEQ ID NO: 59565 - DNA, 18 bp, Homo sapiens
tccttctgatcgaggccc

SEQ ID NO: 59566 - DNA, 16 bp, Homo sapiens
ccttctgatcgaggcc

SEQ ID NO: 59567 - DNA, 17 bp, Homo sapiens
ccttctgatcgaggccc

SEQ ID NO: 59568 - DNA, 16 bp, Homo sapiens
cttctgatcgaggccc

SEQ ID NO: 59569 - DNA, 18 bp, Homo sapiens
gaggcccagcccgtggac

SEQ ID NO: 59570 - DNA, 17 bp, Homo sapiens
aggcccagcccgtggac

SEQ ID NO: 59571 - DNA, 18 bp, Homo sapiens
ccgtggacggtgtgaggc

SEQ ID NO: 59572 - DNA, 19 bp, Homo sapiens
ccgtggacggtgtgaggcc

SEQ ID NO: 59573 - DNA, 18 bp, Homo sapiens
cgtggacggtgtgaggcc

SEQ ID NO: 59574 - DNA, 16 bp, Homo sapiens
gtggacggtgtgaggc

SEQ ID NO: 59575 - DNA, 17 bp, Homo sapiens
gtggacggtgtgaggcc

SEQ ID NO: 59576 - DNA, 35 bp, Homo sapiens
gtgtgaggccggtagcggcccccggcgcgccgggc

SEQ ID NO: 59577 - DNA, 20 bp, Homo sapiens
cggcccccggcgcgccgggc

SEQ ID NO: 59578 - DNA, 27 bp, Homo sapiens
cggcccccggcgcgccgggcccgggtc

SEQ ID NO: 59579 - DNA, 28 bp, Homo sapiens
cggcccccggcgcgccgggcccgggtct

SEQ ID NO: 59580 - DNA, 18 bp, Homo sapiens
ggcccccggcgcgccggg

SEQ ID NO: 59581 - DNA, 19 bp, Homo sapiens
ggcccccggcgcgccgggc

SEQ ID NO: 59582 - DNA, 24 bp, Homo sapiens
ggcccccggcgcgccgggcccggg

SEQ ID NO: 59583 - DNA, 18 bp, Homo sapiens
gcccccggcgcgccgggc

SEQ ID NO: 59584 - DNA, 23 bp, Homo sapiens
gcccccggcgcgccgggcccggg

SEQ ID NO: 59585 - DNA, 22 bp, Homo sapiens
cccccggcgcgccgggcccggg

SEQ ID NO: 59586 - DNA, 21 bp, Homo sapiens
ccccggcgcgccgggcccggg

SEQ ID NO: 59587 - DNA, 20 bp, Homo sapiens
cccggcgcgccgggcccggg

SEQ ID NO: 59588 - DNA, 19 bp, Homo sapiens
ccggcgcgccgggcccggg

SEQ ID NO: 59589 - DNA, 18 bp, Homo sapiens
cggcgcgccgggcccggg

SEQ ID NO: 59590 - DNA, 19 bp, Homo sapiens
cgccgggcccgggtcttcc

SEQ ID NO: 59591 - DNA, 21 bp, Homo sapiens
cgccgggcccgggtcttcccg

SEQ ID NO: 59592 - DNA, 29 bp, Homo sapiens
ggcccgggtcttcccggagtcgggttgct

SEQ ID NO: 59593 - DNA, 18 bp, Homo sapiens
tcttcccggagtcgggtt

SEQ ID NO: 59594 - DNA, 16 bp, Homo sapiens
cttcccggagtcgggt

SEQ ID NO: 59595 - DNA, 17 bp, Homo sapiens
cttcccggagtcgggtt

SEQ ID NO: 59596 - DNA, 20 bp, Homo sapiens
cttcccggagtcgggttgct

SEQ ID NO: 59597 - DNA, 16 bp, Homo sapiens
ttcccggagtcgggtt

SEQ ID NO: 59598 - DNA, 19 bp, Homo sapiens
ttcccggagtcgggttgct

SEQ ID NO: 59599 - DNA, 20 bp, Homo sapiens
ttcccggagtcgggttgctt

SEQ ID NO: 59600 - DNA, 18 bp, Homo sapiens
tcccggagtcgggttgct

SEQ ID NO: 59601 - DNA, 16 bp, Homo sapiens
cccggagtcgggttgc

SEQ ID NO: 59602 - DNA, 23 bp, Homo sapiens
tccatctaaggctaaataccggc

SEQ ID NO: 59603 - DNA, 19 bp, Homo sapiens
ccatctaaggctaaatacc

SEQ ID NO: 59604 - DNA, 22 bp, Homo sapiens
ccatctaaggctaaataccggc

SEQ ID NO: 59605 - DNA, 28 bp, Homo sapiens
ccatctaaggctaaataccggcacgaga

SEQ ID NO: 59606 - DNA, 29 bp, Homo sapiens
ccatctaaggctaaataccggcacgagac

SEQ ID NO: 59607 - DNA, 21 bp, Homo sapiens
ggcacgagaccgatagtcaac

SEQ ID NO: 59608 - DNA, 23 bp, Homo sapiens
caacaagtaccgtaagggaaagt

SEQ ID NO: 59609 - DNA, 24 bp, Homo sapiens
cgtaagggaaagttgaaaagaact

SEQ ID NO: 59610 - DNA, 21 bp, Homo sapiens
tgaaaagaactttgaagagag

SEQ ID NO: 59611 - DNA, 22 bp, Homo sapiens
tgaaaagaactttgaagagaga

SEQ ID NO: 59612 - DNA, 23 bp, Homo sapiens
tgaaaagaactttgaagagagag

SEQ ID NO: 59613 - DNA, 24 bp, Homo sapiens
tgaaaagaactttgaagagagagt

SEQ ID NO: 59614 - DNA, 29 bp, Homo sapiens
tgaaaagaactttgaagagagagttcaag

SEQ ID NO: 59615 - DNA, 32 bp, Homo sapiens; identical to SEQ ID NO: 19256

SEQ ID NO: 59616 - DNA, 21 bp, Homo sapiens
ggcgtgaaaccgttaagaggt

SEQ ID NO: 59617 - DNA, 19 bp, Homo sapiens
cgtgaaaccgttaagaggt

SEQ ID NO: 59618 - DNA, 18 bp, Homo sapiens
gtgaaaccgttaagaggt

SEQ ID NO: 59619 - DNA, 36 bp, Homo sapiens; identical to SEQ ID NO: 57468

SEQ ID NO: 59620 - DNA, 35 bp, Homo sapiens; identical to SEQ ID NO: 57469

SEQ ID NO: 59621 - DNA, 34 bp, Homo sapiens; identical to SEQ ID NO: 57470

SEQ ID NO: 59622 - DNA, 37 bp, Homo sapiens
ggattcaacccggcggcgggtccggccgtgtcggcgg

SEQ ID NO: 59623 - DNA, 38 bp, Homo sapiens
ggattcaacccggcggcgggtccggccgtgtcggcggc

SEQ ID NO: 59624 - DNA, 34 bp, Homo sapiens
gattcaacccggcggcgggtccggccgtgtcggc

SEQ ID NO: 59625 - DNA, 36 bp, Homo sapiens
gattcaacccggcggcgggtccggccgtgtcggcgg

SEQ ID NO: 59626 - DNA, 37 bp, Homo sapiens
gattcaacccggcggcgggtccggccgtgtcggcggc

SEQ ID NO: 59627 - DNA, 43 bp, Homo sapiens
gattcaacccggcggcgggtccggccgtgtcggcggcccggcg

SEQ ID NO: 59628 - DNA, 46 bp, Homo sapiens
gattcaacccggcggcgggtccggccgtgtcggcggcccggcggat

SEQ ID NO: 59629 - DNA, 31 bp, Homo sapiens; identical to SEQ ID NO: 4191

SEQ ID NO: 59630 - DNA, 32 bp, Homo sapiens; identical to SEQ ID NO: 4192

SEQ ID NO: 59631 - DNA, 19 bp, Homo sapiens
cccggcggcgggtccggcc

SEQ ID NO: 59632 - DNA, 20 bp, Homo sapiens
cccggcggcgggtccggccg

SEQ ID NO: 59633 - DNA, 21 bp, Homo sapiens
cccggcggcgggtccggccgt

SEQ ID NO: 59634 - DNA, 22 bp, Homo sapiens
cccggcggcgggtccggccgtg

SEQ ID NO: 59635 - DNA, 26 bp, Homo sapiens
cccggcggcgggtccggccgtgtcgg

SEQ ID NO: 59636 - DNA, 28 bp, Homo sapiens
cccggcggcgggtccggccgtgtcggcg

SEQ ID NO: 59637 - DNA, 29 bp, Homo sapiens
cccggcggcgggtccggccgtgtcggcgg

SEQ ID NO: 59638 - DNA, 30 bp, Homo sapiens; identical to SEQ ID NO: 41602

SEQ ID NO: 59639 - DNA, 31 bp, Homo sapiens; identical to SEQ ID NO: 57479

SEQ ID NO: 59640 - DNA, 36 bp, Homo sapiens
cccggcggcgggtccggccgtgtcggcggcccggcg

SEQ ID NO: 59641 - DNA, 37 bp, Homo sapiens; identical to SEQ ID NO: 57480

SEQ ID NO: 59642 - DNA, 27 bp, Homo sapiens
ccggcggcgggtccggccgtgtcggcg

SEQ ID NO: 59643 - DNA, 17 bp, Homo sapiens
cggcggcgggtccggcc

SEQ ID NO: 59644 - DNA, 18 bp, Homo sapiens
cggcggcgggtccggccg

SEQ ID NO: 59645 - DNA, 24 bp, Homo sapiens
cggcggcgggtccggccgtgtcgg

SEQ ID NO: 59646 - DNA, 26 bp, Homo sapiens
cggcggcgggtccggccgtgtcggcg

SEQ ID NO: 59647 - DNA, 27 bp, Homo sapiens
cggcggcgggtccggccgtgtcggcgg

SEQ ID NO: 59648 - DNA, 26 bp, Homo sapiens
ggcggcgggtccggccgtgtcggcgg

SEQ ID NO: 59649 - DNA, 19 bp, Homo sapiens
ggtccggccgtgtcggcgg

SEQ ID NO: 59650 - DNA, 16 bp, Homo sapiens
gtccggccgtgtcggc

SEQ ID NO: 59651 - DNA, 17 bp, Homo sapiens
gtccggccgtgtcggcg

SEQ ID NO: 59652 - DNA, 18 bp, Homo sapiens
gtccggccgtgtcggcgg

SEQ ID NO: 59653 - DNA, 16 bp, Homo sapiens
tccggccgtgtcggcg

SEQ ID NO: 59654 - DNA, 17 bp, Homo sapiens
tccggccgtgtcggcgg

SEQ ID NO: 59655 - DNA, 16 bp, Homo sapiens
ccggccgtgtcggcgg

SEQ ID NO: 59656 - DNA, 16 bp, Homo sapiens
cggccgtgtcggcggc

SEQ ID NO: 59657 - DNA, 21 bp, Homo sapiens
cggccgtgtcggcggcccggc

SEQ ID NO: 59658 - DNA, 23 bp, Homo sapiens
cggcggatctttcccgccccccg

SEQ ID NO: 59659 - DNA, 20 bp, Homo sapiens
tcccgacccctccacccgcc

SEQ ID NO: 59660 - DNA, 21 bp, Homo sapiens
tcccgacccctccacccgccc

SEQ ID NO: 59661 - DNA, 22 bp, Homo sapiens
tcccgacccctccacccgccct

SEQ ID NO: 59662 - DNA, 23 bp, Homo sapiens
tcccgacccctccacccgccctc

SEQ ID NO: 59663 - DNA, 19 bp, Homo sapiens
cccgacccctccacccgcc

SEQ ID NO: 59664 - DNA, 20 bp, Homo sapiens
cccgacccctccacccgccc

SEQ ID NO: 59665 - DNA, 21 bp, Homo sapiens
cccgacccctccacccgccct

SEQ ID NO: 59666 - DNA, 18 bp, Homo sapiens
ccgacccctccacccgcc

SEQ ID NO: 59667 - DNA, 19 bp, Homo sapiens
ccgacccctccacccgccc

SEQ ID NO: 59668 - DNA, 17 bp, Homo sapiens
cgacccctccacccgcc

SEQ ID NO: 59669 - DNA, 18 bp, Homo sapiens
cgacccctccacccgccc

SEQ ID NO: 59670 - DNA, 19 bp, Homo sapiens
cgacccctccacccgccct

SEQ ID NO: 59671 - DNA, 20 bp, Homo sapiens
cccgccctcccttcccccgc

SEQ ID NO: 59672 - DNA, 21 bp, Homo sapiens
cccgccctcccttcccccgcc

SEQ ID NO: 59673 - DNA, 19 bp, Homo sapiens
ccgccctcccttcccccgc

SEQ ID NO: 59674 - DNA, 20 bp, Homo sapiens
ccgccctcccttcccccgcc

SEQ ID NO: 59675 - DNA, 18 bp, Homo sapiens
cgccctcccttcccccgc

SEQ ID NO: 59676 - DNA, 19 bp, Homo sapiens
cgccctcccttcccccgcc

SEQ ID NO: 59677 - DNA, 20 bp, Homo sapiens
cgccctcccttcccccgccg

SEQ ID NO: 59678 - DNA, 22 bp, Homo sapiens
ccccgccgcccctcctcctcct

SEQ ID NO: 59679 - DNA, 20 bp, Homo sapiens
cccgccgcccctcctcctcc

SEQ ID NO: 59680 - DNA, 21 bp, Homo sapiens
cccgccgcccctcctcctcct

SEQ ID NO: 59681 - DNA, 25 bp, Homo sapiens
ctcctcctccccggagggggcgggc

SEQ ID NO: 59682 - DNA, 26 bp, Homo sapiens
ctcctcctccccggagggggcgggct

SEQ ID NO: 59683 - DNA, 24 bp, Homo sapiens
tcctcctccccggagggggcgggc

SEQ ID NO: 59684 - DNA, 25 bp, Homo sapiens
tcctcctccccggagggggcgggct

SEQ ID NO: 59685 - DNA, 26 bp, Homo sapiens
tcctcctccccggagggggcgggctc

SEQ ID NO: 59686 - DNA, 24 bp, Homo sapiens
cctcctccccggagggggcgggct

SEQ ID NO: 59687 - DNA, 25 bp, Homo sapiens
cctcctccccggagggggcgggctc

SEQ ID NO: 59688 - DNA, 22 bp, Homo sapiens
ctcctccccggagggggcgggc

SEQ ID NO: 59689 - DNA, 23 bp, Homo sapiens
ctcctccccggagggggcgggct

SEQ ID NO: 59690 - DNA, 24 bp, Homo sapiens
ctcctccccggagggggcgggctc

SEQ ID NO: 59691 - DNA, 21 bp, Homo sapiens
tcctccccggagggggcgggc

SEQ ID NO: 59692 - DNA, 22 bp, Homo sapiens
tcctccccggagggggcgggct

SEQ ID NO: 59693 - DNA, 20 bp, Homo sapiens
cctccccggagggggcgggc

SEQ ID NO: 59694 - DNA, 21 bp, Homo sapiens
cctccccggagggggcgggct

SEQ ID NO: 59695 - DNA, 20 bp, Homo sapiens
ctccccggagggggcgggct

SEQ ID NO: 59696 - DNA, 31 bp, Homo sapiens
gagggggcgggctccggcgggtgcgggggtg

SEQ ID NO: 59697 - DNA, 33 bp, Homo sapiens; identical to SEQ ID NO: 57508

SEQ ID NO: 59698 - DNA, 21 bp, Homo sapiens
ggggaccgtcccccgaccggc

SEQ ID NO: 59699 - DNA, 24 bp, Homo sapiens
ggggaccgtcccccgaccggcgac

SEQ ID NO: 59700 - DNA, 25 bp, Homo sapiens
ggggaccgtcccccgaccggcgacc

SEQ ID NO: 59701 - DNA, 23 bp, Homo sapiens
gggaccgtcccccgaccggcgac

SEQ ID NO: 59702 - DNA, 17 bp, Homo sapiens
cccccgaccggcgaccg

SEQ ID NO: 59703 - DNA, 27 bp, Homo sapiens
cccccgaccggcgaccggccgccgccg

SEQ ID NO: 59704 - DNA, 28 bp, Homo sapiens
cccccgaccggcgaccggccgccgccgg

SEQ ID NO: 59705 - DNA, 29 bp, Homo sapiens
cccccgaccggcgaccggccgccgccggg

SEQ ID NO: 59706 - DNA, 30 bp, Homo sapiens
cccccgaccggcgaccggccgccgccgggc

SEQ ID NO: 59707 - DNA, 31 bp, Homo sapiens; identical to SEQ ID NO: 19446

SEQ ID NO: 59708 - DNA, 32 bp, Homo sapiens; identical to SEQ ID NO: 57513

SEQ ID NO: 59709 - DNA, 16 bp, Homo sapiens
ccccgaccggcgaccg

SEQ ID NO: 59710 - DNA, 25 bp, Homo sapiens
ccccgaccggcgaccggccgccgcc

SEQ ID NO: 59711 - DNA, 26 bp, Homo sapiens
ccccgaccggcgaccggccgccgccg

SEQ ID NO: 59712 - DNA, 27 bp, Homo sapiens
ccccgaccggcgaccggccgccgccgg

SEQ ID NO: 59713 - DNA, 28 bp, Homo sapiens
ccccgaccggcgaccggccgccgccggg

SEQ ID NO: 59714 - DNA, 29 bp, Homo sapiens
ccccgaccggcgaccggccgccgccgggc

SEQ ID NO: 59715 - DNA, 30 bp, Homo sapiens; identical to SEQ ID NO: 57517

SEQ ID NO: 59716 - DNA, 31 bp, Homo sapiens
ccccgaccggcgaccggccgccgccgggcgc

SEQ ID NO: 59717 - DNA, 21 bp, Homo sapiens
cccgaccggcgaccggccgcc

SEQ ID NO: 59718 - DNA, 24 bp, Homo sapiens
cccgaccggcgaccggccgccgcc

SEQ ID NO: 59719 - DNA, 26 bp, Homo sapiens
cccgaccggcgaccggccgccgccgg

SEQ ID NO: 59720 - DNA, 27 bp, Homo sapiens
cccgaccggcgaccggccgccgccggg

SEQ ID NO: 59721 - DNA, 29 bp, Homo sapiens
cccgaccggcgaccggccgccgccgggcg

SEQ ID NO: 59722 - DNA, 25 bp, Homo sapiens
ccgaccggcgaccggccgccgccgg

SEQ ID NO: 59723 - DNA, 23 bp, Homo sapiens
ccggcgaccggccgccgccgggc

SEQ ID NO: 59724 - DNA, 22 bp, Homo sapiens
cggcgaccggccgccgccgggc

SEQ ID NO: 59725 - DNA, 19 bp, Homo sapiens
ggcgaccggccgccgccgg

SEQ ID NO: 59726 - DNA, 20 bp, Homo sapiens
ggcgaccggccgccgccggg

SEQ ID NO: 59727 - DNA, 21 bp, Homo sapiens
ggcgaccggccgccgccgggc

SEQ ID NO: 59728 - DNA, 22 bp, Homo sapiens
ggcgaccggccgccgccgggcg

SEQ ID NO: 59729 - DNA, 20 bp, Homo sapiens
gcgaccggccgccgccgggc

SEQ ID NO: 59730 - DNA, 18 bp, Homo sapiens
cgaccggccgccgccggg

SEQ ID NO: 59731 - DNA, 16 bp, Homo sapiens
gaccggccgccgccgg

SEQ ID NO: 59732 - DNA, 17 bp, Homo sapiens
gaccggccgccgccggg

SEQ ID NO: 59733 - DNA, 16 bp, Homo sapiens
ggccgccgccgggcgc

SEQ ID NO: 59734 - DNA, 20 bp, Homo sapiens
gcggtgcgccgcgaccggct

SEQ ID NO: 59735 - DNA, 27 bp, Homo sapiens
gcggtgcgccgcgaccggctccgggac

SEQ ID NO: 59736 - DNA, 18 bp, Homo sapiens
cgccgcgaccggctccgg

SEQ ID NO: 59737 - DNA, 19 bp, Homo sapiens
cgccgcgaccggctccggg

SEQ ID NO: 59738 - DNA, 20 bp, Homo sapiens
cgccgcgaccggctccggga

SEQ ID NO: 59739 - DNA, 16 bp, Homo sapiens
cgcgaccggctccggg

SEQ ID NO: 59740 - DNA, 21 bp, Homo sapiens
cgcgaccggctccgggacggc

SEQ ID NO: 59741 - DNA, 30 bp, Homo sapiens
cggggggccccgtccgtccgtccgtccgtc

SEQ ID NO: 59742 - DNA, 20 bp, Homo sapiens
cccgtccgtccgtccgtccg

SEQ ID NO: 59743 - DNA, 21 bp, Homo sapiens
cccgtccgtccgtccgtccgt

SEQ ID NO: 59744 - DNA, 24 bp, Homo sapiens
cccgtccgtccgtccgtccgtcct

SEQ ID NO: 59745 - DNA, 21 bp, Homo sapiens
tcctcctcccccgtctccgcc

SEQ ID NO: 59746 - DNA, 20 bp, Homo sapiens
cctcctcccccgtctccgcc

SEQ ID NO: 59747 - DNA, 21 bp, Homo sapiens
cctcctcccccgtctccgccc

SEQ ID NO: 59748 - DNA, 19 bp, Homo sapiens
ctcctcccccgtctccgcc

SEQ ID NO: 59749 - DNA, 18 bp, Homo sapiens
tcctcccccgtctccgcc

SEQ ID NO: 59750 - DNA, 19 bp, Homo sapiens
tcctcccccgtctccgccc

SEQ ID NO: 59751 - DNA, 20 bp, Homo sapiens
tcctcccccgtctccgcccc

SEQ ID NO: 59752 - DNA, 17 bp, Homo sapiens
cctcccccgtctccgcc

SEQ ID NO: 59753 - DNA, 18 bp, Homo sapiens
cctcccccgtctccgccc

SEQ ID NO: 59754 - DNA, 19 bp, Homo sapiens
cctcccccgtctccgcccc

SEQ ID NO: 59755 - DNA, 24 bp, Homo sapiens
cctcccccgtctccgccccccggc

SEQ ID NO: 59756 - DNA, 16 bp, Homo sapiens
ctcccccgtctccgcc

SEQ ID NO: 59757 - DNA, 17 bp, Homo sapiens
ctcccccgtctccgccc

SEQ ID NO: 59758 - DNA, 18 bp, Homo sapiens
ctcccccgtctccgcccc

SEQ ID NO: 59759 - DNA, 23 bp, Homo sapiens
ctcccccgtctccgccccccggc

SEQ ID NO: 59760 - DNA, 24 bp, Homo sapiens
ctcccccgtctccgccccccggcc

SEQ ID NO: 59761 - DNA, 16 bp, Homo sapiens
tcccccgtctccgccc

SEQ ID NO: 59762 - DNA, 17 bp, Homo sapiens
tcccccgtctccgcccc

SEQ ID NO: 59763 - DNA, 22 bp, Homo sapiens
tcccccgtctccgccccccggc

SEQ ID NO: 59764 - DNA, 23 bp, Homo sapiens
tcccccgtctccgccccccggcc

SEQ ID NO: 59765 - DNA, 21 bp, Homo sapiens
cccccgtctccgccccccggc

SEQ ID NO: 59766 - DNA, 22 bp, Homo sapiens
cccccgtctccgccccccggcc

SEQ ID NO: 59767 - DNA, 29 bp, Homo sapiens
cccccgtctccgccccccggccccgcgtc

SEQ ID NO: 59768 - DNA, 20 bp, Homo sapiens
ccccgtctccgccccccggc

SEQ ID NO: 59769 - DNA, 21 bp, Homo sapiens
ccccgtctccgccccccggcc

SEQ ID NO: 59770 - DNA, 22 bp, Homo sapiens
ccccgtctccgccccccggccc

SEQ ID NO: 59771 - DNA, 26 bp, Homo sapiens
ccccgtctccgccccccggccccgcg

SEQ ID NO: 59772 - DNA, 28 bp, Homo sapiens
ccccgtctccgccccccggccccgcgtc

SEQ ID NO: 59773 - DNA, 32 bp, Homo sapiens; identical to SEQ ID NO: 19549

SEQ ID NO: 59774 - DNA, 33 bp, Homo sapiens; identical to SEQ ID NO: 19550

SEQ ID NO: 59775 - DNA, 18 bp, Homo sapiens
cccgtctccgccccccgg

SEQ ID NO: 59776 - DNA, 19 bp, Homo sapiens
cccgtctccgccccccggc

SEQ ID NO: 59777 - DNA, 20 bp, Homo sapiens
cccgtctccgccccccggcc

SEQ ID NO: 59778 - DNA, 21 bp, Homo sapiens
cccgtctccgccccccggccc

SEQ ID NO: 59779 - DNA, 22 bp, Homo sapiens
cccgtctccgccccccggcccc

SEQ ID NO: 59780 - DNA, 23 bp, Homo sapiens
cccgtctccgccccccggccccg

SEQ ID NO: 59781 - DNA, 24 bp, Homo sapiens
cccgtctccgccccccggccccgc

SEQ ID NO: 59782 - DNA, 25 bp, Homo sapiens
cccgtctccgccccccggccccgcg

SEQ ID NO: 59783 - DNA, 26 bp, Homo sapiens
cccgtctccgccccccggccccgcgt

SEQ ID NO: 59784 - DNA, 27 bp, Homo sapiens
cccgtctccgccccccggccccgcgtc

SEQ ID NO: 59785 - DNA, 28 bp, Homo sapiens
cccgtctccgccccccggccccgcgtcc

SEQ ID NO: 59786 - DNA, 29 bp, Homo sapiens
cccgtctccgccccccggccccgcgtcct

SEQ ID NO: 59787 - DNA, 30 bp, Homo sapiens; identical to SEQ ID NO: 42425

SEQ ID NO: 59788 - DNA, 31 bp, Homo sapiens; identical to SEQ ID NO: 19552

SEQ ID NO: 59789 - DNA, 32 bp, Homo sapiens; identical to SEQ ID NO: 4220

SEQ ID NO: 59790 - DNA, 18 bp, Homo sapiens
ccgtctccgccccccggc

SEQ ID NO: 59791 - DNA, 19 bp, Homo sapiens
ccgtctccgccccccggcc

SEQ ID NO: 59792 - DNA, 20 bp, Homo sapiens
ccgtctccgccccccggccc

SEQ ID NO: 59793 - DNA, 23 bp, Homo sapiens
ccgtctccgccccccggccccgc

SEQ ID NO: 59794 - DNA, 24 bp, Homo sapiens
ccgtctccgccccccggccccgcg

SEQ ID NO: 59795 - DNA, 26 bp, Homo sapiens
ccgtctccgccccccggccccgcgtc

SEQ ID NO: 59796 - DNA, 27 bp, Homo sapiens
ccgtctccgccccccggccccgcgtcc

SEQ ID NO: 59797 - DNA, 28 bp, Homo sapiens
ccgtctccgccccccggccccgcgtcct

SEQ ID NO: 59798 - DNA, 29 bp, Homo sapiens
ccgtctccgccccccggccccgcgtcctc

SEQ ID NO: 59799 - DNA, 30 bp, Homo sapiens; identical to SEQ ID NO: 4221

SEQ ID NO: 59800 - DNA, 31 bp, Homo sapiens; identical to SEQ ID NO: 4222

SEQ ID NO: 59801 - DNA, 17 bp, Homo sapiens
cgtctccgccccccggc

SEQ ID NO: 59802 - DNA, 18 bp, Homo sapiens
cgtctccgccccccggcc

SEQ ID NO: 59803 - DNA, 19 bp, Homo sapiens
cgtctccgccccccggccc

SEQ ID NO: 59804 - DNA, 20 bp, Homo sapiens
cgtctccgccccccggcccc

SEQ ID NO: 59805 - DNA, 21 bp, Homo sapiens
cgtctccgccccccggccccg

SEQ ID NO: 59806 - DNA, 22 bp, Homo sapiens
cgtctccgccccccggccccgc

SEQ ID NO: 59807 - DNA, 23 bp, Homo sapiens
cgtctccgccccccggccccgcg

SEQ ID NO: 59808 - DNA, 24 bp, Homo sapiens
cgtctccgccccccggccccgcgt

SEQ ID NO: 59809 - DNA, 25 bp, Homo sapiens
cgtctccgccccccggccccgcgtc

SEQ ID NO: 59810 - DNA, 26 bp, Homo sapiens
cgtctccgccccccggccccgcgtcc

SEQ ID NO: 59811 - DNA, 27 bp, Homo sapiens
cgtctccgccccccggccccgcgtcct

SEQ ID NO: 59812 - DNA, 28 bp, Homo sapiens
cgtctccgccccccggccccgcgtcctc

SEQ ID NO: 59813 - DNA, 29 bp, Homo sapiens
cgtctccgccccccggccccgcgtcctcc

SEQ ID NO: 59814 - DNA, 30 bp, Homo sapiens; identical to SEQ ID NO: 19567

SEQ ID NO: 59815 - DNA, 31 bp, Homo sapiens
cgtctccgccccccggccccgcgtcctccct

SEQ ID NO: 59816 - DNA, 22 bp, Homo sapiens
gtctccgccccccggccccgcg

SEQ ID NO: 59817 - DNA, 24 bp, Homo sapiens
gtctccgccccccggccccgcgtc

SEQ ID NO: 59818 - DNA, 26 bp, Homo sapiens
gtctccgccccccggccccgcgtcct

SEQ ID NO: 59819 - DNA, 29 bp, Homo sapiens
gtctccgccccccggccccgcgtcctccc

SEQ ID NO: 59820 - DNA, 30 bp, Homo sapiens; identical to SEQ ID NO: 4225

SEQ ID NO: 59821 - DNA, 19 bp, Homo sapiens
tccgccccccggccccgcg

SEQ ID NO: 59822 - DNA, 21 bp, Homo sapiens
tccgccccccggccccgcgtc

SEQ ID NO: 59823 - DNA, 22 bp, Homo sapiens
tccgccccccggccccgcgtcc

SEQ ID NO: 59824 - DNA, 23 bp, Homo sapiens
tccgccccccggccccgcgtcct

SEQ ID NO: 59825 - DNA, 25 bp, Homo sapiens
tccgccccccggccccgcgtcctcc

SEQ ID NO: 59826 - DNA, 26 bp, Homo sapiens
tccgccccccggccccgcgtcctccc

SEQ ID NO: 59827 - DNA, 18 bp, Homo sapiens
ccgccccccggccccgcg

SEQ ID NO: 59828 - DNA, 19 bp, Homo sapiens
ccgccccccggccccgcgt

SEQ ID NO: 59829 - DNA, 20 bp, Homo sapiens
ccgccccccggccccgcgtc

SEQ ID NO: 59830 - DNA, 21 bp, Homo sapiens
ccgccccccggccccgcgtcc

SEQ ID NO: 59831 - DNA, 22 bp, Homo sapiens
ccgccccccggccccgcgtcct

SEQ ID NO: 59832 - DNA, 23 bp, Homo sapiens
ccgccccccggccccgcgtcctc

SEQ ID NO: 59833 - DNA, 24 bp, Homo sapiens
ccgccccccggccccgcgtcctcc

SEQ ID NO: 59834 - DNA, 25 bp, Homo sapiens
ccgccccccggccccgcgtcctccc

SEQ ID NO: 59835 - DNA, 16 bp, Homo sapiens
cgccccccggccccgc

SEQ ID NO: 59836 - DNA, 17 bp, Homo sapiens
cgccccccggccccgcg

SEQ ID NO: 59837 - DNA, 18 bp, Homo sapiens
cgccccccggccccgcgt

SEQ ID NO: 59838 - DNA, 19 bp, Homo sapiens
cgccccccggccccgcgtc

SEQ ID NO: 59839 - DNA, 20 bp, Homo sapiens
cgccccccggccccgcgtcc

SEQ ID NO: 59840 - DNA, 21 bp, Homo sapiens
cgccccccggccccgcgtcct

SEQ ID NO: 59841 - DNA, 22 bp, Homo sapiens
cgccccccggccccgcgtcctc

SEQ ID NO: 59842 - DNA, 23 bp, Homo sapiens
cgccccccggccccgcgtcctcc

SEQ ID NO: 59843 - DNA, 24 bp, Homo sapiens
cgccccccggccccgcgtcctccc

SEQ ID NO: 59844 - DNA, 18 bp, Homo sapiens
gccccccggccccgcgtc

SEQ ID NO: 59845 - DNA, 23 bp, Homo sapiens
gccccccggccccgcgtcctccc

SEQ ID NO: 59846 - DNA, 22 bp, Homo sapiens
ccccccggccccgcgtcctccc

SEQ ID NO: 59847 - DNA, 16 bp, Homo sapiens
cccccggccccgcgtc

SEQ ID NO: 59848 - DNA, 18 bp, Homo sapiens
cccccggccccgcgtcct

SEQ ID NO: 59849 - DNA, 20 bp, Homo sapiens
cccccggccccgcgtcctcc

SEQ ID NO: 59850 - DNA, 21 bp, Homo sapiens
cccccggccccgcgtcctccc

SEQ ID NO: 59851 - DNA, 16 bp, Homo sapiens
ccccggccccgcgtcc

SEQ ID NO: 59852 - DNA, 17 bp, Homo sapiens
ccccggccccgcgtcct

SEQ ID NO: 59853 - DNA, 18 bp, Homo sapiens
ccccggccccgcgtcctc

SEQ ID NO: 59854 - DNA, 19 bp, Homo sapiens
ccccggccccgcgtcctcc

SEQ ID NO: 59855 - DNA, 20 bp, Homo sapiens
ccccggccccgcgtcctccc

SEQ ID NO: 59856 - DNA, 16 bp, Homo sapiens
cccggccccgcgtcct

SEQ ID NO: 59857 - DNA, 18 bp, Homo sapiens
cccggccccgcgtcctcc

SEQ ID NO: 59858 - DNA, 19 bp, Homo sapiens
cccggccccgcgtcctccc

SEQ ID NO: 59859 - DNA, 23 bp, Homo sapiens
ctccctcgggagggcgcgcgggt

SEQ ID NO: 59860 - DNA, 28 bp, Homo sapiens
ctccctcgggagggcgcgcgggtcgggg

SEQ ID NO: 59861 - DNA, 29 bp, Homo sapiens
ctccctcgggagggcgcgcgggtcggggc

SEQ ID NO: 59862 - DNA, 30 bp, Homo sapiens; identical to SEQ ID NO: 19625

SEQ ID NO: 59863 - DNA, 31 bp, Homo sapiens; identical to SEQ ID NO: 19626

SEQ ID NO: 59864 - DNA, 24 bp, Homo sapiens
cgcgggtcggggcggcggcggcgg

SEQ ID NO: 59865 - DNA, 22 bp, Homo sapiens
cgggtcggggcggcggcggcgg

SEQ ID NO: 59866 - DNA, 23 bp, Homo sapiens
cgggtcggggcggcggcggcggc

SEQ ID NO: 59867 - DNA, 30 bp, Homo sapiens
gcggcggcggcggtggcggcggcggcggcg

SEQ ID NO: 59868 - DNA, 16 bp, Homo sapiens
cggcggcggcgggacc

SEQ ID NO: 59869 - DNA, 23 bp, Homo sapiens
ccccccgagtgttacagcccccc

SEQ ID NO: 59870 - DNA, 24 bp, Homo sapiens
ccccccgagtgttacagccccccc

SEQ ID NO: 59871 - DNA, 26 bp, Homo sapiens
ccccccgagtgttacagcccccccgg

SEQ ID NO: 59872 - DNA, 27 bp, Homo sapiens
ccccccgagtgttacagcccccccggc

SEQ ID NO: 59873 - DNA, 26 bp, Homo sapiens
cccccgagtgttacagcccccccggc

SEQ ID NO: 59874 - DNA, 37 bp, Homo sapiens
cagcactcgccgaatcccggggccgagggagcgagac

SEQ ID NO: 59875 - DNA, 32 bp, Homo sapiens; identical to SEQ ID NO: 19741

SEQ ID NO: 59876 - DNA, 34 bp, Homo sapiens
agcactcgccgaatcccggggccgagggagcgag

SEQ ID NO: 59877 - DNA, 36 bp, Homo sapiens; identical to SEQ ID NO: 57624

SEQ ID NO: 59878 - DNA, 37 bp, Homo sapiens
agcactcgccgaatcccggggccgagggagcgagacc

SEQ ID NO: 59879 - DNA, 32 bp, Homo sapiens; identical to SEQ ID NO: 19756

SEQ ID NO: 59880 - DNA, 16 bp, Homo sapiens
cgccgaatcccggggc

SEQ ID NO: 59881 - DNA, 17 bp, Homo sapiens
cgccgaatcccggggcc

SEQ ID NO: 59882 - DNA, 18 bp, Homo sapiens
cgccgaatcccggggccg

SEQ ID NO: 59883 - DNA, 26 bp, Homo sapiens
aatcccggggccgagggagcgagacc

SEQ ID NO: 59884 - DNA, 17 bp, Homo sapiens
cccggggccgagggagc

SEQ ID NO: 59885 - DNA, 18 bp, Homo sapiens
cccggggccgagggagcg

SEQ ID NO: 59886 - DNA, 19 bp, Homo sapiens
cccggggccgagggagcga

SEQ ID NO: 59887 - DNA, 20 bp, Homo sapiens
cccggggccgagggagcgag

SEQ ID NO: 59888 - DNA, 21 bp, Homo sapiens
cccggggccgagggagcgaga

SEQ ID NO: 59889 - DNA, 22 bp, Homo sapiens
cccggggccgagggagcgagac

SEQ ID NO: 59890 - DNA, 23 bp, Homo sapiens
cccggggccgagggagcgagacc

SEQ ID NO: 59891 - DNA, 24 bp, Homo sapiens
cccggggccgagggagcgagaccc

SEQ ID NO: 59892 - DNA, 25 bp, Homo sapiens
cccggggccgagggagcgagacccg

SEQ ID NO: 59893 - DNA, 30 bp, Homo sapiens; identical to SEQ ID NO: 57631

SEQ ID NO: 59894 - DNA, 32 bp, Homo sapiens
cccggggccgagggagcgagacccgtcgccgc

SEQ ID NO: 59895 - DNA, 33 bp, Homo sapiens
cccggggccgagggagcgagacccgtcgccgcg

SEQ ID NO: 59896 - DNA, 21 bp, Homo sapiens
ccggggccgagggagcgagac

SEQ ID NO: 59897 - DNA, 22 bp, Homo sapiens
ccggggccgagggagcgagacc

SEQ ID NO: 59898 - DNA, 19 bp, Homo sapiens
cggggccgagggagcgaga

SEQ ID NO: 59899 - DNA, 28 bp, Homo sapiens
cggggccgagggagcgagacccgtcgcc

SEQ ID NO: 59900 - DNA, 30 bp, Homo sapiens; identical to SEQ ID NO: 43106

SEQ ID NO: 59901 - DNA, 31 bp, Homo sapiens
agacccgtcgccgcgctctcccccctcccgg

SEQ ID NO: 59902 - DNA, 22 bp, Homo sapiens
cgctctcccccctcccggcgcc

SEQ ID NO: 59903 - DNA, 29 bp, Homo sapiens
tcccccctcccggcgcccacccccgcggg

SEQ ID NO: 59904 - DNA, 30 bp, Homo sapiens
tcccccctcccggcgcccacccccgcgggg

SEQ ID NO: 59905 - DNA, 16 bp, Homo sapiens
cccccctcccggcgcc

SEQ ID NO: 59906 - DNA, 17 bp, Homo sapiens
cccccctcccggcgccc

SEQ ID NO: 59907 - DNA, 28 bp, Homo sapiens
cccccctcccggcgcccacccccgcggg

SEQ ID NO: 59908 - DNA, 29 bp, Homo sapiens
cccccctcccggcgcccacccccgcgggg

SEQ ID NO: 59909 - DNA, 16 bp, Homo sapiens
ccccctcccggcgccc

SEQ ID NO: 59910 - DNA, 27 bp, Homo sapiens
ccccctcccggcgcccacccccgcggg

SEQ ID NO: 59911 - DNA, 28 bp, Homo sapiens
ccccctcccggcgcccacccccgcgggg

SEQ ID NO: 59912 - DNA, 27 bp, Homo sapiens
cccctcccggcgcccacccccgcgggg

SEQ ID NO: 59913 - DNA, 20 bp, Homo sapiens
ccggcgcccacccccgcggg

SEQ ID NO: 59914 - DNA, 18 bp, Homo sapiens
cggcgcccacccccgcgg

SEQ ID NO: 59915 - DNA, 19 bp, Homo sapiens
cggcgcccacccccgcggg

SEQ ID NO: 59916 - DNA, 20 bp, Homo sapiens
cggcgcccacccccgcgggg

SEQ ID NO: 59917 - DNA, 17 bp, Homo sapiens
ggcgcccacccccgcgg

SEQ ID NO: 59918 - DNA, 18 bp, Homo sapiens
ggcgcccacccccgcggg

SEQ ID NO: 59919 - DNA, 19 bp, Homo sapiens
ggcgcccacccccgcgggg

SEQ ID NO: 59920 - DNA, 17 bp, Homo sapiens
gcgcccacccccgcggg

SEQ ID NO: 59921 - DNA, 17 bp, Homo sapiens
cccccgcgaggggggtc

SEQ ID NO: 59922 - DNA, 39 bp, Homo sapiens
cccccgcgaggggggtctcccccgcgggggcgcgccggc

SEQ ID NO: 59923 - DNA, 17 bp, Homo sapiens
ccccgcgaggggggtct

SEQ ID NO: 59924 - DNA, 37 bp, Homo sapiens
ccccgcgaggggggtctcccccgcgggggcgcgccgg

SEQ ID NO: 59925 - DNA, 38 bp, Homo sapiens
ccccgcgaggggggtctcccccgcgggggcgcgccggc

SEQ ID NO: 59926 - DNA, 39 bp, Homo sapiens; identical to SEQ ID NO: 57645

SEQ ID NO: 59927 - DNA, 41 bp, Homo sapiens
ccccgcgaggggggtctcccccgcgggggcgcgccggcgtc

SEQ ID NO: 59928 - DNA, 35 bp, Homo sapiens
cccgcgaggggggtctcccccgcgggggcgcgccg

SEQ ID NO: 59929 - DNA, 36 bp, Homo sapiens
cccgcgaggggggtctcccccgcgggggcgcgccgg

SEQ ID NO: 59930 - DNA, 37 bp, Homo sapiens; identical to SEQ ID NO: 19880

SEQ ID NO: 59931 - DNA, 38 bp, Homo sapiens
cccgcgaggggggtctcccccgcgggggcgcgccggcg

SEQ ID NO: 59932 - DNA, 39 bp, Homo sapiens
cccgcgaggggggtctcccccgcgggggcgcgccggcgt

SEQ ID NO: 59933 - DNA, 37 bp, Homo sapiens
ccgcgaggggggtctcccccgcgggggcgcgccggcg

SEQ ID NO: 59934 - DNA, 17 bp, Homo sapiens
cccccgcgggggcgcgc

SEQ ID NO: 59935 - DNA, 18 bp, Homo sapiens
cccccgcgggggcgcgcc

SEQ ID NO: 59936 - DNA, 19 bp, Homo sapiens
cccccgcgggggcgcgccg

SEQ ID NO: 59937 - DNA, 20 bp, Homo sapiens
cccccgcgggggcgcgccgg

SEQ ID NO: 59938 - DNA, 21 bp, Homo sapiens
cccccgcgggggcgcgccggc

SEQ ID NO: 59939 - DNA, 22 bp, Homo sapiens
cccccgcgggggcgcgccggcg

SEQ ID NO: 59940 - DNA, 23 bp, Homo sapiens
cccccgcgggggcgcgccggcgt

SEQ ID NO: 59941 - DNA, 24 bp, Homo sapiens
cccccgcgggggcgcgccggcgtc

SEQ ID NO: 59942 - DNA, 30 bp, Homo sapiens
cccccgcgggggcgcgccggcgtctcctcg

SEQ ID NO: 59943 - DNA, 16 bp, Homo sapiens
ccccgcgggggcgcgc

SEQ ID NO: 59944 - DNA, 17 bp, Homo sapiens
ccccgcgggggcgcgcc

SEQ ID NO: 59945 - DNA, 18 bp, Homo sapiens
ccccgcgggggcgcgccg

SEQ ID NO: 59946 - DNA, 19 bp, Homo sapiens
ccccgcgggggcgcgccgg

SEQ ID NO: 59947 - DNA, 20 bp, Homo sapiens
ccccgcgggggcgcgccggc

SEQ ID NO: 59948 - DNA, 21 bp, Homo sapiens
ccccgcgggggcgcgccggcg

SEQ ID NO: 59949 - DNA, 16 bp, Homo sapiens
cccgcgggggcgcgcc

SEQ ID NO: 59950 - DNA, 17 bp, Homo sapiens
cccgcgggggcgcgccg

SEQ ID NO: 59951 - DNA, 18 bp, Homo sapiens
cccgcgggggcgcgccgg

SEQ ID NO: 59952 - DNA, 19 bp, Homo sapiens
cccgcgggggcgcgccggc

SEQ ID NO: 59953 - DNA, 20 bp, Homo sapiens
cccgcgggggcgcgccggcg

SEQ ID NO: 59954 - DNA, 17 bp, Homo sapiens
cgcgggggcgcgccggc

SEQ ID NO: 59955 - DNA, 18 bp, Homo sapiens
cgcgggggcgcgccggcg

SEQ ID NO: 59956 - DNA, 46 bp, Homo sapiens
cctcgtgggggggccgggccacccctcccacggcgcgaccgctctc

SEQ ID NO: 59957 - DNA, 47 bp, Homo sapiens
cctcgtgggggggccgggccacccctcccacggcgcgaccgctctcc

SEQ ID NO: 59958 - DNA, 38 bp, Homo sapiens
ctcgtgggggggccgggccacccctcccacggcgcgac

SEQ ID NO: 59959 - DNA, 39 bp, Homo sapiens
ctcgtgggggggccgggccacccctcccacggcgcgacc

SEQ ID NO: 59960 - DNA, 40 bp, Homo sapiens
ctcgtgggggggccgggccacccctcccacggcgcgaccg

SEQ ID NO: 59961 - DNA, 44 bp, Homo sapiens
ctcgtgggggggccgggccacccctcccacggcgcgaccgctct

SEQ ID NO: 59962 - DNA, 45 bp, Homo sapiens
ctcgtgggggggccgggccacccctcccacggcgcgaccgctctc

SEQ ID NO: 59963 - DNA, 46 bp, Homo sapiens
ctcgtgggggggccgggccacccctcccacggcgcgaccgctctcc

SEQ ID NO: 59964 - DNA, 37 bp, Homo sapiens
tcgtgggggggccgggccacccctcccacggcgcgac

SEQ ID NO: 59965 - DNA, 38 bp, Homo sapiens
tcgtgggggggccgggccacccctcccacggcgcgacc

SEQ ID NO: 59966 - DNA, 39 bp, Homo sapiens
tcgtgggggggccgggccacccctcccacggcgcgaccg

SEQ ID NO: 59967 - DNA, 44 bp, Homo sapiens
tcgtgggggggccgggccacccctcccacggcgcgaccgctctc

SEQ ID NO: 59968 - DNA, 45 bp, Homo sapiens
tcgtgggggggccgggccacccctcccacggcgcgaccgctctcc

SEQ ID NO: 59969 - DNA, 36 bp, Homo sapiens
cgtgggggggccgggccacccctcccacggcgcgac

SEQ ID NO: 59970 - DNA, 26 bp, Homo sapiens
cgggccacccctcccacggcgcgacc

SEQ ID NO: 59971 - DNA, 18 bp, Homo sapiens
cccctcccacggcgcgac

SEQ ID NO: 59972 - DNA, 19 bp, Homo sapiens
cccctcccacggcgcgacc

SEQ ID NO: 59973 - DNA, 20 bp, Homo sapiens
cccctcccacggcgcgaccg

SEQ ID NO: 59974 - DNA, 21 bp, Homo sapiens
cccctcccacggcgcgaccgc

SEQ ID NO: 59975 - DNA, 17 bp, Homo sapiens
ccctcccacggcgcgac

SEQ ID NO: 59976 - DNA, 18 bp, Homo sapiens
ccctcccacggcgcgacc

SEQ ID NO: 59977 - DNA, 19 bp, Homo sapiens
ccctcccacggcgcgaccg

SEQ ID NO: 59978 - DNA, 20 bp, Homo sapiens
ccctcccacggcgcgaccgc

SEQ ID NO: 59979 - DNA, 17 bp, Homo sapiens
cctcccacggcgcgacc

SEQ ID NO: 59980 - DNA, 18 bp, Homo sapiens
cctcccacggcgcgaccg

SEQ ID NO: 59981 - DNA, 16 bp, Homo sapiens
ctcccacggcgcgacc

SEQ ID NO: 59982 - DNA, 17 bp, Homo sapiens
ctcccacggcgcgaccg

SEQ ID NO: 59983 - DNA, 16 bp, Homo sapiens
tcccacggcgcgaccg

SEQ ID NO: 59984 - DNA, 19 bp, Homo sapiens
tcccacggcgcgaccgctc

SEQ ID NO: 59985 - DNA, 22 bp, Homo sapiens
cggcgcgaccgctctcccaccc

SEQ ID NO: 59986 - DNA, 23 bp, Homo sapiens
cggcgcgaccgctctcccacccc

SEQ ID NO: 59987 - DNA, 30 bp, Homo sapiens; identical to SEQ ID NO: 19945

SEQ ID NO: 59988 - DNA, 19 bp, Homo sapiens
cgcgaccgctctcccaccc

SEQ ID NO: 59989 - DNA, 17 bp, Homo sapiens
cccctcctccccgcgcc

SEQ ID NO: 59990 - DNA, 23 bp, Homo sapiens
cccctcctccccgcgcccccgcc

SEQ ID NO: 59991 - DNA, 24 bp, Homo sapiens
cccctcctccccgcgcccccgccc

SEQ ID NO: 59992 - DNA, 22 bp, Homo sapiens
ccctcctccccgcgcccccgcc

SEQ ID NO: 59993 - DNA, 23 bp, Homo sapiens
ccctcctccccgcgcccccgccc

SEQ ID NO: 59994 - DNA, 21 bp, Homo sapiens
cctcctccccgcgcccccgcc

SEQ ID NO: 59995 - DNA, 17 bp, Homo sapiens
cccgcgcccccgccccg

SEQ ID NO: 59996 - DNA, 19 bp, Homo sapiens
cccgcgcccccgccccggc

SEQ ID NO: 59997 - DNA, 20 bp, Homo sapiens
cccgccccggcgacgggggg

SEQ ID NO: 59998 - DNA, 22 bp, Homo sapiens
cccgccccggcgacgggggggg

SEQ ID NO: 59999 - DNA, 23 bp, Homo sapiens
cccgccccggcgacggggggggt

SEQ ID NO: 60000 - DNA, 20 bp, Homo sapiens
cccggcgacggggggggtgc

SEQ ID NO: 60001 - DNA, 17 bp, Homo sapiens
cgcgcgcgggtcggggg

SEQ ID NO: 60002 - DNA, 18 bp, Homo sapiens
cgcgcgcgggtcgggggg

SEQ ID NO: 60003 - DNA, 19 bp, Homo sapiens
cgcgcgcgggtcggggggc

SEQ ID NO: 60004 - DNA, 20 bp, Homo sapiens
cgcgcgcgggtcggggggcg

SEQ ID NO: 60005 - DNA, 21 bp, Homo sapiens
cgcgcgcgggtcggggggcgg

SEQ ID NO: 60006 - DNA, 22 bp, Homo sapiens
cgcgcgcgggtcggggggcggg

SEQ ID NO: 60007 - DNA, 23 bp, Homo sapiens
cgcgcgcgggtcggggggcgggg

SEQ ID NO: 60008 - DNA, 24 bp, Homo sapiens
cgcgcgcgggtcggggggcggggc

SEQ ID NO: 60009 - DNA, 25 bp, Homo sapiens
cgcgcgcgggtcggggggcggggcg

SEQ ID NO: 60010 - DNA, 26 bp, Homo sapiens
cgcgcgcgggtcggggggcggggcgg

SEQ ID NO: 60011 - DNA, 27 bp, Homo sapiens
cgcgcgcgggtcggggggcggggcgga

SEQ ID NO: 60012 - DNA, 28 bp, Homo sapiens
cgcgcgcgggtcggggggcggggcggac

SEQ ID NO: 60013 - DNA, 16 bp, Homo sapiens
cgcgcgggtcgggggg

SEQ ID NO: 60014 - DNA, 17 bp, Homo sapiens
cgcgcgggtcggggggc

SEQ ID NO: 60015 - DNA, 20 bp, Homo sapiens
cgcgcgggtcggggggcggg

SEQ ID NO: 60016 - DNA, 21 bp, Homo sapiens
cgcgcgggtcggggggcgggg

SEQ ID NO: 60017 - DNA, 22 bp, Homo sapiens
cgcgcgggtcggggggcggggc

SEQ ID NO: 60018 - DNA, 18 bp, Homo sapiens
cgcgggtcggggggcggg

SEQ ID NO: 60019 - DNA, 24 bp, Homo sapiens
cagtgcgccccgggcgggtcgcgc

SEQ ID NO: 60020 - DNA, 32 bp, Homo sapiens; identical to SEQ ID NO: 4273

SEQ ID NO: 60021 - DNA, 33 bp, Homo sapiens; identical to SEQ ID NO: 4274

SEQ ID NO: 60022 - DNA, 34 bp, Homo sapiens; identical to SEQ ID NO: 20013

SEQ ID NO: 60023 - DNA, 35 bp, Homo sapiens; identical to SEQ ID NO: 20014

SEQ ID NO: 60024 - DNA, 40 bp, Homo sapiens
cagtgcgccccgggcgggtcgcgccgtcgggcccggggga

SEQ ID NO: 60025 - DNA, 41 bp, Homo sapiens
cagtgcgccccgggcgggtcgcgccgtcgggcccgggggag

SEQ ID NO: 60026 - DNA, 42 bp, Homo sapiens
cagtgcgccccgggcgggtcgcgccgtcgggcccgggggagg

SEQ ID NO: 60027 - DNA, 43 bp, Homo sapiens
cagtgcgccccgggcgggtcgcgccgtcgggcccgggggaggt

SEQ ID NO: 60028 - DNA, 44 bp, Homo sapiens
cagtgcgccccgggcgggtcgcgccgtcgggcccgggggaggtt

SEQ ID NO: 60029 - DNA, 30 bp, Homo sapiens; identical to SEQ ID NO: 20020

SEQ ID NO: 60030 - DNA, 31 bp, Homo sapiens; identical to SEQ ID NO: 4275

SEQ ID NO: 60031 - DNA, 32 bp, Homo sapiens; identical to SEQ ID NO: 4276

SEQ ID NO: 60032 - DNA, 33 bp, Homo sapiens; identical to SEQ ID NO: 4277

SEQ ID NO: 60033 - DNA, 34 bp, Homo sapiens; identical to SEQ ID NO: 20024

SEQ ID NO: 60034 - DNA, 35 bp, Homo sapiens; identical to SEQ ID NO: 20025

SEQ ID NO: 60035 - DNA, 41 bp, Homo sapiens
agtgcgccccgggcgggtcgcgccgtcgggcccgggggagg

SEQ ID NO: 60036 - DNA, 43 bp, Homo sapiens
agtgcgccccgggcgggtcgcgccgtcgggcccgggggaggtt

SEQ ID NO: 60037 - DNA, 19 bp, Homo sapiens
cgccccgggcgggtcgcgc

SEQ ID NO: 60038 - DNA, 20 bp, Homo sapiens
cgccccgggcgggtcgcgcc

SEQ ID NO: 60039 - DNA, 21 bp, Homo sapiens
cgccccgggcgggtcgcgccg

SEQ ID NO: 60040 - DNA, 26 bp, Homo sapiens
cgccccgggcgggtcgcgccgtcggg

SEQ ID NO: 60041 - DNA, 27 bp, Homo sapiens
cgccccgggcgggtcgcgccgtcgggc

SEQ ID NO: 60042 - DNA, 30 bp, Homo sapiens; identical to SEQ ID NO: 20036

SEQ ID NO: 60043 - DNA, 19 bp, Homo sapiens
gccccgggcgggtcgcgcc

SEQ ID NO: 60044 - DNA, 20 bp, Homo sapiens
gccccgggcgggtcgcgccg

SEQ ID NO: 60045 - DNA, 25 bp, Homo sapiens
gccccgggcgggtcgcgccgtcggg

SEQ ID NO: 60046 - DNA, 30 bp, Homo sapiens; identical to SEQ ID NO: 20045

SEQ ID NO: 60047 - DNA, 17 bp, Homo sapiens
ccccgggcgggtcgcgc

SEQ ID NO: 60048 - DNA, 18 bp, Homo sapiens
ccccgggcgggtcgcgcc

SEQ ID NO: 60049 - DNA, 19 bp, Homo sapiens
ccccgggcgggtcgcgccg

SEQ ID NO: 60050 - DNA, 21 bp, Homo sapiens
ccccgggcgggtcgcgccgtc

SEQ ID NO: 60051 - DNA, 23 bp, Homo sapiens
ccccgggcgggtcgcgccgtcgg

SEQ ID NO: 60052 - DNA, 24 bp, Homo sapiens
ccccgggcgggtcgcgccgtcggg

SEQ ID NO: 60053 - DNA, 25 bp, Homo sapiens
ccccgggcgggtcgcgccgtcgggc

SEQ ID NO: 60054 - DNA, 26 bp, Homo sapiens
ccccgggcgggtcgcgccgtcgggcc

SEQ ID NO: 60055 - DNA, 33 bp, Homo sapiens
ccccgggcgggtcgcgccgtcgggcccggggga

SEQ ID NO: 60056 - DNA, 35 bp, Homo sapiens
ccccgggcgggtcgcgccgtcgggcccgggggagg

SEQ ID NO: 60057 - DNA, 17 bp, Homo sapiens
cccgggcgggtcgcgcc

SEQ ID NO: 60058 - DNA, 18 bp, Homo sapiens
cccgggcgggtcgcgccg

SEQ ID NO: 60059 - DNA, 23 bp, Homo sapiens
cccgggcgggtcgcgccgtcggg

SEQ ID NO: 60060 - DNA, 24 bp, Homo sapiens
cccgggcgggtcgcgccgtcgggc

SEQ ID NO: 60061 - DNA, 16 bp, Homo sapiens
ccgggcgggtcgcgcc

SEQ ID NO: 60062 - DNA, 22 bp, Homo sapiens
ccgggcgggtcgcgccgtcggg

SEQ ID NO: 60063 - DNA, 23 bp, Homo sapiens
ccgggcgggtcgcgccgtcgggc

SEQ ID NO: 60064 - DNA, 18 bp, Homo sapiens
cgggcgggtcgcgccgtc

SEQ ID NO: 60065 - DNA, 21 bp, Homo sapiens
cgggcgggtcgcgccgtcggg

SEQ ID NO: 60066 - DNA, 22 bp, Homo sapiens
cgggcgggtcgcgccgtcgggc

SEQ ID NO: 60067 - DNA, 23 bp, Homo sapiens
cgggcgggtcgcgccgtcgggcc

SEQ ID NO: 60068 - DNA, 24 bp, Homo sapiens
cgggcgggtcgcgccgtcgggccc

SEQ ID NO: 60069 - DNA, 27 bp, Homo sapiens
cgggcgggtcgcgccgtcgggcccggg

SEQ ID NO: 60070 - DNA, 28 bp, Homo sapiens
cgggcgggtcgcgccgtcgggcccgggg

SEQ ID NO: 60071 - DNA, 31 bp, Homo sapiens
cgggcgggtcgcgccgtcgggcccgggggag

SEQ ID NO: 60072 - DNA, 32 bp, Homo sapiens
cgggcgggtcgcgccgtcgggcccgggggagg

SEQ ID NO: 60073 - DNA, 20 bp, Homo sapiens
gggcgggtcgcgccgtcggg

SEQ ID NO: 60074 - DNA, 22 bp, Homo sapiens
gggcgggtcgcgccgtcgggcc

SEQ ID NO: 60075 - DNA, 22 bp, Homo sapiens
gcgggtcgcgccgtcgggcccg

SEQ ID NO: 60076 - DNA, 16 bp, Homo sapiens
gggtcgcgccgtcggg

SEQ ID NO: 60077 - DNA, 17 bp, Homo sapiens
gggtcgcgccgtcgggc

SEQ ID NO: 60078 - DNA, 17 bp, Homo sapiens
ggtcgcgccgtcgggcc

SEQ ID NO: 60079 - DNA, 19 bp, Homo sapiens
ggtcgcgccgtcgggcccg

SEQ ID NO: 60080 - DNA, 18 bp, Homo sapiens
cgcgccgtcgggcccggg

SEQ ID NO: 60081 - DNA, 19 bp, Homo sapiens
cgcgccgtcgggcccgggg

SEQ ID NO: 60082 - DNA, 20 bp, Homo sapiens
cgcgccgtcgggcccggggg

SEQ ID NO: 60083 - DNA, 17 bp, Homo sapiens
gcgccgtcgggcccggg

SEQ ID NO: 60084 - DNA, 16 bp, Homo sapiens
cgccgtcgggcccggg

SEQ ID NO: 60085 - DNA, 17 bp, Homo sapiens
cgccgtcgggcccgggg

SEQ ID NO: 60086 - DNA, 18 bp, Homo sapiens
cgccgtcgggcccggggg

SEQ ID NO: 60087 - DNA, 19 bp, Homo sapiens
cgccgtcgggcccggggga

SEQ ID NO: 60088 - DNA, 21 bp, Homo sapiens
cgccgtcgggcccgggggagg

SEQ ID NO: 60089 - DNA, 29 bp, Homo sapiens
gttctctcggggccacgcgcgcgtccccc

SEQ ID NO: 60090 - DNA, 38 bp, Homo sapiens
cgcgcgtcccccgaagagggggacggcggagcgagcgc

SEQ ID NO: 60091 - DNA, 30 bp, Homo sapiens
cgcgtcccccgaagagggggacggcggagc

SEQ ID NO: 60092 - DNA, 28 bp, Homo sapiens
cgtcccccgaagagggggacggcggagc

SEQ ID NO: 60093 - DNA, 27 bp, Homo sapiens
gtcccccgaagagggggacggcggagc

SEQ ID NO: 60094 - DNA, 20 bp, Homo sapiens
cccccgaagagggggacggc

SEQ ID NO: 60095 - DNA, 25 bp, Homo sapiens
cccccgaagagggggacggcggagc

SEQ ID NO: 60096 - DNA, 19 bp, Homo sapiens
ccccgaagagggggacggc

SEQ ID NO: 60097 - DNA, 21 bp, Homo sapiens
cgcacggggtcggcggcgacg

SEQ ID NO: 60098 - DNA, 25 bp, Homo sapiens
cgcacggggtcggcggcgacgtcgg

SEQ ID NO: 60099 - DNA, 19 bp, Homo sapiens
gcacggggtcggcggcgac

SEQ ID NO: 60100 - DNA, 20 bp, Homo sapiens
gcacggggtcggcggcgacg

SEQ ID NO: 60101 - DNA, 21 bp, Homo sapiens
gcacggggtcggcggcgacgt

SEQ ID NO: 60102 - DNA, 22 bp, Homo sapiens
gcacggggtcggcggcgacgtc

SEQ ID NO: 60103 - DNA, 24 bp, Homo sapiens
gcacggggtcggcggcgacgtcgg

SEQ ID NO: 60104 - DNA, 25 bp, Homo sapiens
gcacggggtcggcggcgacgtcggc

SEQ ID NO: 60105 - DNA, 19 bp, Homo sapiens
cacggggtcggcggcgacg

SEQ ID NO: 60106 - DNA, 20 bp, Homo sapiens
cacggggtcggcggcgacgt

SEQ ID NO: 60107 - DNA, 21 bp, Homo sapiens
cacggggtcggcggcgacgtc

SEQ ID NO: 60108 - DNA, 16 bp, Homo sapiens
ggcggcgacgtcggct

SEQ ID NO: 60109 - DNA, 24 bp, Homo sapiens
gcgacgtcggctacccacccgacc

SEQ ID NO: 60110 - DNA, 23 bp, Homo sapiens
cgacgtcggctacccacccgacc

SEQ ID NO: 60111 - DNA, 19 bp, Homo sapiens
gtcggctacccacccgacc

SEQ ID NO: 60112 - DNA, 45 bp, Homo sapiens; identical to SEQ ID NO: 20280

SEQ ID NO: 60113 - DNA, 24 bp, Homo sapiens
aaggagtctaacacgtgcgcgagt

SEQ ID NO: 60114 - DNA, 32 bp, Homo sapiens; identical to SEQ ID NO: 4331

SEQ ID NO: 60115 - DNA, 38 bp, Homo sapiens
aaggagtctaacacgtgcgcgagtcgggggctcgcacg

SEQ ID NO: 60116 - DNA, 18 bp, Homo sapiens
ggagtctaacacgtgcgc

SEQ ID NO: 60117 - DNA, 31 bp, Homo sapiens; identical to SEQ ID NO: 20312

SEQ ID NO: 60118 - DNA, 18 bp, Homo sapiens
tctaacacgtgcgcgagt

SEQ ID NO: 60119 - DNA, 26 bp, Homo sapiens
tctaacacgtgcgcgagtcgggggct

SEQ ID NO: 60120 - DNA, 16 bp, Homo sapiens
ctaacacgtgcgcgag

SEQ ID NO: 60121 - DNA, 17 bp, Homo sapiens
ctaacacgtgcgcgagt

SEQ ID NO: 60122 - DNA, 25 bp, Homo sapiens
ctaacacgtgcgcgagtcgggggct

SEQ ID NO: 60123 - DNA, 27 bp, Homo sapiens
ctaacacgtgcgcgagtcgggggctcg

SEQ ID NO: 60124 - DNA, 16 bp, Homo sapiens
ggcgcgctcgccggcc

SEQ ID NO: 60125 - DNA, 32 bp, Homo sapiens; identical to SEQ ID NO: 4342

SEQ ID NO: 60126 - DNA, 33 bp, Homo sapiens; identical to SEQ ID NO: 20384

SEQ ID NO: 60127 - DNA, 32 bp, Homo sapiens; identical to SEQ ID NO: 4344

SEQ ID NO: 60128 - DNA, 30 bp, Homo sapiens; identical to SEQ ID NO: 4345

SEQ ID NO: 60129 - DNA, 31 bp, Homo sapiens; identical to SEQ ID NO: 4346

SEQ ID NO: 60130 - DNA, 34 bp, Homo sapiens; identical to SEQ ID NO: 20399

SEQ ID NO: 60131 - DNA, 38 bp, Homo sapiens; identical to SEQ ID NO: 20400

SEQ ID NO: 60132 - DNA, 32 bp, Homo sapiens; identical to SEQ ID NO: 20414

SEQ ID NO: 60133 - DNA, 34 bp, Homo sapiens
cgctcgccggccgaggtgggatcccgaggcctct

SEQ ID NO: 60134 - DNA, 27 bp, Homo sapiens
cgccggccgaggtgggatcccgaggcc

SEQ ID NO: 60135 - DNA, 19 bp, Homo sapiens
agtccgccgagggcgcacc

SEQ ID NO: 60136 - DNA, 22 bp, Homo sapiens
agtccgccgagggcgcaccacc

SEQ ID NO: 60137 - DNA, 18 bp, Homo sapiens
gtccgccgagggcgcacc

SEQ ID NO: 60138 - DNA, 21 bp, Homo sapiens
gtccgccgagggcgcaccacc

SEQ ID NO: 60139 - DNA, 25 bp, Homo sapiens
gtccgccgagggcgcaccaccggcc

SEQ ID NO: 60140 - DNA, 33 bp, Homo sapiens; identical to SEQ ID NO: 20451

SEQ ID NO: 60141 - DNA, 34 bp, Homo sapiens; identical to SEQ ID NO: 20452

SEQ ID NO: 60142 - DNA, 30 bp, Homo sapiens; identical to SEQ ID NO: 20460

SEQ ID NO: 60143 - DNA, 34 bp, Homo sapiens
cgccgagggcgcaccaccggcccgtctcgcccgc

SEQ ID NO: 60144 - DNA, 16 bp, Homo sapiens
cgcccgccgcgccggg

SEQ ID NO: 60145 - DNA, 16 bp, Homo sapiens
cccgccgcgccgggga

SEQ ID NO: 60146 - DNA, 22 bp, Homo sapiens
cccgccgcgccggggaggtgga

SEQ ID NO: 60147 - DNA, 22 bp, Homo sapiens
cgccgcgccggggaggtggagc

SEQ ID NO: 60148 - DNA, 25 bp, Homo sapiens
gagcacgagcgcacgtgttaggacc

SEQ ID NO: 60149 - DNA, 24 bp, Homo sapiens
agcacgagcgcacgtgttaggacc

SEQ ID NO: 60150 - DNA, 22 bp, Homo sapiens
cacgagcgcacgtgttaggacc

SEQ ID NO: 60151 - DNA, 21 bp, Homo sapiens
acgagcgcacgtgttaggacc

SEQ ID NO: 60152 - DNA, 28 bp, Homo sapiens
acgagcgcacgtgttaggacccgaaaga

SEQ ID NO: 60153 - DNA, 20 bp, Homo sapiens
cgagcgcacgtgttaggacc

SEQ ID NO: 60154 - DNA, 25 bp, Homo sapiens
cgagcgcacgtgttaggacccgaaa

SEQ ID NO: 60155 - DNA, 18 bp, Homo sapiens
gagcgcacgtgttaggac

SEQ ID NO: 60156 - DNA, 19 bp, Homo sapiens
gagcgcacgtgttaggacc

SEQ ID NO: 60157 - DNA, 24 bp, Homo sapiens
gagcgcacgtgttaggacccgaaa

SEQ ID NO: 60158 - DNA, 17 bp, Homo sapiens
agcgcacgtgttaggac

SEQ ID NO: 60159 - DNA, 18 bp, Homo sapiens
agcgcacgtgttaggacc

SEQ ID NO: 60160 - DNA, 21 bp, Homo sapiens
agcgcacgtgttaggacccga

SEQ ID NO: 60161 - DNA, 23 bp, Homo sapiens
agcgcacgtgttaggacccgaaa

SEQ ID NO: 60162 - DNA, 17 bp, Homo sapiens
gcgcacgtgttaggacc

SEQ ID NO: 60163 - DNA, 20 bp, Homo sapiens
gcgcacgtgttaggacccga

SEQ ID NO: 60164 - DNA, 19 bp, Homo sapiens
cgcacgtgttaggacccga

SEQ ID NO: 60165 - DNA, 27 bp, Homo sapiens
cgaaagatggtgaactatgcctgggca

SEQ ID NO: 60166 - DNA, 21 bp, Homo sapiens
atggtgaactatgcctgggca

SEQ ID NO: 60167 - DNA, 25 bp, Homo sapiens
agggcgaagccagaggaaactctgg

SEQ ID NO: 60168 - DNA, 17 bp, Homo sapiens
gtccgtagcggtcctga

SEQ ID NO: 60169 - DNA, 16 bp, Homo sapiens
cgtagcggtcctgacg

SEQ ID NO: 60170 - DNA, 16 bp, Homo sapiens
aatcggtcgtccgacc

SEQ ID NO: 60171 - DNA, 28 bp, Homo sapiens
aatcggtcgtccgacctgggtatagggg

SEQ ID NO: 60172 - DNA, 29 bp, Homo sapiens
aatcggtcgtccgacctgggtataggggc

SEQ ID NO: 60173 - DNA, 30 bp, Homo sapiens; identical to SEQ ID NO: 4444

SEQ ID NO: 60174 - DNA, 35 bp, Homo sapiens; identical to SEQ ID NO: 20859

SEQ ID NO: 60175 - DNA, 37 bp, Homo sapiens; identical to SEQ ID NO: 20861

SEQ ID NO: 60176 - DNA, 33 bp, Homo sapiens; identical to SEQ ID NO: 20889

SEQ ID NO: 60177 - DNA, 20 bp, Homo sapiens
cgtccgacctgggtataggg

SEQ ID NO: 60178 - DNA, 18 bp, Homo sapiens
ccctccgaagtttccctc

SEQ ID NO: 60179 - DNA, 40 bp, Homo sapiens
gaagtttccctcaggatagctggcgctctcgcagacccga

SEQ ID NO: 60180 - DNA, 35 bp, Homo sapiens
tttccctcaggatagctggcgctctcgcagacccg

SEQ ID NO: 60181 - DNA, 36 bp, Homo sapiens; identical to SEQ ID NO: 57748

SEQ ID NO: 60182 - DNA, 19 bp, Homo sapiens
ccctcaggatagctggcgc

SEQ ID NO: 60183 - DNA, 30 bp, Homo sapiens; identical to SEQ ID NO: 4473

SEQ ID NO: 60184 - DNA, 31 bp, Homo sapiens; identical to SEQ ID NO: 4474

SEQ ID NO: 60185 - DNA, 32 bp, Homo sapiens; identical to SEQ ID NO: 4475

SEQ ID NO: 60186 - DNA, 33 bp, Homo sapiens; identical to SEQ ID NO: 4476

SEQ ID NO: 60187 - DNA, 34 bp, Homo sapiens
ccctcaggatagctggcgctctcgcagacccgac

SEQ ID NO: 60188 - DNA, 35 bp, Homo sapiens
ccctcaggatagctggcgctctcgcagacccgacg

SEQ ID NO: 60189 - DNA, 36 bp, Homo sapiens
ccctcaggatagctggcgctctcgcagacccgacgc

SEQ ID NO: 60190 - DNA, 31 bp, Homo sapiens; identical to SEQ ID NO: 4479

SEQ ID NO: 60191 - DNA, 30 bp, Homo sapiens; identical to SEQ ID NO: 21011

SEQ ID NO: 60192 - DNA, 29 bp, Homo sapiens
caggatagctggcgctctcgcagacccga

SEQ ID NO: 60193 - DNA, 27 bp, Homo sapiens
aggatagctggcgctctcgcagacccg

SEQ ID NO: 60194 - DNA, 28 bp, Homo sapiens
aggatagctggcgctctcgcagacccga

SEQ ID NO: 60195 - DNA, 27 bp, Homo sapiens
ggatagctggcgctctcgcagacccga

SEQ ID NO: 60196 - DNA, 24 bp, Homo sapiens
atagctggcgctctcgcagacccg

SEQ ID NO: 60197 - DNA, 25 bp, Homo sapiens
atagctggcgctctcgcagacccga

SEQ ID NO: 60198 - DNA, 26 bp, Homo sapiens
atagctggcgctctcgcagacccgac

SEQ ID NO: 60199 - DNA, 27 bp, Homo sapiens
atagctggcgctctcgcagacccgacg

SEQ ID NO: 60200 - DNA, 24 bp, Homo sapiens
tagctggcgctctcgcagacccga

SEQ ID NO: 60201 - DNA, 21 bp, Homo sapiens
gctggcgctctcgcagacccg

SEQ ID NO: 60202 - DNA, 22 bp, Homo sapiens
gctggcgctctcgcagacccga

SEQ ID NO: 60203 - DNA, 23 bp, Homo sapiens
gctggcgctctcgcagacccgac

SEQ ID NO: 60204 - DNA, 21 bp, Homo sapiens
ctggcgctctcgcagacccga

SEQ ID NO: 60205 - DNA, 28 bp, Homo sapiens
cccgccacgcagttttatccggtaaagc

SEQ ID NO: 60206 - DNA, 32 bp, Homo sapiens
cccgccacgcagttttatccggtaaagcgaat

SEQ ID NO: 60207 - DNA, 43 bp, Homo sapiens; identical to SEQ ID NO: 57761

SEQ ID NO: 60208 - DNA, 23 bp, Homo sapiens
gaatgattagaggtcttggggcc

SEQ ID NO: 60209 - DNA, 21 bp, Homo sapiens
aatgattagaggtcttggggc

SEQ ID NO: 60210 - DNA, 22 bp, Homo sapiens
aatgattagaggtcttggggcc

SEQ ID NO: 60211 - DNA, 23 bp, Homo sapiens
aatgattagaggtcttggggccg

SEQ ID NO: 60212 - DNA, 18 bp, Homo sapiens
gattagaggtcttggggc

SEQ ID NO: 60213 - DNA, 19 bp, Homo sapiens
gattagaggtcttggggcc

SEQ ID NO: 60214 - DNA, 26 bp, Homo sapiens
ctgcgggatgaaccgaacgccgggtt

SEQ ID NO: 60215 - DNA, 17 bp, Homo sapiens
gggatgaaccgaacgcc

SEQ ID NO: 60216 - DNA, 16 bp, Homo sapiens
ggatgaaccgaacgcc

SEQ ID NO: 60217 - DNA, 21 bp, Homo sapiens
ggatgaaccgaacgccgggtt

SEQ ID NO: 60218 - DNA, 58 bp, Homo sapiens; identical to SEQ ID NO: 57762

SEQ ID NO: 60219 - DNA, 59 bp, Homo sapiens
caggacggtggccatggaagtcggaatccgctaaggagtgtgtaacaactcacctgccg

SEQ ID NO: 60220 - DNA, 26 bp, Homo sapiens
aatggatggcgctggagcgtcgggcc

SEQ ID NO: 60221 - DNA, 25 bp, Homo sapiens
atggatggcgctggagcgtcgggcc

SEQ ID NO: 60222 - DNA, 23 bp, Homo sapiens
ggatggcgctggagcgtcgggcc

SEQ ID NO: 60223 - DNA, 24 bp, Homo sapiens
ggatggcgctggagcgtcgggccc

SEQ ID NO: 60224 - DNA, 22 bp, Homo sapiens
gatggcgctggagcgtcgggcc

SEQ ID NO: 60225 - DNA, 23 bp, Homo sapiens
gatggcgctggagcgtcgggccc

SEQ ID NO: 60226 - DNA, 21 bp, Homo sapiens
atggcgctggagcgtcgggcc

SEQ ID NO: 60227 - DNA, 22 bp, Homo sapiens
atggcgctggagcgtcgggccc

SEQ ID NO: 60228 - DNA, 19 bp, Homo sapiens
ggcgctggagcgtcgggcc

SEQ ID NO: 60229 - DNA, 20 bp, Homo sapiens
ggcgctggagcgtcgggccc

SEQ ID NO: 60230 - DNA, 19 bp, Homo sapiens
gcgctggagcgtcgggccc

SEQ ID NO: 60231 - DNA, 26 bp, Homo sapiens
cgtcgggcccatacccggccgtcgcc

SEQ ID NO: 60232 - DNA, 25 bp, Homo sapiens
cgggcccatacccggccgtcgccgg

SEQ ID NO: 60233 - DNA, 24 bp, Homo sapiens
gggcccatacccggccgtcgccgg

SEQ ID NO: 60234 - DNA, 28 bp, Homo sapiens
gggcccatacccggccgtcgccggcagt

SEQ ID NO: 60235 - DNA, 35 bp, Homo sapiens
gggcccatacccggccgtcgccggcagtcgagagt

SEQ ID NO: 60236 - DNA, 28 bp, Homo sapiens
ccatacccggccgtcgccggcagtcgag

SEQ ID NO: 60237 - DNA, 34 bp, Homo sapiens
gagggcggcggcggcggcggcggcgggggtgtgg

SEQ ID NO: 60238 - DNA, 27 bp, Homo sapiens
gcggcggcggcggcggcgggggtgtgg

SEQ ID NO: 60239 - DNA, 24 bp, Homo sapiens
cccgcccacgccccgctccccgcc

SEQ ID NO: 60240 - DNA, 23 bp, Homo sapiens
ccgcccacgccccgctccccgcc

SEQ ID NO: 60241 - DNA, 22 bp, Homo sapiens
cgcccacgccccgctccccgcc

SEQ ID NO: 60242 - DNA, 16 bp, Homo sapiens
cgccccgctccccgcc

SEQ ID NO: 60243 - DNA, 17 bp, Homo sapiens
cgccccgctccccgccc

SEQ ID NO: 60244 - DNA, 20 bp, Homo sapiens
cgccccgctccccgcccccg

SEQ ID NO: 60245 - DNA, 21 bp, Homo sapiens
cgccccgctccccgcccccgg

SEQ ID NO: 60246 - DNA, 32 bp, Homo sapiens; identical to SEQ ID NO: 4742

SEQ ID NO: 60247 - DNA, 33 bp, Homo sapiens; identical to SEQ ID NO: 4743

SEQ ID NO: 60248 - DNA, 43 bp, Homo sapiens
gtggtagtagcaaatattcaaacgagaactttgaaggccgaag

SEQ ID NO: 60249 - DNA, 40 bp, Homo sapiens; identical to SEQ ID NO: 57767

SEQ ID NO: 60250 - DNA, 39 bp, Homo sapiens; identical to SEQ ID NO: 57768

SEQ ID NO: 60251 - DNA, 38 bp, Homo sapiens; identical to SEQ ID NO: 57769

SEQ ID NO: 60252 - DNA, 37 bp, Homo sapiens; identical to SEQ ID NO: 57770

SEQ ID NO: 60253 - DNA, 36 bp, Homo sapiens; identical to SEQ ID NO: 22266

SEQ ID NO: 60254 - DNA, 35 bp, Homo sapiens; identical to SEQ ID NO: 22269

SEQ ID NO: 60255 - DNA, 34 bp, Homo sapiens; identical to SEQ ID NO: 22271

SEQ ID NO: 60256 - DNA, 33 bp, Homo sapiens; identical to SEQ ID NO: 4745

SEQ ID NO: 60257 - DNA, 32 bp, Homo sapiens; identical to SEQ ID NO: 4746

SEQ ID NO: 60258 - DNA, 31 bp, Homo sapiens; identical to SEQ ID NO: 4748

SEQ ID NO: 60259 - DNA, 30 bp, Homo sapiens; identical to SEQ ID NO: 4751

SEQ ID NO: 60260 - DNA, 29 bp, Homo sapiens
tattcaaacgagaactttgaaggccgaag

SEQ ID NO: 60261 - DNA, 28 bp, Homo sapiens
attcaaacgagaactttgaaggccgaag

SEQ ID NO: 60262 - DNA, 27 bp, Homo sapiens
ttcaaacgagaactttgaaggccgaag

SEQ ID NO: 60263 - DNA, 26 bp, Homo sapiens
tcaaacgagaactttgaaggccgaag

SEQ ID NO: 60264 - DNA, 20 bp, Homo sapiens
caaacgagaactttgaaggc

SEQ ID NO: 60265 - DNA, 25 bp, Homo sapiens
caaacgagaactttgaaggccgaag

SEQ ID NO: 60266 - DNA, 26 bp, Homo sapiens
caaacgagaactttgaaggccgaagt

SEQ ID NO: 60267 - DNA, 16 bp, Homo sapiens
aaacgagaactttgaa

SEQ ID NO: 60268 - DNA, 19 bp, Homo sapiens
aaacgagaactttgaaggc

SEQ ID NO: 60269 - DNA, 20 bp, Homo sapiens
aaacgagaactttgaaggcc

SEQ ID NO: 60270 - DNA, 21 bp, Homo sapiens
aaacgagaactttgaaggccg

SEQ ID NO: 60271 - DNA, 22 bp, Homo sapiens
aaacgagaactttgaaggccga

SEQ ID NO: 60272 - DNA, 23 bp, Homo sapiens
aaacgagaactttgaaggccgaa

SEQ ID NO: 60273 - DNA, 24 bp, Homo sapiens
aaacgagaactttgaaggccgaag

SEQ ID NO: 60274 - DNA, 25 bp, Homo sapiens
aaacgagaactttgaaggccgaagt

SEQ ID NO: 60275 - DNA, 36 bp, Homo sapiens; identical to SEQ ID NO: 22395

SEQ ID NO: 60276 - DNA, 38 bp, Homo sapiens; identical to SEQ ID NO: 22397

SEQ ID NO: 60277 - DNA, 44 bp, Homo sapiens; identical to SEQ ID NO: 22403

SEQ ID NO: 60278 - DNA, 45 bp, Homo sapiens; identical to SEQ ID NO: 22404

SEQ ID NO: 60279 - DNA, 18 bp, Homo sapiens
aacgagaactttgaaggc

SEQ ID NO: 60280 - DNA, 19 bp, Homo sapiens
aacgagaactttgaaggcc

SEQ ID NO: 60281 - DNA, 20 bp, Homo sapiens
aacgagaactttgaaggccg

SEQ ID NO: 60282 - DNA, 21 bp, Homo sapiens
aacgagaactttgaaggccga

SEQ ID NO: 60283 - DNA, 22 bp, Homo sapiens
aacgagaactttgaaggccgaa

SEQ ID NO: 60284 - DNA, 23 bp, Homo sapiens
aacgagaactttgaaggccgaag

SEQ ID NO: 60285 - DNA, 24 bp, Homo sapiens
aacgagaactttgaaggccgaagt

SEQ ID NO: 60286 - DNA, 29 bp, Homo sapiens
aacgagaactttgaaggccgaagtggaga

SEQ ID NO: 60287 - DNA, 30 bp, Homo sapiens; identical to SEQ ID NO: 4826

SEQ ID NO: 60288 - DNA, 31 bp, Homo sapiens; identical to SEQ ID NO: 4827

SEQ ID NO: 60289 - DNA, 32 bp, Homo sapiens; identical to SEQ ID NO: 4828

SEQ ID NO: 60290 - DNA, 35 bp, Homo sapiens; identical to SEQ ID NO: 22426

SEQ ID NO: 60291 - DNA, 36 bp, Homo sapiens; identical to SEQ ID NO: 22427

SEQ ID NO: 60292 - DNA, 37 bp, Homo sapiens; identical to SEQ ID NO: 22428

SEQ ID NO: 60293 - DNA, 38 bp, Homo sapiens; identical to SEQ ID NO: 22429

SEQ ID NO: 60294 - DNA, 40 bp, Homo sapiens; identical to SEQ ID NO: 22431

SEQ ID NO: 60295 - DNA, 42 bp, Homo sapiens; identical to SEQ ID NO: 22433

SEQ ID NO: 60296 - DNA, 43 bp, Homo sapiens; identical to SEQ ID NO: 22434

SEQ ID NO: 60297 - DNA, 44 bp, Homo sapiens; identical to SEQ ID NO: 22435

SEQ ID NO: 60298 - DNA, 45 bp, Homo sapiens; identical to SEQ ID NO: 22436

SEQ ID NO: 60299 - DNA, 20 bp, Homo sapiens
acgagaactttgaaggccga

SEQ ID NO: 60300 - DNA, 21 bp, Homo sapiens
acgagaactttgaaggccgaa

SEQ ID NO: 60301 - DNA, 22 bp, Homo sapiens
acgagaactttgaaggccgaag

SEQ ID NO: 60302 - DNA, 23 bp, Homo sapiens
acgagaactttgaaggccgaagt

SEQ ID NO: 60303 - DNA, 42 bp, Homo sapiens; identical to SEQ ID NO: 22460

SEQ ID NO: 60304 - DNA, 43 bp, Homo sapiens; identical to SEQ ID NO: 22461

SEQ ID NO: 60305 - DNA, 21 bp, Homo sapiens
cgagaactttgaaggccgaag

SEQ ID NO: 60306 - DNA, 22 bp, Homo sapiens
cgagaactttgaaggccgaagt

SEQ ID NO: 60307 - DNA, 20 bp, Homo sapiens
gagaactttgaaggccgaag

SEQ ID NO: 60308 - DNA, 21 bp, Homo sapiens
gagaactttgaaggccgaagt

SEQ ID NO: 60309 - DNA, 32 bp, Homo sapiens; identical to SEQ ID NO: 4895

SEQ ID NO: 60310 - DNA, 19 bp, Homo sapiens
gtcagtcggtcctgagaga

SEQ ID NO: 60311 - DNA, 31 bp, Homo sapiens; identical to SEQ ID NO: 4899

SEQ ID NO: 60312 - DNA, 18 bp, Homo sapiens
cagtcggtcctgagagat

SEQ ID NO: 60313 - DNA, 19 bp, Homo sapiens
cagtcggtcctgagagatg

SEQ ID NO: 60314 - DNA, 20 bp, Homo sapiens
gtcggtcctgagagatgggc

SEQ ID NO: 60315 - DNA, 27 bp, Homo sapiens
gtcggtcctgagagatgggcgagcgcc

SEQ ID NO: 60316 - DNA, 17 bp, Homo sapiens
ggtcctgagagatgggc

SEQ ID NO: 60317 - DNA, 32 bp, Homo sapiens
gatgggcgagcgccgttccgaagggacgggcg

SEQ ID NO: 60318 - DNA, 35 bp, Homo sapiens
gatgggcgagcgccgttccgaagggacgggcgatg

SEQ ID NO: 60319 - DNA, 17 bp, Homo sapiens
ccctcggccgatcgaaa

SEQ ID NO: 60320 - DNA, 47 bp, Homo sapiens; identical to SEQ ID NO: 57786

SEQ ID NO: 60321 - DNA, 48 bp, Homo sapiens; identical to SEQ ID NO: 57787

SEQ ID NO: 60322 - DNA, 23 bp, Homo sapiens
aaagggagtcgggttcagatccc

SEQ ID NO: 60323 - DNA, 19 bp, Homo sapiens
ccccgaatccggagtggcg

SEQ ID NO: 60324 - DNA, 20 bp, Homo sapiens
ccccgaatccggagtggcgg

SEQ ID NO: 60325 - DNA, 21 bp, Homo sapiens
ccccgaatccggagtggcgga

SEQ ID NO: 60326 - DNA, 44 bp, Homo sapiens
gcggagatgggcgccgcgaggcgtccagtgcggtaacgcgaccg

SEQ ID NO: 60327 - DNA, 29 bp, Homo sapiens
gcgaggcgtccagtgcggtaacgcgaccg

SEQ ID NO: 60328 - DNA, 17 bp, Homo sapiens
cagtgcggtaacgcgac

SEQ ID NO: 60329 - DNA, 30 bp, Homo sapiens; identical to SEQ ID NO: 4944

SEQ ID NO: 60330 - DNA, 27 bp, Homo sapiens
gtgcggtaacgcgaccgatcccggaga

SEQ ID NO: 60331 - DNA, 28 bp, Homo sapiens
gtgcggtaacgcgaccgatcccggagaa

SEQ ID NO: 60332 - DNA, 21 bp, Homo sapiens
cccggagaagccggcgggagc

SEQ ID NO: 60333 - DNA, 22 bp, Homo sapiens
cccggagaagccggcgggagcc

SEQ ID NO: 60334 - DNA, 26 bp, Homo sapiens
cccggagaagccggcgggagccccgg

SEQ ID NO: 60335 - DNA, 29 bp, Homo sapiens
cccggagaagccggcgggagccccgggga

SEQ ID NO: 60336 - DNA, 31 bp, Homo sapiens
cccggagaagccggcgggagccccggggaga

SEQ ID NO: 60337 - DNA, 33 bp, Homo sapiens; identical to SEQ ID NO: 23020

SEQ ID NO: 60338 - DNA, 20 bp, Homo sapiens
gccggcgggagccccgggga

SEQ ID NO: 60339 - DNA, 16 bp, Homo sapiens
cggcgggagccccggg

SEQ ID NO: 60340 - DNA, 17 bp, Homo sapiens
cggcgggagccccgggg

SEQ ID NO: 60341 - DNA, 18 bp, Homo sapiens
cggcgggagccccgggga

SEQ ID NO: 60342 - DNA, 27 bp, Homo sapiens
gttcgccccgagagaggggcccgtgcc

SEQ ID NO: 60343 - DNA, 18 bp, Homo sapiens
ccccgagagaggggcccg

SEQ ID NO: 60344 - DNA, 19 bp, Homo sapiens
ccccgagagaggggcccgt

SEQ ID NO: 60345 - DNA, 23 bp, Homo sapiens
ccccgagagaggggcccgtgcct

SEQ ID NO: 60346 - DNA, 24 bp, Homo sapiens
ccccgagagaggggcccgtgcctt

SEQ ID NO: 60347 - DNA, 25 bp, Homo sapiens
ccccgagagaggggcccgtgccttg

SEQ ID NO: 60348 - DNA, 17 bp, Homo sapiens
cccgagagaggggcccg

SEQ ID NO: 60349 - DNA, 18 bp, Homo sapiens
cccgagagaggggcccgt

SEQ ID NO: 60350 - DNA, 21 bp, Homo sapiens
cccgagagaggggcccgtgcc

SEQ ID NO: 60351 - DNA, 22 bp, Homo sapiens
cccgagagaggggcccgtgcct

SEQ ID NO: 60352 - DNA, 23 bp, Homo sapiens
cccgagagaggggcccgtgcctt

SEQ ID NO: 60353 - DNA, 24 bp, Homo sapiens
cccgagagaggggcccgtgccttg

SEQ ID NO: 60354 - DNA, 37 bp, Homo sapiens
cccgagagaggggcccgtgccttggaaagcgtcgcgg

SEQ ID NO: 60355 - DNA, 17 bp, Homo sapiens
ccgagagaggggcccgt

SEQ ID NO: 60356 - DNA, 22 bp, Homo sapiens
ccgagagaggggcccgtgcctt

SEQ ID NO: 60357 - DNA, 25 bp, Homo sapiens
tgccttggaaagcgtcgcggttccg

SEQ ID NO: 60358 - DNA, 20 bp, Homo sapiens
ccttggaaagcgtcgcggtt

SEQ ID NO: 60359 - DNA, 32 bp, Homo sapiens; identical to SEQ ID NO: 5022

SEQ ID NO: 60360 - DNA, 36 bp, Homo sapiens; identical to SEQ ID NO: 23192

SEQ ID NO: 60361 - DNA, 37 bp, Homo sapiens; identical to SEQ ID NO: 23193

SEQ ID NO: 60362 - DNA, 38 bp, Homo sapiens; identical to SEQ ID NO: 23194

SEQ ID NO: 60363 - DNA, 35 bp, Homo sapiens; identical to SEQ ID NO: 23203

SEQ ID NO: 60364 - DNA, 36 bp, Homo sapiens; identical to SEQ ID NO: 23204

SEQ ID NO: 60365 - DNA, 34 bp, Homo sapiens; identical to SEQ ID NO: 23210

SEQ ID NO: 60366 - DNA, 35 bp, Homo sapiens; identical to SEQ ID NO: 23211

SEQ ID NO: 60367 - DNA, 29 bp, Homo sapiens
gttccggcggcgtccggtgagctctcgct

SEQ ID NO: 60368 - DNA, 33 bp, Homo sapiens; identical to SEQ ID NO: 5027

SEQ ID NO: 60369 - DNA, 34 bp, Homo sapiens; identical to SEQ ID NO: 23219

SEQ ID NO: 60370 - DNA, 35 bp, Homo sapiens; identical to SEQ ID NO: 23220

SEQ ID NO: 60371 - DNA, 36 bp, Homo sapiens; identical to SEQ ID NO: 23221

SEQ ID NO: 60372 - DNA, 30 bp, Homo sapiens; identical to SEQ ID NO: 5033

SEQ ID NO: 60373 - DNA, 28 bp, Homo sapiens
cggcggcgtccggtgagctctcgctggc

SEQ ID NO: 60374 - DNA, 29 bp, Homo sapiens
cggcggcgtccggtgagctctcgctggcc

SEQ ID NO: 60375 - DNA, 30 bp, Homo sapiens; identical to SEQ ID NO: 5041

SEQ ID NO: 60376 - DNA, 23 bp, Homo sapiens
ggcggcgtccggtgagctctcgc

SEQ ID NO: 60377 - DNA, 24 bp, Homo sapiens
ggcggcgtccggtgagctctcgct

SEQ ID NO: 60378 - DNA, 27 bp, Homo sapiens
ggcggcgtccggtgagctctcgctggc

SEQ ID NO: 60379 - DNA, 28 bp, Homo sapiens
ggcggcgtccggtgagctctcgctggcc

SEQ ID NO: 60380 - DNA, 29 bp, Homo sapiens
ggcggcgtccggtgagctctcgctggccc

SEQ ID NO: 60381 - DNA, 30 bp, Homo sapiens; identical to SEQ ID NO: 5051

SEQ ID NO: 60382 - DNA, 18 bp, Homo sapiens
gcggcgtccggtgagctc

SEQ ID NO: 60383 - DNA, 19 bp, Homo sapiens
gcggcgtccggtgagctct

SEQ ID NO: 60384 - DNA, 22 bp, Homo sapiens
gcggcgtccggtgagctctcgc

SEQ ID NO: 60385 - DNA, 23 bp, Homo sapiens
gcggcgtccggtgagctctcgct

SEQ ID NO: 60386 - DNA, 26 bp, Homo sapiens
gcggcgtccggtgagctctcgctggc

SEQ ID NO: 60387 - DNA, 27 bp, Homo sapiens
gcggcgtccggtgagctctcgctggcc

SEQ ID NO: 60388 - DNA, 28 bp, Homo sapiens
gcggcgtccggtgagctctcgctggccc

SEQ ID NO: 60389 - DNA, 22 bp, Homo sapiens
cggcgtccggtgagctctcgct

SEQ ID NO: 60390 - DNA, 25 bp, Homo sapiens
cggcgtccggtgagctctcgctggc

SEQ ID NO: 60391 - DNA, 26 bp, Homo sapiens
cggcgtccggtgagctctcgctggcc

SEQ ID NO: 60392 - DNA, 27 bp, Homo sapiens
cggcgtccggtgagctctcgctggccc

SEQ ID NO: 60393 - DNA, 22 bp, Homo sapiens
gtccggtgagctctcgctggcc

SEQ ID NO: 60394 - DNA, 16 bp, Homo sapiens
tccggtgagctctcgc

SEQ ID NO: 60395 - DNA, 21 bp, Homo sapiens
tccggtgagctctcgctggcc

SEQ ID NO: 60396 - DNA, 22 bp, Homo sapiens
tccggtgagctctcgctggccc

SEQ ID NO: 60397 - DNA, 19 bp, Homo sapiens
ccggtgagctctcgctggc

SEQ ID NO: 60398 - DNA, 20 bp, Homo sapiens
ccggtgagctctcgctggcc

SEQ ID NO: 60399 - DNA, 21 bp, Homo sapiens
ccggtgagctctcgctggccc

SEQ ID NO: 60400 - DNA, 18 bp, Homo sapiens
cggtgagctctcgctggc

SEQ ID NO: 60401 - DNA, 19 bp, Homo sapiens
cggtgagctctcgctggcc

SEQ ID NO: 60402 - DNA, 20 bp, Homo sapiens
cggtgagctctcgctggccc

SEQ ID NO: 60403 - DNA, 17 bp, Homo sapiens
ggtgagctctcgctggc

SEQ ID NO: 60404 - DNA, 18 bp, Homo sapiens
ggtgagctctcgctggcc

SEQ ID NO: 60405 - DNA, 19 bp, Homo sapiens
ggtgagctctcgctggccc

SEQ ID NO: 60406 - DNA, 20 bp, Homo sapiens
ggtgagctctcgctggccct

SEQ ID NO: 60407 - DNA, 18 bp, Homo sapiens
gtgagctctcgctggccc

SEQ ID NO: 60408 - DNA, 21 bp, Homo sapiens
aatctcgcgccgggccgtacc

SEQ ID NO: 60409 - DNA, 17 bp, Homo sapiens
tcgcgccgggccgtacc

SEQ ID NO: 60410 - DNA, 20 bp, Homo sapiens
agcctctggcatgttggaac

SEQ ID NO: 60411 - DNA, 18 bp, Homo sapiens
atgtaggtaagggaagtc

SEQ ID NO: 60412 - DNA, 22 bp, Homo sapiens
atgtaggtaagggaagtcggca

SEQ ID NO: 60413 - DNA, 32 bp, Homo sapiens; identical to SEQ ID NO: 5183

SEQ ID NO: 60414 - DNA, 28 bp, Homo sapiens
ccgtaacttcgggataaggattggctct

SEQ ID NO: 60415 - DNA, 26 bp, Homo sapiens
cgtaacttcgggataaggattggctc

SEQ ID NO: 60416 - DNA, 27 bp, Homo sapiens
cgtaacttcgggataaggattggctct

SEQ ID NO: 60417 - DNA, 46 bp, Homo sapiens; identical to SEQ ID NO: 23884

SEQ ID NO: 60418 - DNA, 44 bp, Homo sapiens
ggctctaagggctgggtcggtcgggctggggcgcgaagcggggc

SEQ ID NO: 60419 - DNA, 45 bp, Homo sapiens; identical to SEQ ID NO: 23890

SEQ ID NO: 60420 - DNA, 42 bp, Homo sapiens
gctctaagggctgggtcggtcgggctggggcgcgaagcgggg

SEQ ID NO: 60421 - DNA, 43 bp, Homo sapiens
gctctaagggctgggtcggtcgggctggggcgcgaagcggggc

SEQ ID NO: 60422 - DNA, 44 bp, Homo sapiens
gctctaagggctgggtcggtcgggctggggcgcgaagcggggct

SEQ ID NO: 60423 - DNA, 41 bp, Homo sapiens
tctaagggctgggtcggtcgggctggggcgcgaagcggggc

SEQ ID NO: 60424 - DNA, 41 bp, Homo sapiens; identical to SEQ ID NO: 23891

SEQ ID NO: 60425 - DNA, 21 bp, Homo sapiens
aagggctgggtcggtcgggct

SEQ ID NO: 60426 - DNA, 24 bp, Homo sapiens
aagggctgggtcggtcgggctggg

SEQ ID NO: 60427 - DNA, 39 bp, Homo sapiens; identical to SEQ ID NO: 23904

SEQ ID NO: 60428 - DNA, 25 bp, Homo sapiens
agggctgggtcggtcgggctggggc

SEQ ID NO: 60429 - DNA, 26 bp, Homo sapiens
agggctgggtcggtcgggctggggcg

SEQ ID NO: 60430 - DNA, 28 bp, Homo sapiens
agggctgggtcggtcgggctggggcgcg

SEQ ID NO: 60431 - DNA, 38 bp, Homo sapiens; identical to SEQ ID NO: 23915

SEQ ID NO: 60432 - DNA, 18 bp, Homo sapiens
ggctgggtcggtcgggct

SEQ ID NO: 60433 - DNA, 36 bp, Homo sapiens; identical to SEQ ID NO: 23923

SEQ ID NO: 60434 - DNA, 34 bp, Homo sapiens
gctgggtcggtcgggctggggcgcgaagcggggc

SEQ ID NO: 60435 - DNA, 35 bp, Homo sapiens; identical to SEQ ID NO: 23925

SEQ ID NO: 60436 - DNA, 29 bp, Homo sapiens
gtcggtcgggctggggcgcgaagcggggc

SEQ ID NO: 60437 - DNA, 30 bp, Homo sapiens; identical to SEQ ID NO: 5227

SEQ ID NO: 60438 - DNA, 25 bp, Homo sapiens
cggtcgggctggggcgcgaagcggg

SEQ ID NO: 60439 - DNA, 26 bp, Homo sapiens
cggtcgggctggggcgcgaagcgggg

SEQ ID NO: 60440 - DNA, 27 bp, Homo sapiens
cggtcgggctggggcgcgaagcggggc

SEQ ID NO: 60441 - DNA, 28 bp, Homo sapiens
cggtcgggctggggcgcgaagcggggct

SEQ ID NO: 60442 - DNA, 42 bp, Homo sapiens; identical to SEQ ID NO: 57829

SEQ ID NO: 60443 - DNA, 37 bp, Homo sapiens
ctgggcgcgcgccgcggctggacgaggcgccgccgcc

SEQ ID NO: 60444 - DNA, 16 bp, Homo sapiens
gggcgcgcgccgcggc

SEQ ID NO: 60445 - DNA, 17 bp, Homo sapiens
gggcgcgcgccgcggct

SEQ ID NO: 60446 - DNA, 18 bp, Homo sapiens
gggcgcgcgccgcggctg

SEQ ID NO: 60447 - DNA, 21 bp, Homo sapiens
gggcgcgcgccgcggctggac

SEQ ID NO: 60448 - DNA, 22 bp, Homo sapiens
gggcgcgcgccgcggctggacg

SEQ ID NO: 60449 - DNA, 24 bp, Homo sapiens
gggcgcgcgccgcggctggacgag

SEQ ID NO: 60450 - DNA, 25 bp, Homo sapiens
gggcgcgcgccgcggctggacgagg

SEQ ID NO: 60451 - DNA, 26 bp, Homo sapiens
gggcgcgcgccgcggctggacgaggc

SEQ ID NO: 60452 - DNA, 27 bp, Homo sapiens
gggcgcgcgccgcggctggacgaggcg

SEQ ID NO: 60453 - DNA, 29 bp, Homo sapiens
gggcgcgcgccgcggctggacgaggcgcc

SEQ ID NO: 60454 - DNA, 30 bp, Homo sapiens; identical to SEQ ID NO: 23994

SEQ ID NO: 60455 - DNA, 31 bp, Homo sapiens
gggcgcgcgccgcggctggacgaggcgccgc

SEQ ID NO: 60456 - DNA, 32 bp, Homo sapiens
gggcgcgcgccgcggctggacgaggcgccgcc

SEQ ID NO: 60457 - DNA, 20 bp, Homo sapiens
ggcgcgcgccgcggctggac

SEQ ID NO: 60458 - DNA, 30 bp, Homo sapiens
ggcgcgcgccgcggctggacgaggcgccgc

SEQ ID NO: 60459 - DNA, 28 bp, Homo sapiens
gcgcgcgccgcggctggacgaggcgccg

SEQ ID NO: 60460 - DNA, 34 bp, Homo sapiens
cgcgcgccgcggctggacgaggcgccgccgcccc

SEQ ID NO: 60461 - DNA, 30 bp, Homo sapiens; identical to SEQ ID NO: 24004

SEQ ID NO: 60462 - DNA, 19 bp, Homo sapiens
cgcggctggacgaggcgcc

SEQ ID NO: 60463 - DNA, 20 bp, Homo sapiens
cgcggctggacgaggcgccg

SEQ ID NO: 60464 - DNA, 21 bp, Homo sapiens
cgcggctggacgaggcgccgc

SEQ ID NO: 60465 - DNA, 22 bp, Homo sapiens
cgcggctggacgaggcgccgcc

SEQ ID NO: 60466 - DNA, 23 bp, Homo sapiens
cgcggctggacgaggcgccgccg

SEQ ID NO: 60467 - DNA, 24 bp, Homo sapiens
cgcggctggacgaggcgccgccgc

SEQ ID NO: 60468 - DNA, 25 bp, Homo sapiens
cgcggctggacgaggcgccgccgcc

SEQ ID NO: 60469 - DNA, 29 bp, Homo sapiens
cgcggctggacgaggcgccgccgcccccc

SEQ ID NO: 60470 - DNA, 30 bp, Homo sapiens; identical to SEQ ID NO: 57838

SEQ ID NO: 60471 - DNA, 31 bp, Homo sapiens; identical to SEQ ID NO: 57839

SEQ ID NO: 60472 - DNA, 40 bp, Homo sapiens; identical to SEQ ID NO: 57840

SEQ ID NO: 60473 - DNA, 41 bp, Homo sapiens; identical to SEQ ID NO: 57841

SEQ ID NO: 60474 - DNA, 23 bp, Homo sapiens
cggctggacgaggcgccgccgcc

SEQ ID NO: 60475 - DNA, 38 bp, Homo sapiens
cggctggacgaggcgccgccgccccccccacgcccggg

SEQ ID NO: 60476 - DNA, 39 bp, Homo sapiens
cggctggacgaggcgccgccgccccccccacgcccgggg

SEQ ID NO: 60477 - DNA, 21 bp, Homo sapiens
gctggacgaggcgccgccgcc

SEQ ID NO: 60478 - DNA, 22 bp, Homo sapiens
gctggacgaggcgccgccgccc

SEQ ID NO: 60479 - DNA, 23 bp, Homo sapiens
gctggacgaggcgccgccgcccc

SEQ ID NO: 60480 - DNA, 24 bp, Homo sapiens
gctggacgaggcgccgccgccccc

SEQ ID NO: 60481 - DNA, 25 bp, Homo sapiens
gctggacgaggcgccgccgcccccc

SEQ ID NO: 60482 - DNA, 26 bp, Homo sapiens
gctggacgaggcgccgccgccccccc

SEQ ID NO: 60483 - DNA, 27 bp, Homo sapiens
gctggacgaggcgccgccgcccccccc

SEQ ID NO: 60484 - DNA, 32 bp, Homo sapiens
gctggacgaggcgccgccgccccccccacgcc

SEQ ID NO: 60485 - DNA, 34 bp, Homo sapiens
gctggacgaggcgccgccgccccccccacgcccg

SEQ ID NO: 60486 - DNA, 37 bp, Homo sapiens
gctggacgaggcgccgccgccccccccacgcccgggg

SEQ ID NO: 60487 - DNA, 38 bp, Homo sapiens
gctggacgaggcgccgccgccccccccacgcccggggc

SEQ ID NO: 60488 - DNA, 39 bp, Homo sapiens
gctggacgaggcgccgccgccccccccacgcccggggca

SEQ ID NO: 60489 - DNA, 20 bp, Homo sapiens
ctggacgaggcgccgccgcc

SEQ ID NO: 60490 - DNA, 36 bp, Homo sapiens; identical to SEQ ID NO: 57843

SEQ ID NO: 60491 - DNA, 37 bp, Homo sapiens
ctggacgaggcgccgccgccccccccacgcccggggc

SEQ ID NO: 60492 - DNA, 18 bp, Homo sapiens
ggacgaggcgccgccgcc

SEQ ID NO: 60493 - DNA, 29 bp, Homo sapiens
aggcgccgccgccccccccacgcccgggg

SEQ ID NO: 60494 - DNA, 28 bp, Homo sapiens
gcgccgccgccccccccacgcccggggc

SEQ ID NO: 60495 - DNA, 25 bp, Homo sapiens
cgccgccgccccccccacgcccggg

SEQ ID NO: 60496 - DNA, 26 bp, Homo sapiens
cgccgccgccccccccacgcccgggg

SEQ ID NO: 60497 - DNA, 22 bp, Homo sapiens
cgccgccccccccacgcccggg

SEQ ID NO: 60498 - DNA, 23 bp, Homo sapiens
cgccgccccccccacgcccgggg

SEQ ID NO: 60499 - DNA, 19 bp, Homo sapiens
cgccccccccacgcccggg

SEQ ID NO: 60500 - DNA, 21 bp, Homo sapiens
cggggcacccccctcgcggcc

SEQ ID NO: 60501 - DNA, 24 bp, Homo sapiens
cccccctcgcggccctcccccgcc

SEQ ID NO: 60502 - DNA, 23 bp, Homo sapiens
ccccctcgcggccctcccccgcc

SEQ ID NO: 60503 - DNA, 31 bp, Homo sapiens; identical to SEQ ID NO: 24055

SEQ ID NO: 60504 - DNA, 33 bp, Homo sapiens; identical to SEQ ID NO: 24056

SEQ ID NO: 60505 - DNA, 32 bp, Homo sapiens; identical to SEQ ID NO: 24058

SEQ ID NO: 60506 - DNA, 30 bp, Homo sapiens
cccccgccccaccccgcgcgcgccgctcgc

SEQ ID NO: 60507 - DNA, 31 bp, Homo sapiens
cccccgccccaccccgcgcgcgccgctcgct

SEQ ID NO: 60508 - DNA, 25 bp, Homo sapiens
ccccgccccaccccgcgcgcgccgc

SEQ ID NO: 60509 - DNA, 29 bp, Homo sapiens
ccccgccccaccccgcgcgcgccgctcgc

SEQ ID NO: 60510 - DNA, 22 bp, Homo sapiens
cccgccccaccccgcgcgcgcc

SEQ ID NO: 60511 - DNA, 23 bp, Homo sapiens
cccgccccaccccgcgcgcgccg

SEQ ID NO: 60512 - DNA, 24 bp, Homo sapiens
cccgccccaccccgcgcgcgccgc

SEQ ID NO: 60513 - DNA, 25 bp, Homo sapiens
cccgccccaccccgcgcgcgccgct

SEQ ID NO: 60514 - DNA, 28 bp, Homo sapiens
cccgccccaccccgcgcgcgccgctcgc

SEQ ID NO: 60515 - DNA, 22 bp, Homo sapiens
ccgccccaccccgcgcgcgccg

SEQ ID NO: 60516 - DNA, 23 bp, Homo sapiens
ccgccccaccccgcgcgcgccgc

SEQ ID NO: 60517 - DNA, 24 bp, Homo sapiens
ccgccccaccccgcgcgcgccgct

SEQ ID NO: 60518 - DNA, 28 bp, Homo sapiens
ccgccccaccccgcgcgcgccgctcgct

SEQ ID NO: 60519 - DNA, 20 bp, Homo sapiens
cgccccaccccgcgcgcgcc

SEQ ID NO: 60520 - DNA, 21 bp, Homo sapiens
cgccccaccccgcgcgcgccg

SEQ ID NO: 60521 - DNA, 22 bp, Homo sapiens
cgccccaccccgcgcgcgccgc

SEQ ID NO: 60522 - DNA, 23 bp, Homo sapiens
cgccccaccccgcgcgcgccgct

SEQ ID NO: 60523 - DNA, 26 bp, Homo sapiens
cgccccaccccgcgcgcgccgctcgc

SEQ ID NO: 60524 - DNA, 27 bp, Homo sapiens
cgccccaccccgcgcgcgccgctcgct

SEQ ID NO: 60525 - DNA, 19 bp, Homo sapiens
ccccgcgcgcgccgctcgc

SEQ ID NO: 60526 - DNA, 25 bp, Homo sapiens
ctctctctctcccccgctccccgtc

SEQ ID NO: 60527 - DNA, 27 bp, Homo sapiens
ctctctctctcccccgctccccgtcct

SEQ ID NO: 60528 - DNA, 29 bp, Homo sapiens
ctctctctctcccccgctccccgtcctcc

SEQ ID NO: 60529 - DNA, 24 bp, Homo sapiens
cccccgctccccgtcctcccccct

SEQ ID NO: 60530 - DNA, 22 bp, Homo sapiens
cccgctccccgtcctcccccct

SEQ ID NO: 60531 - DNA, 19 bp, Homo sapiens
gctccccgtcctcccccct

SEQ ID NO: 60532 - DNA, 18 bp, Homo sapiens
ccccgggggagcgccgcg

SEQ ID NO: 60533 - DNA, 17 bp, Homo sapiens
cccgggggagcgccgcg

SEQ ID NO: 60534 - DNA, 28 bp, Homo sapiens
cccgggggagcgccgcgtgggggcggcg

SEQ ID NO: 60535 - DNA, 30 bp, Homo sapiens
cccgggggagcgccgcgtgggggcggcggc

SEQ ID NO: 60536 - DNA, 39 bp, Homo sapiens
cgcgtgggggcggcggcggggggagaagggtcggggcgg

SEQ ID NO: 60537 - DNA, 40 bp, Homo sapiens; identical to SEQ ID NO: 57857

SEQ ID NO: 60538 - DNA, 16 bp, Homo sapiens
aggggccggcggcggc

SEQ ID NO: 60539 - DNA, 28 bp, Homo sapiens
ggggccggcggcggcccgccgcggggcc

SEQ ID NO: 60540 - DNA, 22 bp, Homo sapiens
cggcggcggcccgccgcggggc

SEQ ID NO: 60541 - DNA, 21 bp, Homo sapiens
ggcggcggcccgccgcggggc

SEQ ID NO: 60542 - DNA, 21 bp, Homo sapiens
gcggcggcccgccgcggggcc

SEQ ID NO: 60543 - DNA, 19 bp, Homo sapiens
cggcggcccgccgcggggc

SEQ ID NO: 60544 - DNA, 18 bp, Homo sapiens
ggcggcccgccgcggggc

SEQ ID NO: 60545 - DNA, 16 bp, Homo sapiens
cggcccgccgcggggc

SEQ ID NO: 60546 - DNA, 17 bp, Homo sapiens
cggcccgccgcggggcc

SEQ ID NO: 60547 - DNA, 17 bp, Homo sapiens
cccgccgcggggccccg

SEQ ID NO: 60548 - DNA, 28 bp, Homo sapiens
cccgccgcggggccccggcggcgggggc

SEQ ID NO: 60549 - DNA, 19 bp, Homo sapiens
cccggcggcgggggcacgg

SEQ ID NO: 60550 - DNA, 26 bp, Homo sapiens
cggcggcgggggcacggtcccccgcg

SEQ ID NO: 60551 - DNA, 34 bp, Homo sapiens
cggcggcgggggcacggtcccccgcgaggggggc

SEQ ID NO: 60552 - DNA, 35 bp, Homo sapiens
cggcggcgggggcacggtcccccgcgaggggggcc

SEQ ID NO: 60553 - DNA, 36 bp, Homo sapiens
cggcggcgggggcacggtcccccgcgaggggggccc

SEQ ID NO: 60554 - DNA, 37 bp, Homo sapiens
cggcggcgggggcacggtcccccgcgaggggggcccg

SEQ ID NO: 60555 - DNA, 41 bp, Homo sapiens
cggcggcgggggcacggtcccccgcgaggggggcccgggca

SEQ ID NO: 60556 - DNA, 42 bp, Homo sapiens; identical to SEQ ID NO: 57862

SEQ ID NO: 60557 - DNA, 33 bp, Homo sapiens; identical to SEQ ID NO: 24109

SEQ ID NO: 60558 - DNA, 34 bp, Homo sapiens
ggcggcgggggcacggtcccccgcgaggggggcc

SEQ ID NO: 60559 - DNA, 36 bp, Homo sapiens
ggcggcgggggcacggtcccccgcgaggggggcccg

SEQ ID NO: 60560 - DNA, 30 bp, Homo sapiens; identical to SEQ ID NO: 24111

SEQ ID NO: 60561 - DNA, 30 bp, Homo sapiens; identical to SEQ ID NO: 24113

SEQ ID NO: 60562 - DNA, 29 bp, Homo sapiens
gcacggtcccccgcgaggggggcccgggc

SEQ ID NO: 60563 - DNA, 27 bp, Homo sapiens
acggtcccccgcgaggggggcccgggc

SEQ ID NO: 60564 - DNA, 26 bp, Homo sapiens
cggtcccccgcgaggggggcccgggc

SEQ ID NO: 60565 - DNA, 27 bp, Homo sapiens
cggtcccccgcgaggggggcccgggca

SEQ ID NO: 60566 - DNA, 23 bp, Homo sapiens
tcccccgcgaggggggcccgggc

SEQ ID NO: 60567 - DNA, 20 bp, Homo sapiens
cccccgcgaggggggcccgg

SEQ ID NO: 60568 - DNA, 21 bp, Homo sapiens
cccccgcgaggggggcccggg

SEQ ID NO: 60569 - DNA, 22 bp, Homo sapiens
cccccgcgaggggggcccgggc

SEQ ID NO: 60570 - DNA, 23 bp, Homo sapiens
cccccgcgaggggggcccgggca

SEQ ID NO: 60571 - DNA, 24 bp, Homo sapiens
cccccgcgaggggggcccgggcac

SEQ ID NO: 60572 - DNA, 25 bp, Homo sapiens
cccccgcgaggggggcccgggcacc

SEQ ID NO: 60573 - DNA, 16 bp, Homo sapiens
ccccgcgaggggggcc

SEQ ID NO: 60574 - DNA, 18 bp, Homo sapiens
ccccgcgaggggggcccg

SEQ ID NO: 60575 - DNA, 19 bp, Homo sapiens
ccccgcgaggggggcccgg

SEQ ID NO: 60576 - DNA, 20 bp, Homo sapiens
ccccgcgaggggggcccggg

SEQ ID NO: 60577 - DNA, 21 bp, Homo sapiens
ccccgcgaggggggcccgggc

SEQ ID NO: 60578 - DNA, 22 bp, Homo sapiens
ccccgcgaggggggcccgggca

SEQ ID NO: 60579 - DNA, 23 bp, Homo sapiens
ccccgcgaggggggcccgggcac

SEQ ID NO: 60580 - DNA, 24 bp, Homo sapiens
ccccgcgaggggggcccgggcacc

SEQ ID NO: 60581 - DNA, 16 bp, Homo sapiens
cccgcgaggggggccc

SEQ ID NO: 60582 - DNA, 17 bp, Homo sapiens
cccgcgaggggggcccg

SEQ ID NO: 60583 - DNA, 18 bp, Homo sapiens
cccgcgaggggggcccgg

SEQ ID NO: 60584 - DNA, 19 bp, Homo sapiens
cccgcgaggggggcccggg

SEQ ID NO: 60585 - DNA, 20 bp, Homo sapiens
cccgcgaggggggcccgggc

SEQ ID NO: 60586 - DNA, 21 bp, Homo sapiens
cccgcgaggggggcccgggca

SEQ ID NO: 60587 - DNA, 22 bp, Homo sapiens
cccgcgaggggggcccgggcac

SEQ ID NO: 60588 - DNA, 23 bp, Homo sapiens
cccgcgaggggggcccgggcacc

SEQ ID NO: 60589 - DNA, 24 bp, Homo sapiens
cccgcgaggggggcccgggcaccc

SEQ ID NO: 60590 - DNA, 25 bp, Homo sapiens
cccgcgaggggggcccgggcacccg

SEQ ID NO: 60591 - DNA, 28 bp, Homo sapiens
cccgcgaggggggcccgggcacccgggg

SEQ ID NO: 60592 - DNA, 29 bp, Homo sapiens
cccgcgaggggggcccgggcacccggggg

SEQ ID NO: 60593 - DNA, 30 bp, Homo sapiens
cccgcgaggggggcccgggcacccgggggg

SEQ ID NO: 60594 - DNA, 31 bp, Homo sapiens; identical to SEQ ID NO: 57888

SEQ ID NO: 60595 - DNA, 32 bp, Homo sapiens
cccgcgaggggggcccgggcacccggggggcc

SEQ ID NO: 60596 - DNA, 42 bp, Homo sapiens
cccgcgaggggggcccgggcacccggggggccggcggcggcg

SEQ ID NO: 60597 - DNA, 44 bp, Homo sapiens
cccgcgaggggggcccgggcacccggggggccggcggcggcggc

SEQ ID NO: 60598 - DNA, 18 bp, Homo sapiens
ccgcgaggggggcccggg

SEQ ID NO: 60599 - DNA, 19 bp, Homo sapiens
ccgcgaggggggcccgggc

SEQ ID NO: 60600 - DNA, 20 bp, Homo sapiens
ccgcgaggggggcccgggca

SEQ ID NO: 60601 - DNA, 21 bp, Homo sapiens
ccgcgaggggggcccgggcac

SEQ ID NO: 60602 - DNA, 22 bp, Homo sapiens
ccgcgaggggggcccgggcacc

SEQ ID NO: 60603 - DNA, 23 bp, Homo sapiens
ccgcgaggggggcccgggcaccc

SEQ ID NO: 60604 - DNA, 17 bp, Homo sapiens
cgcgaggggggcccggg

SEQ ID NO: 60605 - DNA, 18 bp, Homo sapiens
cgcgaggggggcccgggc

SEQ ID NO: 60606 - DNA, 19 bp, Homo sapiens
cgcgaggggggcccgggca

SEQ ID NO: 60607 - DNA, 20 bp, Homo sapiens
cgcgaggggggcccgggcac

SEQ ID NO: 60608 - DNA, 17 bp, Homo sapiens
gcgaggggggcccgggc

SEQ ID NO: 60609 - DNA, 16 bp, Homo sapiens
cgaggggggcccgggc

SEQ ID NO: 60610 - DNA, 29 bp, Homo sapiens
ggcacccggggggccggcggcggcggcga

SEQ ID NO: 60611 - DNA, 30 bp, Homo sapiens; identical to SEQ ID NO: 50317

SEQ ID NO: 60612 - DNA, 31 bp, Homo sapiens
ggcacccggggggccggcggcggcggcgact

SEQ ID NO: 60613 - DNA, 32 bp, Homo sapiens; identical to SEQ ID NO: 24162

SEQ ID NO: 60614 - DNA, 33 bp, Homo sapiens
ggcacccggggggccggcggcggcggcgactct

SEQ ID NO: 60615 - DNA, 34 bp, Homo sapiens
ggcacccggggggccggcggcggcggcgactctg

SEQ ID NO: 60616 - DNA, 35 bp, Homo sapiens
ggcacccggggggccggcggcggcggcgactctgg

SEQ ID NO: 60617 - DNA, 36 bp, Homo sapiens
ggcacccggggggccggcggcggcggcgactctgga

SEQ ID NO: 60618 - DNA, 37 bp, Homo sapiens
ggcacccggggggccggcggcggcggcgactctggac

SEQ ID NO: 60619 - DNA, 38 bp, Homo sapiens
ggcacccggggggccggcggcggcggcgactctggacg

SEQ ID NO: 60620 - DNA, 39 bp, Homo sapiens
ggcacccggggggccggcggcggcggcgactctggacgc

SEQ ID NO: 60621 - DNA, 40 bp, Homo sapiens
ggcacccggggggccggcggcggcggcgactctggacgcg

SEQ ID NO: 60622 - DNA, 41 bp, Homo sapiens
ggcacccggggggccggcggcggcggcgactctggacgcga

SEQ ID NO: 60623 - DNA, 42 bp, Homo sapiens
ggcacccggggggccggcggcggcggcgactctggacgcgag

SEQ ID NO: 60624 - DNA, 43 bp, Homo sapiens
ggcacccggggggccggcggcggcggcgactctggacgcgagc

SEQ ID NO: 60625 - DNA, 46 bp, Homo sapiens
ggcacccggggggccggcggcggcggcgactctggacgcgagccgg

SEQ ID NO: 60626 - DNA, 47 bp, Homo sapiens
ggcacccggggggccggcggcggcggcgactctggacgcgagccggg

SEQ ID NO: 60627 - DNA, 32 bp, Homo sapiens
gcacccggggggccggcggcggcggcgactct

SEQ ID NO: 60628 - DNA, 35 bp, Homo sapiens
gcacccggggggccggcggcggcggcgactctgga

SEQ ID NO: 60629 - DNA, 39 bp, Homo sapiens
gcacccggggggccggcggcggcggcgactctggacgcg

SEQ ID NO: 60630 - DNA, 41 bp, Homo sapiens
gcacccggggggccggcggcggcggcgactctggacgcgag

SEQ ID NO: 60631 - DNA, 42 bp, Homo sapiens
gcacccggggggccggcggcggcggcgactctggacgcgagc

SEQ ID NO: 60632 - DNA, 43 bp, Homo sapiens
gcacccggggggccggcggcggcggcgactctggacgcgagcc

SEQ ID NO: 60633 - DNA, 38 bp, Homo sapiens; identical to SEQ ID NO: 24172

SEQ ID NO: 60634 - DNA, 39 bp, Homo sapiens
cccggggggccggcggcggcggcgactctggacgcgagc

SEQ ID NO: 60635 - DNA, 40 bp, Homo sapiens
cccggggggccggcggcggcggcgactctggacgcgagcc

SEQ ID NO: 60636 - DNA, 36 bp, Homo sapiens
cggggggccggcggcggcggcgactctggacgcgag

SEQ ID NO: 60637 - DNA, 37 bp, Homo sapiens
cggggggccggcggcggcggcgactctggacgcgagc

SEQ ID NO: 60638 - DNA, 44 bp, Homo sapiens; identical to SEQ ID NO: 57898

SEQ ID NO: 60639 - DNA, 45 bp, Homo sapiens
cggggggccggcggcggcggcgactctggacgcgagccgggccct

SEQ ID NO: 60640 - DNA, 35 bp, Homo sapiens; identical to SEQ ID NO: 57899

SEQ ID NO: 60641 - DNA, 37 bp, Homo sapiens; identical to SEQ ID NO: 24200

SEQ ID NO: 60642 - DNA, 38 bp, Homo sapiens
ccggcggcggcggcgactctggacgcgagccgggccct

SEQ ID NO: 60643 - DNA, 22 bp, Homo sapiens
cggcggcggcggcgactctgga

SEQ ID NO: 60644 - DNA, 25 bp, Homo sapiens
cggcggcggcggcgactctggacgc

SEQ ID NO: 60645 - DNA, 26 bp, Homo sapiens
cggcggcggcggcgactctggacgcg

SEQ ID NO: 60646 - DNA, 27 bp, Homo sapiens
cggcggcggcggcgactctggacgcga

SEQ ID NO: 60647 - DNA, 28 bp, Homo sapiens
cggcggcggcggcgactctggacgcgag

SEQ ID NO: 60648 - DNA, 29 bp, Homo sapiens
cggcggcggcggcgactctggacgcgagc

SEQ ID NO: 60649 - DNA, 30 bp, Homo sapiens; identical to SEQ ID NO: 30385

SEQ ID NO: 60650 - DNA, 31 bp, Homo sapiens; identical to SEQ ID NO: 57907

SEQ ID NO: 60651 - DNA, 33 bp, Homo sapiens; identical to SEQ ID NO: 24202

SEQ ID NO: 60652 - DNA, 34 bp, Homo sapiens; identical to SEQ ID NO: 57909

SEQ ID NO: 60653 - DNA, 35 bp, Homo sapiens; identical to SEQ ID NO: 57910

SEQ ID NO: 60654 - DNA, 36 bp, Homo sapiens; identical to SEQ ID NO: 57911

SEQ ID NO: 60655 - DNA, 37 bp, Homo sapiens; identical to SEQ ID NO: 57912

SEQ ID NO: 60656 - DNA, 24 bp, Homo sapiens
ggcggcggcggcgactctggacgc

SEQ ID NO: 60657 - DNA, 25 bp, Homo sapiens
ggcggcggcggcgactctggacgcg

SEQ ID NO: 60658 - DNA, 26 bp, Homo sapiens
ggcggcggcggcgactctggacgcga

SEQ ID NO: 60659 - DNA, 28 bp, Homo sapiens
ggcggcggcggcgactctggacgcgagc

SEQ ID NO: 60660 - DNA, 32 bp, Homo sapiens; identical to SEQ ID NO: 24206

SEQ ID NO: 60661 - DNA, 33 bp, Homo sapiens; identical to SEQ ID NO: 24207

SEQ ID NO: 60662 - DNA, 34 bp, Homo sapiens; identical to SEQ ID NO: 57919

SEQ ID NO: 60663 - DNA, 35 bp, Homo sapiens; identical to SEQ ID NO: 57920

SEQ ID NO: 60664 - DNA, 36 bp, Homo sapiens; identical to SEQ ID NO: 57921

SEQ ID NO: 60665 - DNA, 27 bp, Homo sapiens
gcggcggcggcgactctggacgcgagc

SEQ ID NO: 60666 - DNA, 28 bp, Homo sapiens
gcggcggcggcgactctggacgcgagcc

SEQ ID NO: 60667 - DNA, 29 bp, Homo sapiens
gcggcggcggcgactctggacgcgagccg

SEQ ID NO: 60668 - DNA, 31 bp, Homo sapiens; identical to SEQ ID NO: 24212

SEQ ID NO: 60669 - DNA, 32 bp, Homo sapiens; identical to SEQ ID NO: 24213

SEQ ID NO: 60670 - DNA, 33 bp, Homo sapiens; identical to SEQ ID NO: 5252

SEQ ID NO: 60671 - DNA, 34 bp, Homo sapiens; identical to SEQ ID NO: 24215

SEQ ID NO: 60672 - DNA, 35 bp, Homo sapiens; identical to SEQ ID NO: 24216

SEQ ID NO: 60673 - DNA, 36 bp, Homo sapiens; identical to SEQ ID NO: 57925

SEQ ID NO: 60674 - DNA, 37 bp, Homo sapiens
gcggcggcggcgactctggacgcgagccgggcccttc

SEQ ID NO: 60675 - DNA, 44 bp, Homo sapiens
gcggcggcggcgactctggacgcgagccgggcccttcccgtgga

SEQ ID NO: 60676 - DNA, 45 bp, Homo sapiens; identical to SEQ ID NO: 24217

SEQ ID NO: 60677 - DNA, 22 bp, Homo sapiens
cggcggcggcgactctggacgc

SEQ ID NO: 60678 - DNA, 23 bp, Homo sapiens
cggcggcggcgactctggacgcg

SEQ ID NO: 60679 - DNA, 24 bp, Homo sapiens
cggcggcggcgactctggacgcga

SEQ ID NO: 60680 - DNA, 26 bp, Homo sapiens
cggcggcggcgactctggacgcgagc

SEQ ID NO: 60681 - DNA, 27 bp, Homo sapiens
cggcggcggcgactctggacgcgagcc

SEQ ID NO: 60682 - DNA, 28 bp, Homo sapiens
cggcggcggcgactctggacgcgagccg

SEQ ID NO: 60683 - DNA, 30 bp, Homo sapiens; identical to SEQ ID NO: 24223

SEQ ID NO: 60684 - DNA, 31 bp, Homo sapiens; identical to SEQ ID NO: 24224

SEQ ID NO: 60685 - DNA, 32 bp, Homo sapiens; identical to SEQ ID NO: 5253

SEQ ID NO: 60686 - DNA, 33 bp, Homo sapiens; identical to SEQ ID NO: 5254

SEQ ID NO: 60687 - DNA, 34 bp, Homo sapiens; identical to SEQ ID NO: 24227

SEQ ID NO: 60688 - DNA, 35 bp, Homo sapiens
cggcggcggcgactctggacgcgagccgggccctt

SEQ ID NO: 60689 - DNA, 44 bp, Homo sapiens; identical to SEQ ID NO: 24228

SEQ ID NO: 60690 - DNA, 21 bp, Homo sapiens
ggcggcggcgactctggacgc

SEQ ID NO: 60691 - DNA, 22 bp, Homo sapiens
ggcggcggcgactctggacgcg

SEQ ID NO: 60692 - DNA, 25 bp, Homo sapiens
ggcggcggcgactctggacgcgagc

SEQ ID NO: 60693 - DNA, 27 bp, Homo sapiens
ggcggcggcgactctggacgcgagccg

SEQ ID NO: 60694 - DNA, 29 bp, Homo sapiens
ggcggcggcgactctggacgcgagccggg

SEQ ID NO: 60695 - DNA, 30 bp, Homo sapiens; identical to SEQ ID NO: 50479

SEQ ID NO: 60696 - DNA, 31 bp, Homo sapiens; identical to SEQ ID NO: 24232

SEQ ID NO: 60697 - DNA, 32 bp, Homo sapiens; identical to SEQ ID NO: 5255

SEQ ID NO: 60698 - DNA, 33 bp, Homo sapiens; identical to SEQ ID NO: 5256

SEQ ID NO: 60699 - DNA, 34 bp, Homo sapiens
ggcggcggcgactctggacgcgagccgggccctt

SEQ ID NO: 60700 - DNA, 43 bp, Homo sapiens; identical to SEQ ID NO: 24235

SEQ ID NO: 60701 - DNA, 26 bp, Homo sapiens
gcggcggcgactctggacgcgagccg

SEQ ID NO: 60702 - DNA, 28 bp, Homo sapiens
gcggcggcgactctggacgcgagccggg

SEQ ID NO: 60703 - DNA, 29 bp, Homo sapiens
gcggcggcgactctggacgcgagccgggc

SEQ ID NO: 60704 - DNA, 30 bp, Homo sapiens; identical to SEQ ID NO: 5257

SEQ ID NO: 60705 - DNA, 31 bp, Homo sapiens; identical to SEQ ID NO: 5258

SEQ ID NO: 60706 - DNA, 32 bp, Homo sapiens; identical to SEQ ID NO: 5259

SEQ ID NO: 60707 - DNA, 33 bp, Homo sapiens; identical to SEQ ID NO: 24246

SEQ ID NO: 60708 - DNA, 42 bp, Homo sapiens; identical to SEQ ID NO: 24247

SEQ ID NO: 60709 - DNA, 19 bp, Homo sapiens
cggcggcgactctggacgc

SEQ ID NO: 60710 - DNA, 23 bp, Homo sapiens
cggcggcgactctggacgcgagc

SEQ ID NO: 60711 - DNA, 24 bp, Homo sapiens
cggcggcgactctggacgcgagcc

SEQ ID NO: 60712 - DNA, 27 bp, Homo sapiens
cggcggcgactctggacgcgagccggg

SEQ ID NO: 60713 - DNA, 29 bp, Homo sapiens
cggcggcgactctggacgcgagccgggcc

SEQ ID NO: 60714 - DNA, 30 bp, Homo sapiens; identical to SEQ ID NO: 5260

SEQ ID NO: 60715 - DNA, 31 bp, Homo sapiens; identical to SEQ ID NO: 5261

SEQ ID NO: 60716 - DNA, 32 bp, Homo sapiens; identical to SEQ ID NO: 24257

SEQ ID NO: 60717 - DNA, 22 bp, Homo sapiens
ggcggcgactctggacgcgagc

SEQ ID NO: 60718 - DNA, 28 bp, Homo sapiens
ggcggcgactctggacgcgagccgggcc

SEQ ID NO: 60719 - DNA, 29 bp, Homo sapiens
ggcggcgactctggacgcgagccgggccc

SEQ ID NO: 60720 - DNA, 30 bp, Homo sapiens; identical to SEQ ID NO: 24263

SEQ ID NO: 60721 - DNA, 31 bp, Homo sapiens; identical to SEQ ID NO: 24264

SEQ ID NO: 60722 - DNA, 32 bp, Homo sapiens
ggcggcgactctggacgcgagccgggcccttc

SEQ ID NO: 60723 - DNA, 40 bp, Homo sapiens; identical to SEQ ID NO: 24265

SEQ ID NO: 60724 - DNA, 21 bp, Homo sapiens
gcggcgactctggacgcgagc

SEQ ID NO: 60725 - DNA, 22 bp, Homo sapiens
gcggcgactctggacgcgagcc

SEQ ID NO: 60726 - DNA, 25 bp, Homo sapiens
gcggcgactctggacgcgagccggg

SEQ ID NO: 60727 - DNA, 26 bp, Homo sapiens
gcggcgactctggacgcgagccgggc

SEQ ID NO: 60728 - DNA, 27 bp, Homo sapiens
gcggcgactctggacgcgagccgggcc

SEQ ID NO: 60729 - DNA, 28 bp, Homo sapiens
gcggcgactctggacgcgagccgggccc

SEQ ID NO: 60730 - DNA, 29 bp, Homo sapiens
gcggcgactctggacgcgagccgggccct

SEQ ID NO: 60731 - DNA, 30 bp, Homo sapiens; identical to SEQ ID NO: 5266

SEQ ID NO: 60732 - DNA, 31 bp, Homo sapiens
gcggcgactctggacgcgagccgggcccttc

SEQ ID NO: 60733 - DNA, 39 bp, Homo sapiens
gcggcgactctggacgcgagccgggcccttcccgtggat

SEQ ID NO: 60734 - DNA, 21 bp, Homo sapiens
cggcgactctggacgcgagcc

SEQ ID NO: 60735 - DNA, 24 bp, Homo sapiens
cggcgactctggacgcgagccggg

SEQ ID NO: 60736 - DNA, 26 bp, Homo sapiens
cggcgactctggacgcgagccgggcc

SEQ ID NO: 60737 - DNA, 27 bp, Homo sapiens
cggcgactctggacgcgagccgggccc

SEQ ID NO: 60738 - DNA, 28 bp, Homo sapiens
cggcgactctggacgcgagccgggccct

SEQ ID NO: 60739 - DNA, 29 bp, Homo sapiens
cggcgactctggacgcgagccgggccctt

SEQ ID NO: 60740 - DNA, 30 bp, Homo sapiens; identical to SEQ ID NO: 50554

SEQ ID NO: 60741 - DNA, 38 bp, Homo sapiens; identical to SEQ ID NO: 24287

SEQ ID NO: 60742 - DNA, 26 bp, Homo sapiens
ggcgactctggacgcgagccgggccc

SEQ ID NO: 60743 - DNA, 27 bp, Homo sapiens
ggcgactctggacgcgagccgggccct

SEQ ID NO: 60744 - DNA, 28 bp, Homo sapiens
ggcgactctggacgcgagccgggccctt

SEQ ID NO: 60745 - DNA, 18 bp, Homo sapiens
gcgactctggacgcgagc

SEQ ID NO: 60746 - DNA, 23 bp, Homo sapiens
gcgactctggacgcgagccgggc

SEQ ID NO: 60747 - DNA, 24 bp, Homo sapiens
gcgactctggacgcgagccgggcc

SEQ ID NO: 60748 - DNA, 25 bp, Homo sapiens
gcgactctggacgcgagccgggccc

SEQ ID NO: 60749 - DNA, 26 bp, Homo sapiens
gcgactctggacgcgagccgggccct

SEQ ID NO: 60750 - DNA, 24 bp, Homo sapiens
cgactctggacgcgagccgggccc

SEQ ID NO: 60751 - DNA, 25 bp, Homo sapiens
cgactctggacgcgagccgggccct

SEQ ID NO: 60752 - DNA, 22 bp, Homo sapiens
actctggacgcgagccgggccc

SEQ ID NO: 60753 - DNA, 23 bp, Homo sapiens
actctggacgcgagccgggccct

SEQ ID NO: 60754 - DNA, 20 bp, Homo sapiens
ctctggacgcgagccgggcc

SEQ ID NO: 60755 - DNA, 21 bp, Homo sapiens
ctctggacgcgagccgggccc

SEQ ID NO: 60756 - DNA, 22 bp, Homo sapiens
ctctggacgcgagccgggccct

SEQ ID NO: 60757 - DNA, 19 bp, Homo sapiens
tctggacgcgagccgggcc

SEQ ID NO: 60758 - DNA, 20 bp, Homo sapiens
tctggacgcgagccgggccc

SEQ ID NO: 60759 - DNA, 21 bp, Homo sapiens
tctggacgcgagccgggccct

SEQ ID NO: 60760 - DNA, 17 bp, Homo sapiens
ctggacgcgagccgggc

SEQ ID NO: 60761 - DNA, 18 bp, Homo sapiens
ctggacgcgagccgggcc

SEQ ID NO: 60762 - DNA, 19 bp, Homo sapiens
ctggacgcgagccgggccc

SEQ ID NO: 60763 - DNA, 20 bp, Homo sapiens
ctggacgcgagccgggccct

SEQ ID NO: 60764 - DNA, 21 bp, Homo sapiens
ctggacgcgagccgggccctt

SEQ ID NO: 60765 - DNA, 22 bp, Homo sapiens
ctggacgcgagccgggcccttc

SEQ ID NO: 60766 - DNA, 25 bp, Homo sapiens
ctggacgcgagccgggcccttcccg

SEQ ID NO: 60767 - DNA, 29 bp, Homo sapiens
ctggacgcgagccgggcccttcccgtgga

SEQ ID NO: 60768 - DNA, 30 bp, Homo sapiens; identical to SEQ ID NO: 5285

SEQ ID NO: 60769 - DNA, 31 bp, Homo sapiens; identical to SEQ ID NO: 5286

SEQ ID NO: 60770 - DNA, 32 bp, Homo sapiens; identical to SEQ ID NO: 5287

SEQ ID NO: 60771 - DNA, 35 bp, Homo sapiens
ctggacgcgagccgggcccttcccgtggatcgccc

SEQ ID NO: 60772 - DNA, 36 bp, Homo sapiens
ctggacgcgagccgggcccttcccgtggatcgcccc

SEQ ID NO: 60773 - DNA, 16 bp, Homo sapiens
ggacgcgagccgggcc

SEQ ID NO: 60774 - DNA, 17 bp, Homo sapiens
ggacgcgagccgggccc

SEQ ID NO: 60775 - DNA, 18 bp, Homo sapiens
ggacgcgagccgggccct

SEQ ID NO: 60776 - DNA, 30 bp, Homo sapiens; identical to SEQ ID NO: 50679

SEQ ID NO: 60777 - DNA, 29 bp, Homo sapiens
gccgggcccttcccgtggatcgccccagc

SEQ ID NO: 60778 - DNA, 21 bp, Homo sapiens
tcccgtggatcgccccagctg

SEQ ID NO: 60779 - DNA, 22 bp, Homo sapiens
tcccgtggatcgccccagctgc

SEQ ID NO: 60780 - DNA, 18 bp, Homo sapiens
cccgtggatcgccccagc

SEQ ID NO: 60781 - DNA, 19 bp, Homo sapiens
cccgtggatcgccccagct

SEQ ID NO: 60782 - DNA, 20 bp, Homo sapiens
cccgtggatcgccccagctg

SEQ ID NO: 60783 - DNA, 21 bp, Homo sapiens
cccgtggatcgccccagctgc

SEQ ID NO: 60784 - DNA, 22 bp, Homo sapiens
cccgtggatcgccccagctgcg

SEQ ID NO: 60785 - DNA, 28 bp, Homo sapiens
cccgtggatcgccccagctgcggcgggc

SEQ ID NO: 60786 - DNA, 29 bp, Homo sapiens
cccgtggatcgccccagctgcggcgggcg

SEQ ID NO: 60787 - DNA, 34 bp, Homo sapiens
cccgtggatcgccccagctgcggcgggcgtcgcg

SEQ ID NO: 60788 - DNA, 17 bp, Homo sapiens
ccgtggatcgccccagc

SEQ ID NO: 60789 - DNA, 16 bp, Homo sapiens
cgtggatcgccccagc

SEQ ID NO: 60790 - DNA, 19 bp, Homo sapiens
cgtggatcgccccagctgc

SEQ ID NO: 60791 - DNA, 34 bp, Homo sapiens
cgtggatcgccccagctgcggcgggcgtcgcggc

SEQ ID NO: 60792 - DNA, 28 bp, Homo sapiens
gtggatcgccccagctgcggcgggcgtc

SEQ ID NO: 60793 - DNA, 19 bp, Homo sapiens
cgccccagctgcggcgggc

SEQ ID NO: 60794 - DNA, 20 bp, Homo sapiens
cgccccagctgcggcgggcg

SEQ ID NO: 60795 - DNA, 38 bp, Homo sapiens; identical to SEQ ID NO: 57991

SEQ ID NO: 60796 - DNA, 26 bp, Homo sapiens
gccccagctgcggcgggcgtcgcggc

SEQ ID NO: 60797 - DNA, 27 bp, Homo sapiens
gccccagctgcggcgggcgtcgcggcc

SEQ ID NO: 60798 - DNA, 19 bp, Homo sapiens
cggcgggcgtcgcggccgc

SEQ ID NO: 60799 - DNA, 18 bp, Homo sapiens
ggcgggcgtcgcggccgc

SEQ ID NO: 60800 - DNA, 19 bp, Homo sapiens
cgtcgcggccgcccccggg

SEQ ID NO: 60801 - DNA, 20 bp, Homo sapiens
cgtcgcggccgcccccgggg

SEQ ID NO: 60802 - DNA, 35 bp, Homo sapiens; identical to SEQ ID NO: 57995

SEQ ID NO: 60803 - DNA, 29 bp, Homo sapiens
tcgcggccgcccccggggagcccggcggg

SEQ ID NO: 60804 - DNA, 16 bp, Homo sapiens
cgcggccgcccccggg

SEQ ID NO: 60805 - DNA, 17 bp, Homo sapiens
cgcggccgcccccgggg

SEQ ID NO: 60806 - DNA, 18 bp, Homo sapiens
cgcggccgcccccgggga

SEQ ID NO: 60807 - DNA, 27 bp, Homo sapiens
cgcggccgcccccggggagcccggcgg

SEQ ID NO: 60808 - DNA, 28 bp, Homo sapiens
cgcggccgcccccggggagcccggcggg

SEQ ID NO: 60809 - DNA, 29 bp, Homo sapiens
cgcggccgcccccggggagcccggcgggc

SEQ ID NO: 60810 - DNA, 16 bp, Homo sapiens
gcggccgcccccgggg

SEQ ID NO: 60811 - DNA, 17 bp, Homo sapiens
gcggccgcccccgggga

SEQ ID NO: 60812 - DNA, 27 bp, Homo sapiens
gcggccgcccccggggagcccggcggg

SEQ ID NO: 60813 - DNA, 29 bp, Homo sapiens
gcggccgcccccggggagcccggcgggcg

SEQ ID NO: 60814 - DNA, 30 bp, Homo sapiens
gcggccgcccccggggagcccggcgggcgc

SEQ ID NO: 60815 - DNA, 32 bp, Homo sapiens
gcggccgcccccggggagcccggcgggcgccg

SEQ ID NO: 60816 - DNA, 16 bp, Homo sapiens
cggccgcccccgggga

SEQ ID NO: 60817 - DNA, 23 bp, Homo sapiens
cggccgcccccggggagcccggc

SEQ ID NO: 60818 - DNA, 25 bp, Homo sapiens
cggccgcccccggggagcccggcgg

SEQ ID NO: 60819 - DNA, 26 bp, Homo sapiens
cggccgcccccggggagcccggcggg

SEQ ID NO: 60820 - DNA, 27 bp, Homo sapiens
cggccgcccccggggagcccggcgggc

SEQ ID NO: 60821 - DNA, 25 bp, Homo sapiens
ggccgcccccggggagcccggcggg

SEQ ID NO: 60822 - DNA, 30 bp, Homo sapiens; identical to SEQ ID NO: 58010

SEQ ID NO: 60823 - DNA, 29 bp, Homo sapiens
cgcccccggggagcccggcgggcgccggc

SEQ ID NO: 60824 - DNA, 20 bp, Homo sapiens
cccccggggagcccggcggg

SEQ ID NO: 60825 - DNA, 21 bp, Homo sapiens
cccccggggagcccggcgggc

SEQ ID NO: 60826 - DNA, 22 bp, Homo sapiens
cccccggggagcccggcgggcg

SEQ ID NO: 60827 - DNA, 27 bp, Homo sapiens
cccccggggagcccggcgggcgccggc

SEQ ID NO: 60828 - DNA, 28 bp, Homo sapiens
cccccggggagcccggcgggcgccggcg

SEQ ID NO: 60829 - DNA, 29 bp, Homo sapiens
cccccggggagcccggcgggcgccggcgc

SEQ ID NO: 60830 - DNA, 18 bp, Homo sapiens
ccccggggagcccggcgg

SEQ ID NO: 60831 - DNA, 19 bp, Homo sapiens
ccccggggagcccggcggg

SEQ ID NO: 60832 - DNA, 20 bp, Homo sapiens
ccccggggagcccggcgggc

SEQ ID NO: 60833 - DNA, 21 bp, Homo sapiens
ccccggggagcccggcgggcg

SEQ ID NO: 60834 - DNA, 24 bp, Homo sapiens
ccccggggagcccggcgggcgccg

SEQ ID NO: 60835 - DNA, 26 bp, Homo sapiens
ccccggggagcccggcgggcgccggc

SEQ ID NO: 60836 - DNA, 27 bp, Homo sapiens
ccccggggagcccggcgggcgccggcg

SEQ ID NO: 60837 - DNA, 28 bp, Homo sapiens
ccccggggagcccggcgggcgccggcgc

SEQ ID NO: 60838 - DNA, 31 bp, Homo sapiens
ccccggggagcccggcgggcgccggcgcgcc

SEQ ID NO: 60839 - DNA, 17 bp, Homo sapiens
cccggggagcccggcgg

SEQ ID NO: 60840 - DNA, 18 bp, Homo sapiens
cccggggagcccggcggg

SEQ ID NO: 60841 - DNA, 19 bp, Homo sapiens
cccggggagcccggcgggc

SEQ ID NO: 60842 - DNA, 20 bp, Homo sapiens
cccggggagcccggcgggcg

SEQ ID NO: 60843 - DNA, 25 bp, Homo sapiens
cccggggagcccggcgggcgccggc

SEQ ID NO: 60844 - DNA, 26 bp, Homo sapiens
cccggggagcccggcgggcgccggcg

SEQ ID NO: 60845 - DNA, 27 bp, Homo sapiens
cccggggagcccggcgggcgccggcgc

SEQ ID NO: 60846 - DNA, 18 bp, Homo sapiens
ccggggagcccggcgggc

SEQ ID NO: 60847 - DNA, 24 bp, Homo sapiens
ccggggagcccggcgggcgccggc

SEQ ID NO: 60848 - DNA, 16 bp, Homo sapiens
cggggagcccggcggg

SEQ ID NO: 60849 - DNA, 17 bp, Homo sapiens
cggggagcccggcgggc

SEQ ID NO: 60850 - DNA, 18 bp, Homo sapiens
cggggagcccggcgggcg

SEQ ID NO: 60851 - DNA, 23 bp, Homo sapiens
cggggagcccggcgggcgccggc

SEQ ID NO: 60852 - DNA, 28 bp, Homo sapiens
cggggagcccggcgggcgccggcgcgcc

SEQ ID NO: 60853 - DNA, 29 bp, Homo sapiens
cggggagcccggcgggcgccggcgcgccc

SEQ ID NO: 60854 - DNA, 16 bp, Homo sapiens
ggggagcccggcgggc

SEQ ID NO: 60855 - DNA, 17 bp, Homo sapiens
cccggcgggcgccggcg

SEQ ID NO: 60856 - DNA, 18 bp, Homo sapiens
cccggcgggcgccggcgc

SEQ ID NO: 60857 - DNA, 19 bp, Homo sapiens
cccggcgggcgccggcgcg

SEQ ID NO: 60858 - DNA, 20 bp, Homo sapiens
cccggcgggcgccggcgcgc

SEQ ID NO: 60859 - DNA, 21 bp, Homo sapiens
cccggcgggcgccggcgcgcc

SEQ ID NO: 60860 - DNA, 22 bp, Homo sapiens
cccggcgggcgccggcgcgccc

SEQ ID NO: 60861 - DNA, 23 bp, Homo sapiens
cccggcgggcgccggcgcgcccc

SEQ ID NO: 60862 - DNA, 24 bp, Homo sapiens
cccggcgggcgccggcgcgccccc

SEQ ID NO: 60863 - DNA, 25 bp, Homo sapiens
cccggcgggcgccggcgcgcccccc

SEQ ID NO: 60864 - DNA, 26 bp, Homo sapiens
cccggcgggcgccggcgcgccccccc

SEQ ID NO: 60865 - DNA, 20 bp, Homo sapiens
ccggcgggcgccggcgcgcc

SEQ ID NO: 60866 - DNA, 18 bp, Homo sapiens
cggcgggcgccggcgcgc

SEQ ID NO: 60867 - DNA, 19 bp, Homo sapiens
cggcgggcgccggcgcgcc

SEQ ID NO: 60868 - DNA, 21 bp, Homo sapiens
cggcgggcgccggcgcgcccc

SEQ ID NO: 60869 - DNA, 24 bp, Homo sapiens
ccccaccccacgtctcgtcgcgcg

SEQ ID NO: 60870 - DNA, 23 bp, Homo sapiens
cccaccccacgtctcgtcgcgcg

SEQ ID NO: 60871 - DNA, 20 bp, Homo sapiens
ccaccccacgtctcgtcgcg

SEQ ID NO: 60872 - DNA, 22 bp, Homo sapiens
ccaccccacgtctcgtcgcgcg

SEQ ID NO: 60873 - DNA, 26 bp, Homo sapiens
ccaccccacgtctcgtcgcgcgcgcg

SEQ ID NO: 60874 - DNA, 19 bp, Homo sapiens
caccccacgtctcgtcgcg

SEQ ID NO: 60875 - DNA, 21 bp, Homo sapiens
caccccacgtctcgtcgcgcg

SEQ ID NO: 60876 - DNA, 25 bp, Homo sapiens
caccccacgtctcgtcgcgcgcgcg

SEQ ID NO: 60877 - DNA, 31 bp, Homo sapiens; identical to SEQ ID NO: 24468

SEQ ID NO: 60878 - DNA, 18 bp, Homo sapiens
accccacgtctcgtcgcg

SEQ ID NO: 60879 - DNA, 20 bp, Homo sapiens
accccacgtctcgtcgcgcg

SEQ ID NO: 60880 - DNA, 17 bp, Homo sapiens
ccccacgtctcgtcgcg

SEQ ID NO: 60881 - DNA, 19 bp, Homo sapiens
ccccacgtctcgtcgcgcg

SEQ ID NO: 60882 - DNA, 17 bp, Homo sapiens
ccacgtctcgtcgcgcg

SEQ ID NO: 60883 - DNA, 26 bp, Homo sapiens
cacgtctcgtcgcgcgcgcgtccgct

SEQ ID NO: 60884 - DNA, 22 bp, Homo sapiens
acgtctcgtcgcgcgcgcgtcc

SEQ ID NO: 60885 - DNA, 24 bp, Homo sapiens
acgtctcgtcgcgcgcgcgtccgc

SEQ ID NO: 60886 - DNA, 25 bp, Homo sapiens
acgtctcgtcgcgcgcgcgtccgct

SEQ ID NO: 60887 - DNA, 32 bp, Homo sapiens
acgtctcgtcgcgcgcgcgtccgctgggggcg

SEQ ID NO: 60888 - DNA, 24 bp, Homo sapiens
cgtctcgtcgcgcgcgcgtccgct

SEQ ID NO: 60889 - DNA, 19 bp, Homo sapiens
cgcgcgtccgctgggggcg

SEQ ID NO: 60890 - DNA, 26 bp, Homo sapiens
cgcgcgtccgctgggggcggggagcg

SEQ ID NO: 60891 - DNA, 30 bp, Homo sapiens; identical to SEQ ID NO: 51090

SEQ ID NO: 60892 - DNA, 31 bp, Homo sapiens
cgcgcgtccgctgggggcggggagcggtcgg

SEQ ID NO: 60893 - DNA, 33 bp, Homo sapiens; identical to SEQ ID NO: 24540

SEQ ID NO: 60894 - DNA, 19 bp, Homo sapiens
ggggagcggtcgggcggcg

SEQ ID NO: 60895 - DNA, 32 bp, Homo sapiens; identical to SEQ ID NO: 24546

SEQ ID NO: 60896 - DNA, 18 bp, Homo sapiens
cgggcggcggcggtcggc

SEQ ID NO: 60897 - DNA, 21 bp, Homo sapiens
cgggcggcggcggtcggcggg

SEQ ID NO: 60898 - DNA, 33 bp, Homo sapiens; identical to SEQ ID NO: 58042

SEQ ID NO: 60899 - DNA, 34 bp, Homo sapiens; identical to SEQ ID NO: 58043

SEQ ID NO: 60900 - DNA, 17 bp, Homo sapiens
gggcggcggcggtcggc

SEQ ID NO: 60901 - DNA, 20 bp, Homo sapiens
gggcggcggcggtcggcggg

SEQ ID NO: 60902 - DNA, 21 bp, Homo sapiens
gggcggcggcggtcggcgggc

SEQ ID NO: 60903 - DNA, 18 bp, Homo sapiens
cggcggtcggcgggcggc

SEQ ID NO: 60904 - DNA, 26 bp, Homo sapiens
cggcggtcggcgggcggcggggcggg

SEQ ID NO: 60905 - DNA, 23 bp, Homo sapiens
cggtcggcgggcggcggggcggg

SEQ ID NO: 60906 - DNA, 24 bp, Homo sapiens
cggtcggcgggcggcggggcgggg

SEQ ID NO: 60907 - DNA, 22 bp, Homo sapiens
gtcggcgggcggcggggcgggg

SEQ ID NO: 60908 - DNA, 23 bp, Homo sapiens
gtcggcgggcggcggggcggggc

SEQ ID NO: 60909 - DNA, 19 bp, Homo sapiens
cggcgggcggcggggcggg

SEQ ID NO: 60910 - DNA, 19 bp, Homo sapiens
cccgccctacccccccggc

SEQ ID NO: 60911 - DNA, 20 bp, Homo sapiens
cccgccctacccccccggcc

SEQ ID NO: 60912 - DNA, 19 bp, Homo sapiens
ccgccctacccccccggcc

SEQ ID NO: 60913 - DNA, 22 bp, Homo sapiens
ccgccctacccccccggccccg

SEQ ID NO: 60914 - DNA, 17 bp, Homo sapiens
cgccctacccccccggc

SEQ ID NO: 60915 - DNA, 18 bp, Homo sapiens
cgccctacccccccggcc

SEQ ID NO: 60916 - DNA, 19 bp, Homo sapiens
cgccctacccccccggccc

SEQ ID NO: 60917 - DNA, 21 bp, Homo sapiens
cgccctacccccccggccccg

SEQ ID NO: 60918 - DNA, 23 bp, Homo sapiens
cgccctacccccccggccccgtc

SEQ ID NO: 60919 - DNA, 20 bp, Homo sapiens
gccctacccccccggccccg

SEQ ID NO: 60920 - DNA, 20 bp, Homo sapiens
cccccccggccccgtccgcc

SEQ ID NO: 60921 - DNA, 21 bp, Homo sapiens
cccccccggccccgtccgccc

SEQ ID NO: 60922 - DNA, 19 bp, Homo sapiens
ccccccggccccgtccgcc

SEQ ID NO: 60923 - DNA, 20 bp, Homo sapiens
ccccccggccccgtccgccc

SEQ ID NO: 60924 - DNA, 27 bp, Homo sapiens
ccccggccccgtccgccccccgttccc

SEQ ID NO: 60925 - DNA, 25 bp, Homo sapiens
cccggccccgtccgccccccgttcc

SEQ ID NO: 60926 - DNA, 26 bp, Homo sapiens
cccggccccgtccgccccccgttccc

SEQ ID NO: 60927 - DNA, 27 bp, Homo sapiens
cccggccccgtccgccccccgttcccc

SEQ ID NO: 60928 - DNA, 25 bp, Homo sapiens
ccggccccgtccgccccccgttccc

SEQ ID NO: 60929 - DNA, 26 bp, Homo sapiens
ccggccccgtccgccccccgttcccc

SEQ ID NO: 60930 - DNA, 24 bp, Homo sapiens
cggccccgtccgccccccgttccc

SEQ ID NO: 60931 - DNA, 25 bp, Homo sapiens
cggccccgtccgccccccgttcccc

SEQ ID NO: 60932 - DNA, 33 bp, Homo sapiens
gttcccccctcctcctcggcgcgcggcggcggc

SEQ ID NO: 60933 - DNA, 17 bp, Homo sapiens
cggcgcgcggcggcggc

SEQ ID NO: 60934 - DNA, 18 bp, Homo sapiens
cgcgcggcggcggcggcg

SEQ ID NO: 60935 - DNA, 26 bp, Homo sapiens
cgcgggccggtcccccccgccgggtc

SEQ ID NO: 60936 - DNA, 24 bp, Homo sapiens
cgggccggtcccccccgccgggtc

SEQ ID NO: 60937 - DNA, 25 bp, Homo sapiens
cgggccggtcccccccgccgggtcc

SEQ ID NO: 60938 - DNA, 36 bp, Homo sapiens
cgggccggtcccccccgccgggtccgcccccggggc

SEQ ID NO: 60939 - DNA, 19 bp, Homo sapiens
cggtcccccccgccgggtc

SEQ ID NO: 60940 - DNA, 24 bp, Homo sapiens
cccccgccgggtccgcccccgggg

SEQ ID NO: 60941 - DNA, 22 bp, Homo sapiens
ccccgccgggtccgcccccggg

SEQ ID NO: 60942 - DNA, 29 bp, Homo sapiens
ccccgccgggtccgcccccggggccgcgg

SEQ ID NO: 60943 - DNA, 24 bp, Homo sapiens
cccgccgggtccgcccccggggcc

SEQ ID NO: 60944 - DNA, 28 bp, Homo sapiens
cccgccgggtccgcccccggggccgcgg

SEQ ID NO: 60945 - DNA, 30 bp, Homo sapiens; identical to SEQ ID NO: 24667

SEQ ID NO: 60946 - DNA, 31 bp, Homo sapiens; identical to SEQ ID NO: 5343

SEQ ID NO: 60947 - DNA, 17 bp, Homo sapiens
cccccggggccgcggtt

SEQ ID NO: 60948 - DNA, 18 bp, Homo sapiens
cccccggggccgcggttc

SEQ ID NO: 60949 - DNA, 19 bp, Homo sapiens
cccccggggccgcggttcc

SEQ ID NO: 60950 - DNA, 20 bp, Homo sapiens
cccccggggccgcggttccg

SEQ ID NO: 60951 - DNA, 29 bp, Homo sapiens
cgcggttccgcgcggcgcctcgcctcggc

SEQ ID NO: 60952 - DNA, 21 bp, Homo sapiens
cgcgcggcgcctcgcctcggc

SEQ ID NO: 60953 - DNA, 25 bp, Homo sapiens
cgcgcggcgcctcgcctcggccggc

SEQ ID NO: 60954 - DNA, 20 bp, Homo sapiens
gcgcggcgcctcgcctcggc

SEQ ID NO: 60955 - DNA, 21 bp, Homo sapiens
gcgcggcgcctcgcctcggcc

SEQ ID NO: 60956 - DNA, 22 bp, Homo sapiens
gcgcggcgcctcgcctcggccg

SEQ ID NO: 60957 - DNA, 24 bp, Homo sapiens
gcgcggcgcctcgcctcggccggc

SEQ ID NO: 60958 - DNA, 19 bp, Homo sapiens
cgcggcgcctcgcctcggc

SEQ ID NO: 60959 - DNA, 20 bp, Homo sapiens
cgcggcgcctcgcctcggcc

SEQ ID NO: 60960 - DNA, 21 bp, Homo sapiens
cgcggcgcctcgcctcggccg

SEQ ID NO: 60961 - DNA, 22 bp, Homo sapiens
cgcggcgcctcgcctcggccgg

SEQ ID NO: 60962 - DNA, 23 bp, Homo sapiens
cgcggcgcctcgcctcggccggc

SEQ ID NO: 60963 - DNA, 24 bp, Homo sapiens
cgcggcgcctcgcctcggccggcg

SEQ ID NO: 60964 - DNA, 45 bp, Homo sapiens; identical to SEQ ID NO: 24695

SEQ ID NO: 60965 - DNA, 17 bp, Homo sapiens
cggcgcctcgcctcggc

SEQ ID NO: 60966 - DNA, 18 bp, Homo sapiens
cggcgcctcgcctcggcc

SEQ ID NO: 60967 - DNA, 21 bp, Homo sapiens
cggcgcctcgcctcggccggc

SEQ ID NO: 60968 - DNA, 17 bp, Homo sapiens
ggcgcctcgcctcggcc

SEQ ID NO: 60969 - DNA, 18 bp, Homo sapiens
agcagccgacttagaact

SEQ ID NO: 60970 - DNA, 45 bp, Homo sapiens; identical to SEQ ID NO: 24788

SEQ ID NO: 60971 - DNA, 17 bp, Homo sapiens
gcagccgacttagaact

SEQ ID NO: 60972 - DNA, 27 bp, Homo sapiens
gcagccgacttagaactggtgcggacc

SEQ ID NO: 60973 - DNA, 33 bp, Homo sapiens; identical to SEQ ID NO: 5392

SEQ ID NO: 60974 - DNA, 34 bp, Homo sapiens; identical to SEQ ID NO: 24805

SEQ ID NO: 60975 - DNA, 36 bp, Homo sapiens; identical to SEQ ID NO: 24807

SEQ ID NO: 60976 - DNA, 40 bp, Homo sapiens; identical to SEQ ID NO: 24808

SEQ ID NO: 60977 - DNA, 42 bp, Homo sapiens; identical to SEQ ID NO: 24810

SEQ ID NO: 60978 - DNA, 44 bp, Homo sapiens; identical to SEQ ID NO: 24811

SEQ ID NO: 60979 - DNA, 24 bp, Homo sapiens
gccgacttagaactggtgcggacc

SEQ ID NO: 60980 - DNA, 41 bp, Homo sapiens; identical to SEQ ID NO: 24848

SEQ ID NO: 60981 - DNA, 33 bp, Homo sapiens; identical to SEQ ID NO: 5419

SEQ ID NO: 60982 - DNA, 29 bp, Homo sapiens
gaactggtgcggaccaggggaatccgact

SEQ ID NO: 60983 - DNA, 32 bp, Homo sapiens; identical to SEQ ID NO: 5423

SEQ ID NO: 60984 - DNA, 22 bp, Homo sapiens
aactggtgcggaccaggggaat

SEQ ID NO: 60985 - DNA, 26 bp, Homo sapiens
aactggtgcggaccaggggaatccga

SEQ ID NO: 60986 - DNA, 27 bp, Homo sapiens
aactggtgcggaccaggggaatccgac

SEQ ID NO: 60987 - DNA, 28 bp, Homo sapiens
aactggtgcggaccaggggaatccgact

SEQ ID NO: 60988 - DNA, 31 bp, Homo sapiens; identical to SEQ ID NO: 5430

SEQ ID NO: 60989 - DNA, 20 bp, Homo sapiens
actggtgcggaccaggggaa

SEQ ID NO: 60990 - DNA, 21 bp, Homo sapiens
actggtgcggaccaggggaat

SEQ ID NO: 60991 - DNA, 22 bp, Homo sapiens
actggtgcggaccaggggaatc

SEQ ID NO: 60992 - DNA, 23 bp, Homo sapiens
actggtgcggaccaggggaatcc

SEQ ID NO: 60993 - DNA, 24 bp, Homo sapiens
actggtgcggaccaggggaatccg

SEQ ID NO: 60994 - DNA, 25 bp, Homo sapiens
actggtgcggaccaggggaatccga

SEQ ID NO: 60995 - DNA, 26 bp, Homo sapiens
actggtgcggaccaggggaatccgac

SEQ ID NO: 60996 - DNA, 27 bp, Homo sapiens
actggtgcggaccaggggaatccgact

SEQ ID NO: 60997 - DNA, 30 bp, Homo sapiens; identical to SEQ ID NO: 5436

SEQ ID NO: 60998 - DNA, 35 bp, Homo sapiens; identical to SEQ ID NO: 24933

SEQ ID NO: 60999 - DNA, 24 bp, Homo sapiens
ctggtgcggaccaggggaatccga

SEQ ID NO: 61000 - DNA, 26 bp, Homo sapiens
ctggtgcggaccaggggaatccgact

SEQ ID NO: 61001 - DNA, 29 bp, Homo sapiens
ctggtgcggaccaggggaatccgactgtt

SEQ ID NO: 61002 - DNA, 30 bp, Homo sapiens; identical to SEQ ID NO: 5445

SEQ ID NO: 61003 - DNA, 34 bp, Homo sapiens; identical to SEQ ID NO: 24949

SEQ ID NO: 61004 - DNA, 28 bp, Homo sapiens
tggtgcggaccaggggaatccgactgtt

SEQ ID NO: 61005 - DNA, 17 bp, Homo sapiens
ggtgcggaccaggggaa

SEQ ID NO: 61006 - DNA, 19 bp, Homo sapiens
ggtgcggaccaggggaatc

SEQ ID NO: 61007 - DNA, 20 bp, Homo sapiens
ggtgcggaccaggggaatcc

SEQ ID NO: 61008 - DNA, 22 bp, Homo sapiens
ggtgcggaccaggggaatccga

SEQ ID NO: 61009 - DNA, 23 bp, Homo sapiens
ggtgcggaccaggggaatccgac

SEQ ID NO: 61010 - DNA, 24 bp, Homo sapiens
ggtgcggaccaggggaatccgact

SEQ ID NO: 61011 - DNA, 25 bp, Homo sapiens
ggtgcggaccaggggaatccgactg

SEQ ID NO: 61012 - DNA, 27 bp, Homo sapiens
ggtgcggaccaggggaatccgactgtt

SEQ ID NO: 61013 - DNA, 28 bp, Homo sapiens
ggtgcggaccaggggaatccgactgttt

SEQ ID NO: 61014 - DNA, 18 bp, Homo sapiens
gtgcggaccaggggaatc

SEQ ID NO: 61015 - DNA, 19 bp, Homo sapiens
gtgcggaccaggggaatcc

SEQ ID NO: 61016 - DNA, 26 bp, Homo sapiens
gtgcggaccaggggaatccgactgtt

SEQ ID NO: 61017 - DNA, 27 bp, Homo sapiens
gtgcggaccaggggaatccgactgttt

SEQ ID NO: 61018 - DNA, 18 bp, Homo sapiens
tgcggaccaggggaatcc

SEQ ID NO: 61019 - DNA, 25 bp, Homo sapiens
tgcggaccaggggaatccgactgtt

SEQ ID NO: 61020 - DNA, 17 bp, Homo sapiens
gcggaccaggggaatcc

SEQ ID NO: 61021 - DNA, 21 bp, Homo sapiens
gcggaccaggggaatccgact

SEQ ID NO: 61022 - DNA, 24 bp, Homo sapiens
gcggaccaggggaatccgactgtt

SEQ ID NO: 61023 - DNA, 25 bp, Homo sapiens
gcggaccaggggaatccgactgttt

SEQ ID NO: 61024 - DNA, 29 bp, Homo sapiens
gcggaccaggggaatccgactgtttaatt

SEQ ID NO: 61025 - DNA, 16 bp, Homo sapiens
cggaccaggggaatcc

SEQ ID NO: 61026 - DNA, 23 bp, Homo sapiens
cggaccaggggaatccgactgtt

SEQ ID NO: 61027 - DNA, 24 bp, Homo sapiens
cggaccaggggaatccgactgttt

SEQ ID NO: 61028 - DNA, 28 bp, Homo sapiens
cggaccaggggaatccgactgtttaatt

SEQ ID NO: 61029 - DNA, 20 bp, Homo sapiens
ggaccaggggaatccgactg

SEQ ID NO: 61030 - DNA, 22 bp, Homo sapiens
ggaccaggggaatccgactgtt

SEQ ID NO: 61031 - DNA, 23 bp, Homo sapiens
ggaccaggggaatccgactgttt

SEQ ID NO: 61032 - DNA, 19 bp, Homo sapiens
gaccaggggaatccgactg

SEQ ID NO: 61033 - DNA, 21 bp, Homo sapiens
gaccaggggaatccgactgtt

SEQ ID NO: 61034 - DNA, 22 bp, Homo sapiens
gaccaggggaatccgactgttt

SEQ ID NO: 61035 - DNA, 20 bp, Homo sapiens
accaggggaatccgactgtt

SEQ ID NO: 61036 - DNA, 19 bp, Homo sapiens
ccaggggaatccgactgtt

SEQ ID NO: 61037 - DNA, 20 bp, Homo sapiens
ccaggggaatccgactgttt

SEQ ID NO: 61038 - DNA, 24 bp, Homo sapiens
ccaggggaatccgactgtttaatt

SEQ ID NO: 61039 - DNA, 18 bp, Homo sapiens
caggggaatccgactgtt

SEQ ID NO: 61040 - DNA, 23 bp, Homo sapiens
caggggaatccgactgtttaatt

SEQ ID NO: 61041 - DNA, 17 bp, Homo sapiens
aggggaatccgactgtt

SEQ ID NO: 61042 - DNA, 18 bp, Homo sapiens
aggggaatccgactgttt

SEQ ID NO: 61043 - DNA, 22 bp, Homo sapiens
aggggaatccgactgtttaatt

SEQ ID NO: 61044 - DNA, 16 bp, Homo sapiens
ggggaatccgactgtt

SEQ ID NO: 61045 - DNA, 17 bp, Homo sapiens
ggggaatccgactgttt

SEQ ID NO: 61046 - DNA, 21 bp, Homo sapiens
ggggaatccgactgtttaatt

SEQ ID NO: 61047 - DNA, 19 bp, Homo sapiens
ggaatccgactgtttaatt

SEQ ID NO: 61048 - DNA, 21 bp, Homo sapiens
aaacaaagcatcgcgaaggcc

SEQ ID NO: 61049 - DNA, 20 bp, Homo sapiens
aacaaagcatcgcgaaggcc

SEQ ID NO: 61050 - DNA, 21 bp, Homo sapiens
aacaaagcatcgcgaaggccc

SEQ ID NO: 61051 - DNA, 19 bp, Homo sapiens
acaaagcatcgcgaaggcc

SEQ ID NO: 61052 - DNA, 17 bp, Homo sapiens
aaagcatcgcgaaggcc

SEQ ID NO: 61053 - DNA, 18 bp, Homo sapiens
aaagcatcgcgaaggccc

SEQ ID NO: 61054 - DNA, 16 bp, Homo sapiens
aagcatcgcgaaggcc

SEQ ID NO: 61055 - DNA, 17 bp, Homo sapiens
aagcatcgcgaaggccc

SEQ ID NO: 61056 - DNA, 18 bp, Homo sapiens
aagcatcgcgaaggcccg

SEQ ID NO: 61057 - DNA, 18 bp, Homo sapiens
cgcggcgggtgttgacgc

SEQ ID NO: 61058 - DNA, 20 bp, Homo sapiens
tgcccagtgctctgaatgtc

SEQ ID NO: 61059 - DNA, 24 bp, Homo sapiens
tgcccagtgctctgaatgtcaaag

SEQ ID NO: 61060 - DNA, 26 bp, Homo sapiens
tgcccagtgctctgaatgtcaaagtg

SEQ ID NO: 61061 - DNA, 30 bp, Homo sapiens; identical to SEQ ID NO: 5659

SEQ ID NO: 61062 - DNA, 36 bp, Homo sapiens; identical to SEQ ID NO: 25436

SEQ ID NO: 61063 - DNA, 16 bp, Homo sapiens
gcccagtgctctgaat

SEQ ID NO: 61064 - DNA, 19 bp, Homo sapiens
gcccagtgctctgaatgtc

SEQ ID NO: 61065 - DNA, 20 bp, Homo sapiens
gcccagtgctctgaatgtca

SEQ ID NO: 61066 - DNA, 23 bp, Homo sapiens
gcccagtgctctgaatgtcaaag

SEQ ID NO: 61067 - DNA, 25 bp, Homo sapiens
gcccagtgctctgaatgtcaaagtg

SEQ ID NO: 61068 - DNA, 28 bp, Homo sapiens
gcccagtgctctgaatgtcaaagtgaag

SEQ ID NO: 61069 - DNA, 35 bp, Homo sapiens; identical to SEQ ID NO: 25459

SEQ ID NO: 61070 - DNA, 26 bp, Homo sapiens
gaatgtcaaagtgaagaaattcaatg

SEQ ID NO: 61071 - DNA, 22 bp, Homo sapiens
atgtcaaagtgaagaaattcaa

SEQ ID NO: 61072 - DNA, 17 bp, Homo sapiens
agtaactatgactctct

SEQ ID NO: 61073 - DNA, 16 bp, Homo sapiens
aaatgcctcgtcatct

SEQ ID NO: 61074 - DNA, 20 bp, Homo sapiens
gtgacgcgcatgaatggatg

SEQ ID NO: 61075 - DNA, 28 bp, Homo sapiens
tgacgcgcatgaatggatgaacgagatt

SEQ ID NO: 61076 - DNA, 34 bp, Homo sapiens; identical to SEQ ID NO: 25806

SEQ ID NO: 61077 - DNA, 18 bp, Homo sapiens
gacgcgcatgaatggatg

SEQ ID NO: 61078 - DNA, 26 bp, Homo sapiens
gacgcgcatgaatggatgaacgagat

SEQ ID NO: 61079 - DNA, 27 bp, Homo sapiens
gacgcgcatgaatggatgaacgagatt

SEQ ID NO: 61080 - DNA, 25 bp, Homo sapiens
acgcgcatgaatggatgaacgagat

SEQ ID NO: 61081 - DNA, 26 bp, Homo sapiens
acgcgcatgaatggatgaacgagatt

SEQ ID NO: 61082 - DNA, 24 bp, Homo sapiens
cgcgcatgaatggatgaacgagat

SEQ ID NO: 61083 - DNA, 25 bp, Homo sapiens
cgcgcatgaatggatgaacgagatt

SEQ ID NO: 61084 - DNA, 21 bp, Homo sapiens
catgaatggatgaacgagatt

SEQ ID NO: 61085 - DNA, 19 bp, Homo sapiens
actgtccctacctactatc

SEQ ID NO: 61086 - DNA, 18 bp, Homo sapiens
ctgtccctacctactatc

SEQ ID NO: 61087 - DNA, 18 bp, Homo sapiens
aagaagaccctgttgagc

SEQ ID NO: 61088 - DNA, 18 bp, Homo sapiens
gaagaccctgttgagctt

SEQ ID NO: 61089 - DNA, 24 bp, Homo sapiens
gaagaccctgttgagcttgactct

SEQ ID NO: 61090 - DNA, 17 bp, Homo sapiens
aagaccctgttgagctt

SEQ ID NO: 61091 - DNA, 23 bp, Homo sapiens
aagaccctgttgagcttgactct

SEQ ID NO: 61092 - DNA, 22 bp, Homo sapiens
agaccctgttgagcttgactct

SEQ ID NO: 61093 - DNA, 21 bp, Homo sapiens
gaccctgttgagcttgactct

SEQ ID NO: 61094 - DNA, 20 bp, Homo sapiens
accctgttgagcttgactct

SEQ ID NO: 61095 - DNA, 42 bp, Homo sapiens
acggtgaagagacatgagaggtgtagaataagtgggaggccc

SEQ ID NO: 61096 - DNA, 41 bp, Homo sapiens
cggtgaagagacatgagaggtgtagaataagtgggaggccc

SEQ ID NO: 61097 - DNA, 39 bp, Homo sapiens
gtgaagagacatgagaggtgtagaataagtgggaggccc

SEQ ID NO: 61098 - DNA, 36 bp, Homo sapiens
aagagacatgagaggtgtagaataagtgggaggccc

SEQ ID NO: 61099 - DNA, 35 bp, Homo sapiens
agagacatgagaggtgtagaataagtgggaggccc

SEQ ID NO: 61100 - DNA, 34 bp, Homo sapiens
gagacatgagaggtgtagaataagtgggaggccc

SEQ ID NO: 61101 - DNA, 32 bp, Homo sapiens; identical to SEQ ID NO: 26109

SEQ ID NO: 61102 - DNA, 31 bp, Homo sapiens; identical to SEQ ID NO: 26112

SEQ ID NO: 61103 - DNA, 30 bp, Homo sapiens; identical to SEQ ID NO: 26123

SEQ ID NO: 61104 - DNA, 29 bp, Homo sapiens
atgagaggtgtagaataagtgggaggccc

SEQ ID NO: 61105 - DNA, 28 bp, Homo sapiens
tgagaggtgtagaataagtgggaggccc

SEQ ID NO: 61106 - DNA, 33 bp, Homo sapiens; identical to SEQ ID NO: 26139

SEQ ID NO: 61107 - DNA, 27 bp, Homo sapiens
gagaggtgtagaataagtgggaggccc

SEQ ID NO: 61108 - DNA, 25 bp, Homo sapiens
agaggtgtagaataagtgggaggcc

SEQ ID NO: 61109 - DNA, 26 bp, Homo sapiens
agaggtgtagaataagtgggaggccc

SEQ ID NO: 61110 - DNA, 27 bp, Homo sapiens
agaggtgtagaataagtgggaggcccc

SEQ ID NO: 61111 - DNA, 28 bp, Homo sapiens
agaggtgtagaataagtgggaggccccc

SEQ ID NO: 61112 - DNA, 29 bp, Homo sapiens
agaggtgtagaataagtgggaggcccccg

SEQ ID NO: 61113 - DNA, 25 bp, Homo sapiens
gaggtgtagaataagtgggaggccc

SEQ ID NO: 61114 - DNA, 24 bp, Homo sapiens
aggtgtagaataagtgggaggccc

SEQ ID NO: 61115 - DNA, 16 bp, Homo sapiens
cccggcgcccccccgg

SEQ ID NO: 61116 - DNA, 22 bp, Homo sapiens
cccggcgcccccccggtgtccc

SEQ ID NO: 61117 - DNA, 21 bp, Homo sapiens
ccggcgcccccccggtgtccc

SEQ ID NO: 61118 - DNA, 41 bp, Homo sapiens
ccggcgcccccccggtgtccccgcgaggggcccggggcggg

SEQ ID NO: 61119 - DNA, 42 bp, Homo sapiens; identical to SEQ ID NO: 58100

SEQ ID NO: 61120 - DNA, 39 bp, Homo sapiens
cggcgcccccccggtgtccccgcgaggggcccggggcgg

SEQ ID NO: 61121 - DNA, 40 bp, Homo sapiens
cggcgcccccccggtgtccccgcgaggggcccggggcggg

SEQ ID NO: 61122 - DNA, 41 bp, Homo sapiens; identical to SEQ ID NO: 58101

SEQ ID NO: 61123 - DNA, 25 bp, Homo sapiens
cccggtgtccccgcgaggggcccgg

SEQ ID NO: 61124 - DNA, 18 bp, Homo sapiens
ccccgcgaggggcccggg

SEQ ID NO: 61125 - DNA, 19 bp, Homo sapiens
ccccgcgaggggcccgggg

SEQ ID NO: 61126 - DNA, 20 bp, Homo sapiens
ccccgcgaggggcccggggc

SEQ ID NO: 61127 - DNA, 21 bp, Homo sapiens
ccccgcgaggggcccggggcg

SEQ ID NO: 61128 - DNA, 22 bp, Homo sapiens
ccccgcgaggggcccggggcgg

SEQ ID NO: 61129 - DNA, 23 bp, Homo sapiens
ccccgcgaggggcccggggcggg

SEQ ID NO: 61130 - DNA, 24 bp, Homo sapiens
ccccgcgaggggcccggggcgggg

SEQ ID NO: 61131 - DNA, 25 bp, Homo sapiens
ccccgcgaggggcccggggcggggt

SEQ ID NO: 61132 - DNA, 23 bp, Homo sapiens
cccgcgaggggcccggggcgggg

SEQ ID NO: 61133 - DNA, 17 bp, Homo sapiens
ccgcgaggggcccgggg

SEQ ID NO: 61134 - DNA, 18 bp, Homo sapiens
ccgcgaggggcccggggc

SEQ ID NO: 61135 - DNA, 31 bp, Homo sapiens
cgcgaggggcccggggcggggtccgccggcc

SEQ ID NO: 61136 - DNA, 26 bp, Homo sapiens
aggggcccggggcggggtccgccggc

SEQ ID NO: 61137 - DNA, 27 bp, Homo sapiens
aggggcccggggcggggtccgccggcc

SEQ ID NO: 61138 - DNA, 23 bp, Homo sapiens
cccggggcggggtccgccggccc

SEQ ID NO: 61139 - DNA, 24 bp, Homo sapiens
cgccggccctgcgggccgccggtg

SEQ ID NO: 61140 - DNA, 30 bp, Homo sapiens; identical to SEQ ID NO: 5848

SEQ ID NO: 61141 - DNA, 31 bp, Homo sapiens; identical to SEQ ID NO: 5849

SEQ ID NO: 61142 - DNA, 29 bp, Homo sapiens
gggccgccggtgaaataccactactctga

SEQ ID NO: 61143 - DNA, 30 bp, Homo sapiens; identical to SEQ ID NO: 5852

SEQ ID NO: 61144 - DNA, 31 bp, Homo sapiens; identical to SEQ ID NO: 26227

SEQ ID NO: 61145 - DNA, 24 bp, Homo sapiens
ggccgccggtgaaataccactact

SEQ ID NO: 61146 - DNA, 27 bp, Homo sapiens
ggccgccggtgaaataccactactctg

SEQ ID NO: 61147 - DNA, 28 bp, Homo sapiens
ggccgccggtgaaataccactactctga

SEQ ID NO: 61148 - DNA, 29 bp, Homo sapiens
ggccgccggtgaaataccactactctgat

SEQ ID NO: 61149 - DNA, 30 bp, Homo sapiens; identical to SEQ ID NO: 5857

SEQ ID NO: 61150 - DNA, 22 bp, Homo sapiens
gccgccggtgaaataccactac

SEQ ID NO: 61151 - DNA, 23 bp, Homo sapiens
gccgccggtgaaataccactact

SEQ ID NO: 61152 - DNA, 25 bp, Homo sapiens
gccgccggtgaaataccactactct

SEQ ID NO: 61153 - DNA, 26 bp, Homo sapiens
gccgccggtgaaataccactactctg

SEQ ID NO: 61154 - DNA, 27 bp, Homo sapiens
gccgccggtgaaataccactactctga

SEQ ID NO: 61155 - DNA, 28 bp, Homo sapiens
gccgccggtgaaataccactactctgat

SEQ ID NO: 61156 - DNA, 29 bp, Homo sapiens
gccgccggtgaaataccactactctgatc

SEQ ID NO: 61157 - DNA, 30 bp, Homo sapiens; identical to SEQ ID NO: 5864

SEQ ID NO: 61158 - DNA, 40 bp, Homo sapiens; identical to SEQ ID NO: 58117

SEQ ID NO: 61159 - DNA, 41 bp, Homo sapiens
gccgccggtgaaataccactactctgatcgttttttcactg

SEQ ID NO: 61160 - DNA, 42 bp, Homo sapiens
gccgccggtgaaataccactactctgatcgttttttcactga

SEQ ID NO: 61161 - DNA, 46 bp, Homo sapiens
gccgccggtgaaataccactactctgatcgttttttcactgacccg

SEQ ID NO: 61162 - DNA, 27 bp, Homo sapiens
ccactactctgatcgttttttcactga

SEQ ID NO: 61163 - DNA, 31 bp, Homo sapiens; identical to SEQ ID NO: 26287

SEQ ID NO: 61164 - DNA, 32 bp, Homo sapiens; identical to SEQ ID NO: 26288

SEQ ID NO: 61165 - DNA, 33 bp, Homo sapiens; identical to SEQ ID NO: 26289

SEQ ID NO: 61166 - DNA, 34 bp, Homo sapiens
ccactactctgatcgttttttcactgacccggtg

SEQ ID NO: 61167 - DNA, 42 bp, Homo sapiens
ccactactctgatcgttttttcactgacccggtgaggcgggg

SEQ ID NO: 61168 - DNA, 46 bp, Homo sapiens
ccactactctgatcgttttttcactgacccggtgaggcgggggggc

SEQ ID NO: 61169 - DNA, 36 bp, Homo sapiens; identical to SEQ ID NO: 26331

SEQ ID NO: 61170 - DNA, 37 bp, Homo sapiens; identical to SEQ ID NO: 26332

SEQ ID NO: 61171 - DNA, 38 bp, Homo sapiens; identical to SEQ ID NO: 26333

SEQ ID NO: 61172 - DNA, 39 bp, Homo sapiens; identical to SEQ ID NO: 26334

SEQ ID NO: 61173 - DNA, 40 bp, Homo sapiens; identical to SEQ ID NO: 26335

SEQ ID NO: 61174 - DNA, 35 bp, Homo sapiens; identical to SEQ ID NO: 26342

SEQ ID NO: 61175 - DNA, 36 bp, Homo sapiens; identical to SEQ ID NO: 26343

SEQ ID NO: 61176 - DNA, 37 bp, Homo sapiens; identical to SEQ ID NO: 26344

SEQ ID NO: 61177 - DNA, 38 bp, Homo sapiens; identical to SEQ ID NO: 26345

SEQ ID NO: 61178 - DNA, 39 bp, Homo sapiens; identical to SEQ ID NO: 26346

SEQ ID NO: 61179 - DNA, 25 bp, Homo sapiens
ccgaggggctctcgcttctggcgcc

SEQ ID NO: 61180 - DNA, 33 bp, Homo sapiens; identical to SEQ ID NO: 5879

SEQ ID NO: 61181 - DNA, 34 bp, Homo sapiens; identical to SEQ ID NO: 26359

SEQ ID NO: 61182 - DNA, 36 bp, Homo sapiens; identical to SEQ ID NO: 26361

SEQ ID NO: 61183 - DNA, 37 bp, Homo sapiens; identical to SEQ ID NO: 26362

SEQ ID NO: 61184 - DNA, 36 bp, Homo sapiens; identical to SEQ ID NO: 26369

SEQ ID NO: 61185 - DNA, 35 bp, Homo sapiens; identical to SEQ ID NO: 26374

SEQ ID NO: 61186 - DNA, 36 bp, Homo sapiens; identical to SEQ ID NO: 26375

SEQ ID NO: 61187 - DNA, 33 bp, Homo sapiens; identical to SEQ ID NO: 5885

SEQ ID NO: 61188 - DNA, 34 bp, Homo sapiens; identical to SEQ ID NO: 26382

SEQ ID NO: 61189 - DNA, 35 bp, Homo sapiens; identical to SEQ ID NO: 26383

SEQ ID NO: 61190 - DNA, 36 bp, Homo sapiens; identical to SEQ ID NO: 58128

SEQ ID NO: 61191 - DNA, 33 bp, Homo sapiens; identical to SEQ ID NO: 5886

SEQ ID NO: 61192 - DNA, 34 bp, Homo sapiens; identical to SEQ ID NO: 58130

SEQ ID NO: 61193 - DNA, 32 bp, Homo sapiens
gggctctcgcttctggcgccaagcgcccggcc

SEQ ID NO: 61194 - DNA, 26 bp, Homo sapiens
gctctcgcttctggcgccaagcgccc

SEQ ID NO: 61195 - DNA, 27 bp, Homo sapiens
gctctcgcttctggcgccaagcgcccg

SEQ ID NO: 61196 - DNA, 28 bp, Homo sapiens
gctctcgcttctggcgccaagcgcccgg

SEQ ID NO: 61197 - DNA, 29 bp, Homo sapiens
gctctcgcttctggcgccaagcgcccggc

SEQ ID NO: 61198 - DNA, 30 bp, Homo sapiens; identical to SEQ ID NO: 26397

SEQ ID NO: 61199 - DNA, 31 bp, Homo sapiens
gctctcgcttctggcgccaagcgcccggccg

SEQ ID NO: 61200 - DNA, 28 bp, Homo sapiens
ctctcgcttctggcgccaagcgcccggc

SEQ ID NO: 61201 - DNA, 27 bp, Homo sapiens
tctcgcttctggcgccaagcgcccggc

SEQ ID NO: 61202 - DNA, 28 bp, Homo sapiens
tctcgcttctggcgccaagcgcccggcc

SEQ ID NO: 61203 - DNA, 25 bp, Homo sapiens
ctcgcttctggcgccaagcgcccgg

SEQ ID NO: 61204 - DNA, 26 bp, Homo sapiens
ctcgcttctggcgccaagcgcccggc

SEQ ID NO: 61205 - DNA, 27 bp, Homo sapiens
ctcgcttctggcgccaagcgcccggcc

SEQ ID NO: 61206 - DNA, 24 bp, Homo sapiens
cgcttctggcgccaagcgcccggc

SEQ ID NO: 61207 - DNA, 21 bp, Homo sapiens
tctggcgccaagcgcccggcc

SEQ ID NO: 61208 - DNA, 22 bp, Homo sapiens
tctggcgccaagcgcccggccg

SEQ ID NO: 61209 - DNA, 19 bp, Homo sapiens
tggcgccaagcgcccggcc

SEQ ID NO: 61210 - DNA, 20 bp, Homo sapiens
tggcgccaagcgcccggccg

SEQ ID NO: 61211 - DNA, 23 bp, Homo sapiens
cgcccggccgcgcgccggccggg

SEQ ID NO: 61212 - DNA, 18 bp, Homo sapiens
gcgcgccggccgggcgcg

SEQ ID NO: 61213 - DNA, 18 bp, Homo sapiens
cggccgggcgcgacccgc

SEQ ID NO: 61214 - DNA, 24 bp, Homo sapiens
cggccgggcgcgacccgctccggg

SEQ ID NO: 61215 - DNA, 27 bp, Homo sapiens
cggccgggcgcgacccgctccggggac

SEQ ID NO: 61216 - DNA, 22 bp, Homo sapiens
cgggcgcgacccgctccgggga

SEQ ID NO: 61217 - DNA, 21 bp, Homo sapiens
aggacagaaacctcccgtgga

SEQ ID NO: 61218 - DNA, 21 bp, Homo sapiens
aaagctcgcttgatcttgatt

SEQ ID NO: 61219 - DNA, 18 bp, Homo sapiens
cgacgtcgctttttgatc

SEQ ID NO: 61220 - DNA, 31 bp, Homo sapiens
gacgtcgctttttgatccttcgatgtcggct

SEQ ID NO: 61221 - DNA, 19 bp, Homo sapiens
tgatccttcgatgtcggct

SEQ ID NO: 61222 - DNA, 16 bp, Homo sapiens
cttcgatgtcggctct

SEQ ID NO: 61223 - DNA, 19 bp, Homo sapiens
cttcgatgtcggctcttcc

SEQ ID NO: 61224 - DNA, 20 bp, Homo sapiens
cttcgatgtcggctcttcct

SEQ ID NO: 61225 - DNA, 19 bp, Homo sapiens
ttcgatgtcggctcttcct

SEQ ID NO: 61226 - DNA, 39 bp, Homo sapiens; identical to SEQ ID NO: 27078

SEQ ID NO: 61227 - DNA, 38 bp, Homo sapiens; identical to SEQ ID NO: 27092

SEQ ID NO: 61228 - DNA, 39 bp, Homo sapiens; identical to SEQ ID NO: 27093

SEQ ID NO: 61229 - DNA, 38 bp, Homo sapiens; identical to SEQ ID NO: 27105

SEQ ID NO: 61230 - DNA, 33 bp, Homo sapiens; identical to SEQ ID NO: 6118

SEQ ID NO: 61231 - DNA, 36 bp, Homo sapiens; identical to SEQ ID NO: 27112

SEQ ID NO: 61232 - DNA, 37 bp, Homo sapiens; identical to SEQ ID NO: 27113

SEQ ID NO: 61233 - DNA, 24 bp, Homo sapiens
gaattcaccaagcgttggattgtt

SEQ ID NO: 61234 - DNA, 28 bp, Homo sapiens
gaattcaccaagcgttggattgttcacc

SEQ ID NO: 61235 - DNA, 29 bp, Homo sapiens
gaattcaccaagcgttggattgttcaccc

SEQ ID NO: 61236 - DNA, 30 bp, Homo sapiens; identical to SEQ ID NO: 6142

SEQ ID NO: 61237 - DNA, 27 bp, Homo sapiens
aattcaccaagcgttggattgttcacc

SEQ ID NO: 61238 - DNA, 28 bp, Homo sapiens
aattcaccaagcgttggattgttcaccc

SEQ ID NO: 61239 - DNA, 26 bp, Homo sapiens
attcaccaagcgttggattgttcacc

SEQ ID NO: 61240 - DNA, 27 bp, Homo sapiens
attcaccaagcgttggattgttcaccc

SEQ ID NO: 61241 - DNA, 24 bp, Homo sapiens
tcaccaagcgttggattgttcacc

SEQ ID NO: 61242 - DNA, 25 bp, Homo sapiens
tcaccaagcgttggattgttcaccc

SEQ ID NO: 61243 - DNA, 28 bp, Homo sapiens
tcaccaagcgttggattgttcacccact

SEQ ID NO: 61244 - DNA, 19 bp, Homo sapiens
caccaagcgttggattgtt

SEQ ID NO: 61245 - DNA, 23 bp, Homo sapiens
caccaagcgttggattgttcacc

SEQ ID NO: 61246 - DNA, 24 bp, Homo sapiens
caccaagcgttggattgttcaccc

SEQ ID NO: 61247 - DNA, 27 bp, Homo sapiens
caccaagcgttggattgttcacccact

SEQ ID NO: 61248 - DNA, 22 bp, Homo sapiens
accaagcgttggattgttcacc

SEQ ID NO: 61249 - DNA, 23 bp, Homo sapiens
accaagcgttggattgttcaccc

SEQ ID NO: 61250 - DNA, 26 bp, Homo sapiens
accaagcgttggattgttcacccact

SEQ ID NO: 61251 - DNA, 21 bp, Homo sapiens
ccaagcgttggattgttcacc

SEQ ID NO: 61252 - DNA, 22 bp, Homo sapiens
ccaagcgttggattgttcaccc

SEQ ID NO: 61253 - DNA, 19 bp, Homo sapiens
aagcgttggattgttcacc

SEQ ID NO: 61254 - DNA, 20 bp, Homo sapiens
aagcgttggattgttcaccc

SEQ ID NO: 61255 - DNA, 21 bp, Homo sapiens
aagcgttggattgttcaccca

SEQ ID NO: 61256 - DNA, 23 bp, Homo sapiens
aagcgttggattgttcacccact

SEQ ID NO: 61257 - DNA, 19 bp, Homo sapiens
agcgttggattgttcaccc

SEQ ID NO: 61258 - DNA, 19 bp, Homo sapiens
gttggattgttcacccact

SEQ ID NO: 61259 - DNA, 18 bp, Homo sapiens
ttggattgttcacccact

SEQ ID NO: 61260 - DNA, 16 bp, Homo sapiens
aaccgcaggttcagac

SEQ ID NO: 61261 - DNA, 37 bp, Homo sapiens; identical to SEQ ID NO: 27564

SEQ ID NO: 61262 - DNA, 21 bp, Homo sapiens
accatctgtgggattatgact

SEQ ID NO: 61263 - DNA, 23 bp, Homo sapiens
accatctgtgggattatgactga

SEQ ID NO: 61264 - DNA, 28 bp, Homo sapiens
accatctgtgggattatgactgaacgcc

SEQ ID NO: 61265 - DNA, 29 bp, Homo sapiens
accatctgtgggattatgactgaacgcct

SEQ ID NO: 61266 - DNA, 27 bp, Homo sapiens
catctgtgggattatgactgaacgcct

SEQ ID NO: 61267 - DNA, 25 bp, Homo sapiens
tctgtgggattatgactgaacgcct

SEQ ID NO: 61268 - DNA, 22 bp, Homo sapiens
tgtgggattatgactgaacgcc

SEQ ID NO: 61269 - DNA, 23 bp, Homo sapiens
tgtgggattatgactgaacgcct

SEQ ID NO: 61270 - DNA, 25 bp, Homo sapiens
tgtgggattatgactgaacgcctct

SEQ ID NO: 61271 - DNA, 19 bp, Homo sapiens
gtgggattatgactgaacg

SEQ ID NO: 61272 - DNA, 21 bp, Homo sapiens
gtgggattatgactgaacgcc

SEQ ID NO: 61273 - DNA, 22 bp, Homo sapiens
gtgggattatgactgaacgcct

SEQ ID NO: 61274 - DNA, 19 bp, Homo sapiens
gggattatgactgaacgcc

SEQ ID NO: 61275 - DNA, 20 bp, Homo sapiens
gggattatgactgaacgcct

SEQ ID NO: 61276 - DNA, 18 bp, Homo sapiens
cccgcccaggcggaacga

SEQ ID NO: 61277 - DNA, 43 bp, Homo sapiens
ggcagcgccgcggagcctcggttggcctcggatagccggtccc

SEQ ID NO: 61278 - DNA, 40 bp, Homo sapiens; identical to SEQ ID NO: 27768

SEQ ID NO: 61279 - DNA, 41 bp, Homo sapiens; identical to SEQ ID NO: 58141

SEQ ID NO: 61280 - DNA, 42 bp, Homo sapiens; identical to SEQ ID NO: 58142

SEQ ID NO: 61281 - DNA, 43 bp, Homo sapiens
gcagcgccgcggagcctcggttggcctcggatagccggtcccc

SEQ ID NO: 61282 - DNA, 44 bp, Homo sapiens; identical to SEQ ID NO: 58143

SEQ ID NO: 61283 - DNA, 46 bp, Homo sapiens; identical to SEQ ID NO: 58144

SEQ ID NO: 61284 - DNA, 47 bp, Homo sapiens; identical to SEQ ID NO: 58145

SEQ ID NO: 61285 - DNA, 39 bp, Homo sapiens; identical to SEQ ID NO: 27772

SEQ ID NO: 61286 - DNA, 40 bp, Homo sapiens; identical to SEQ ID NO: 58147

SEQ ID NO: 61287 - DNA, 41 bp, Homo sapiens; identical to SEQ ID NO: 58148

SEQ ID NO: 61288 - DNA, 42 bp, Homo sapiens; identical to SEQ ID NO: 58149

SEQ ID NO: 61289 - DNA, 43 bp, Homo sapiens; identical to SEQ ID NO: 58150

SEQ ID NO: 61290 - DNA, 44 bp, Homo sapiens; identical to SEQ ID NO: 58151

SEQ ID NO: 61291 - DNA, 45 bp, Homo sapiens; identical to SEQ ID NO: 58152

SEQ ID NO: 61292 - DNA, 46 bp, Homo sapiens; identical to SEQ ID NO: 58153

SEQ ID NO: 61293 - DNA, 42 bp, Homo sapiens; identical to SEQ ID NO: 58154

SEQ ID NO: 61294 - DNA, 21 bp, Homo sapiens
gcggagcctcggttggcctcg

SEQ ID NO: 61295 - DNA, 36 bp, Homo sapiens; identical to SEQ ID NO: 27809

SEQ ID NO: 61296 - DNA, 30 bp, Homo sapiens; identical to SEQ ID NO: 6334

SEQ ID NO: 61297 - DNA, 35 bp, Homo sapiens; identical to SEQ ID NO: 58157

SEQ ID NO: 61298 - DNA, 36 bp, Homo sapiens; identical to SEQ ID NO: 58158

SEQ ID NO: 61299 - DNA, 37 bp, Homo sapiens; identical to SEQ ID NO: 58159

SEQ ID NO: 61300 - DNA, 29 bp, Homo sapiens
gagcctcggttggcctcggatagccggtc

SEQ ID NO: 61301 - DNA, 31 bp, Homo sapiens; identical to SEQ ID NO: 27824

SEQ ID NO: 61302 - DNA, 32 bp, Homo sapiens; identical to SEQ ID NO: 58162

SEQ ID NO: 61303 - DNA, 33 bp, Homo sapiens; identical to SEQ ID NO: 58163

SEQ ID NO: 61304 - DNA, 34 bp, Homo sapiens; identical to SEQ ID NO: 27825

SEQ ID NO: 61305 - DNA, 35 bp, Homo sapiens; identical to SEQ ID NO: 58165

SEQ ID NO: 61306 - DNA, 36 bp, Homo sapiens; identical to SEQ ID NO: 58166

SEQ ID NO: 61307 - DNA, 30 bp, Homo sapiens; identical to SEQ ID NO: 27830

SEQ ID NO: 61308 - DNA, 31 bp, Homo sapiens; identical to SEQ ID NO: 58168

SEQ ID NO: 61309 - DNA, 32 bp, Homo sapiens; identical to SEQ ID NO: 58169

SEQ ID NO: 61310 - DNA, 33 bp, Homo sapiens; identical to SEQ ID NO: 6337

SEQ ID NO: 61311 - DNA, 34 bp, Homo sapiens; identical to SEQ ID NO: 58171

SEQ ID NO: 61312 - DNA, 35 bp, Homo sapiens; identical to SEQ ID NO: 58172

SEQ ID NO: 61313 - DNA, 16 bp, Homo sapiens
tgtccccgccggcggg

SEQ ID NO: 61314 - DNA, 17 bp, Homo sapiens
tgtccccgccggcgggc

SEQ ID NO: 61315 - DNA, 21 bp, Homo sapiens
tgtccccgccggcgggccgcc

SEQ ID NO: 61316 - DNA, 22 bp, Homo sapiens
tgtccccgccggcgggccgccc

SEQ ID NO: 61317 - DNA, 20 bp, Homo sapiens
gtccccgccggcgggccgcc

SEQ ID NO: 61318 - DNA, 18 bp, Homo sapiens
ccccgccggcgggccgcc

SEQ ID NO: 61319 - DNA, 19 bp, Homo sapiens
ccccgccggcgggccgccc

SEQ ID NO: 61320 - DNA, 20 bp, Homo sapiens
ccccgccggcgggccgcccc

SEQ ID NO: 61321 - DNA, 21 bp, Homo sapiens
ccccgccggcgggccgccccc

SEQ ID NO: 61322 - DNA, 22 bp, Homo sapiens
ccccgccggcgggccgcccccc

SEQ ID NO: 61323 - DNA, 23 bp, Homo sapiens
ccccgccggcgggccgccccccc

SEQ ID NO: 61324 - DNA, 24 bp, Homo sapiens
ccccgccggcgggccgcccccccc

SEQ ID NO: 61325 - DNA, 17 bp, Homo sapiens
cccgccggcgggccgcc

SEQ ID NO: 61326 - DNA, 18 bp, Homo sapiens
cccgccggcgggccgccc

SEQ ID NO: 61327 - DNA, 19 bp, Homo sapiens
cccgccggcgggccgcccc

SEQ ID NO: 61328 - DNA, 20 bp, Homo sapiens
cccgccggcgggccgccccc

SEQ ID NO: 61329 - DNA, 21 bp, Homo sapiens
cccgccggcgggccgcccccc

SEQ ID NO: 61330 - DNA, 22 bp, Homo sapiens
cccgccggcgggccgccccccc

SEQ ID NO: 61331 - DNA, 23 bp, Homo sapiens
cccgccggcgggccgcccccccc

SEQ ID NO: 61332 - DNA, 24 bp, Homo sapiens
cccgccggcgggccgcccccccct

SEQ ID NO: 61333 - DNA, 33 bp, Homo sapiens
cccgccggcgggccgcccccccctccacgcgcc

SEQ ID NO: 61334 - DNA, 16 bp, Homo sapiens
ccgccggcgggccgcc

SEQ ID NO: 61335 - DNA, 17 bp, Homo sapiens
ccgccggcgggccgccc

SEQ ID NO: 61336 - DNA, 18 bp, Homo sapiens
ccgccggcgggccgcccc

SEQ ID NO: 61337 - DNA, 19 bp, Homo sapiens
ccgccggcgggccgccccc

SEQ ID NO: 61338 - DNA, 20 bp, Homo sapiens
ccgccggcgggccgcccccc

SEQ ID NO: 61339 - DNA, 21 bp, Homo sapiens
ccgccggcgggccgccccccc

SEQ ID NO: 61340 - DNA, 22 bp, Homo sapiens
ccgccggcgggccgcccccccc

SEQ ID NO: 61341 - DNA, 16 bp, Homo sapiens
cgccggcgggccgccc

SEQ ID NO: 61342 - DNA, 17 bp, Homo sapiens
cgccggcgggccgcccc

SEQ ID NO: 61343 - DNA, 18 bp, Homo sapiens
cgccggcgggccgccccc

SEQ ID NO: 61344 - DNA, 19 bp, Homo sapiens
cgccggcgggccgcccccc

SEQ ID NO: 61345 - DNA, 20 bp, Homo sapiens
cgccggcgggccgccccccc

SEQ ID NO: 61346 - DNA, 21 bp, Homo sapiens
cgccggcgggccgcccccccc

SEQ ID NO: 61347 - DNA, 22 bp, Homo sapiens
cgccccgcgcgcgcgggagggc

SEQ ID NO: 61348 - DNA, 20 bp, Homo sapiens
ccccgcgcgcgcgggagggc

SEQ ID NO: 61349 - DNA, 23 bp, Homo sapiens
ccccgcgcgcgcgggagggcgcg

SEQ ID NO: 61350 - DNA, 21 bp, Homo sapiens
cccgcgcgcgcgggagggcgc

SEQ ID NO: 61351 - DNA, 22 bp, Homo sapiens
cccgcgcgcgcgggagggcgcg

SEQ ID NO: 61352 - DNA, 20 bp, Homo sapiens
cgcgcgcgcgggagggcgcg

SEQ ID NO: 61353 - DNA, 28 bp, Homo sapiens
cgcgcgggagggcgcgtgccccgccgcg

SEQ ID NO: 61354 - DNA, 20 bp, Homo sapiens
ccccgccgcgcgccgggacc

SEQ ID NO: 61355 - DNA, 24 bp, Homo sapiens
ccccgccgcgcgccgggaccgggg

SEQ ID NO: 61356 - DNA, 29 bp, Homo sapiens
ccccgccgcgcgccgggaccggggtccgg

SEQ ID NO: 61357 - DNA, 33 bp, Homo sapiens
ccccgccgcgcgccgggaccggggtccggtgcg

SEQ ID NO: 61358 - DNA, 35 bp, Homo sapiens
ccccgccgcgcgccgggaccggggtccggtgcgga

SEQ ID NO: 61359 - DNA, 22 bp, Homo sapiens
cccgccgcgcgccgggaccggg

SEQ ID NO: 61360 - DNA, 23 bp, Homo sapiens
cccgccgcgcgccgggaccgggg

SEQ ID NO: 61361 - DNA, 28 bp, Homo sapiens
cccgccgcgcgccgggaccggggtccgg

SEQ ID NO: 61362 - DNA, 21 bp, Homo sapiens
cgccgcgcgccgggaccgggg

SEQ ID NO: 61363 - DNA, 40 bp, Homo sapiens
cgccgggaccggggtccggtgcggagtgcccttcgtcctg

SEQ ID NO: 61364 - DNA, 39 bp, Homo sapiens
gccgggaccggggtccggtgcggagtgcccttcgtcctg

SEQ ID NO: 61365 - DNA, 32 bp, Homo sapiens; identical to SEQ ID NO: 27948

SEQ ID NO: 61366 - DNA, 31 bp, Homo sapiens; identical to SEQ ID NO: 27949

SEQ ID NO: 61367 - DNA, 27 bp, Homo sapiens
gtccggtgcggagtgcccttcgtcctg

SEQ ID NO: 61368 - DNA, 39 bp, Homo sapiens; identical to SEQ ID NO: 58207

SEQ ID NO: 61369 - DNA, 36 bp, Homo sapiens
cctcgcccgtcacgcaccgcacgttcgtggggaacc

SEQ ID NO: 61370 - DNA, 37 bp, Homo sapiens
cctcgcccgtcacgcaccgcacgttcgtggggaacct

SEQ ID NO: 61371 - DNA, 38 bp, Homo sapiens
cctcgcccgtcacgcaccgcacgttcgtggggaacctg

SEQ ID NO: 61372 - DNA, 37 bp, Homo sapiens
ctcgcccgtcacgcaccgcacgttcgtggggaacctg

SEQ ID NO: 61373 - DNA, 18 bp, Homo sapiens
gcacgttcgtggggaacc

SEQ ID NO: 61374 - DNA, 25 bp, Homo sapiens
gcacgttcgtggggaacctggcgct

SEQ ID NO: 61375 - DNA, 22 bp, Homo sapiens
cgttcgtggggaacctggcgct

SEQ ID NO: 61376 - DNA, 21 bp, Homo sapiens
gttcgtggggaacctggcgct

SEQ ID NO: 61377 - DNA, 20 bp, Homo sapiens
ttcgtggggaacctggcgct

SEQ ID NO: 61378 - DNA, 31 bp, Homo sapiens; identical to SEQ ID NO: 28119

SEQ ID NO: 61379 - DNA, 30 bp, Homo sapiens; identical to SEQ ID NO: 56331

SEQ ID NO: 61380 - DNA, 28 bp, Homo sapiens
cgctaaaccattcgtagacgacctgctt

SEQ ID NO: 61381 - DNA, 29 bp, Homo sapiens
cgctaaaccattcgtagacgacctgcttc

SEQ ID NO: 61382 - DNA, 27 bp, Homo sapiens
gctaaaccattcgtagacgacctgctt

SEQ ID NO: 61383 - DNA, 28 bp, Homo sapiens
gctaaaccattcgtagacgacctgcttc

SEQ ID NO: 61384 - DNA, 26 bp, Homo sapiens
taaaccattcgtagacgacctgcttc

SEQ ID NO: 61385 - DNA, 16 bp, Homo sapiens
aaaccattcgtagacg

SEQ ID NO: 61386 - DNA, 17 bp, Homo sapiens
aaaccattcgtagacga

SEQ ID NO: 61387 - DNA, 18 bp, Homo sapiens
aaaccattcgtagacgac

SEQ ID NO: 61388 - DNA, 24 bp, Homo sapiens
aaaccattcgtagacgacctgctt

SEQ ID NO: 61389 - DNA, 25 bp, Homo sapiens
aaaccattcgtagacgacctgcttc

SEQ ID NO: 61390 - DNA, 23 bp, Homo sapiens
aaccattcgtagacgacctgctt

SEQ ID NO: 61391 - DNA, 24 bp, Homo sapiens
aaccattcgtagacgacctgcttc

SEQ ID NO: 61392 - DNA, 22 bp, Homo sapiens
accattcgtagacgacctgctt

SEQ ID NO: 61393 - DNA, 23 bp, Homo sapiens
accattcgtagacgacctgcttc

SEQ ID NO: 61394 - DNA, 20 bp, Homo sapiens
attcgtagacgacctgcttc

SEQ ID NO: 61395 - DNA, 35 bp, Homo sapiens; identical to SEQ ID NO: 28251

SEQ ID NO: 61396 - DNA, 36 bp, Homo sapiens; identical to SEQ ID NO: 28252

SEQ ID NO: 61397 - DNA, 34 bp, Homo sapiens; identical to SEQ ID NO: 28264

SEQ ID NO: 61398 - DNA, 35 bp, Homo sapiens; identical to SEQ ID NO: 28265

SEQ ID NO: 61399 - DNA, 36 bp, Homo sapiens; identical to SEQ ID NO: 28266

SEQ ID NO: 61400 - DNA, 53 bp, Homo sapiens
gcagctccctcgctgcgatctattgaaagtcagccctcgacacaagggtttgt

SEQ ID NO: 61401 - DNA, 38 bp, Homo sapiens
ccctcgctgcgatctattgaaagtcagccctcgacaca

SEQ ID NO: 61402 - DNA, 47 bp, Homo sapiens; identical to SEQ ID NO: 58223

SEQ ID NO: 61403 - DNA, 46 bp, Homo sapiens; identical to SEQ ID NO: 28404

SEQ ID NO: 61404 - DNA, 36 bp, Homo sapiens; identical to SEQ ID NO: 28409

SEQ ID NO: 61405 - DNA, 44 bp, Homo sapiens; identical to SEQ ID NO: 28412

SEQ ID NO: 61406 - DNA, 45 bp, Homo sapiens; identical to SEQ ID NO: 28413

SEQ ID NO: 61407 - DNA, 35 bp, Homo sapiens; identical to SEQ ID NO: 58227

SEQ ID NO: 61408 - DNA, 43 bp, Homo sapiens; identical to SEQ ID NO: 28424

SEQ ID NO: 61409 - DNA, 44 bp, Homo sapiens; identical to SEQ ID NO: 28425

SEQ ID NO: 61410 - DNA, 34 bp, Homo sapiens; identical to SEQ ID NO: 58230

SEQ ID NO: 61411 - DNA, 35 bp, Homo sapiens
cgctgcgatctattgaaagtcagccctcgacacaa

SEQ ID NO: 61412 - DNA, 36 bp, Homo sapiens
cgctgcgatctattgaaagtcagccctcgacacaag

SEQ ID NO: 61413 - DNA, 42 bp, Homo sapiens; identical to SEQ ID NO: 28436

SEQ ID NO: 61414 - DNA, 43 bp, Homo sapiens; identical to SEQ ID NO: 28437

SEQ ID NO: 61415 - DNA, 44 bp, Homo sapiens
cgctgcgatctattgaaagtcagccctcgacacaagggtttgtc

SEQ ID NO: 61416 - DNA, 33 bp, Homo sapiens; identical to SEQ ID NO: 58233

SEQ ID NO: 61417 - DNA, 41 bp, Homo sapiens; identical to SEQ ID NO: 28443

SEQ ID NO: 61418 - DNA, 42 bp, Homo sapiens; identical to SEQ ID NO: 28444

SEQ ID NO: 61419 - DNA, 41 bp, Homo sapiens
ctgcgatctattgaaagtcagccctcgacacaagggtttgt

SEQ ID NO: 61420 - DNA, 40 bp, Homo sapiens
tgcgatctattgaaagtcagccctcgacacaagggtttgt

SEQ ID NO: 61421 - DNA, 38 bp, Homo sapiens
gcgatctattgaaagtcagccctcgacacaagggtttg

SEQ ID NO: 61422 - DNA, 39 bp, Homo sapiens; identical to SEQ ID NO: 58236

SEQ ID NO: 61423 - DNA, 35 bp, Homo sapiens; identical to SEQ ID NO: 58237

SEQ ID NO: 61424 - DNA, 34 bp, Homo sapiens; identical to SEQ ID NO: 58238

SEQ ID NO: 61425 - DNA, 24 bp, Homo sapiens
tattgaaagtcagccctcgacaca

SEQ ID NO: 61426 - DNA, 26 bp, Homo sapiens
tattgaaagtcagccctcgacacaag

SEQ ID NO: 61427 - DNA, 32 bp, Homo sapiens; identical to SEQ ID NO: 6507

SEQ ID NO: 61428 - DNA, 33 bp, Homo sapiens; identical to SEQ ID NO: 6508

SEQ ID NO: 61429 - DNA, 34 bp, Homo sapiens
tattgaaagtcagccctcgacacaagggtttgtc

SEQ ID NO: 61430 - DNA, 23 bp, Homo sapiens
attgaaagtcagccctcgacaca

SEQ ID NO: 61431 - DNA, 31 bp, Homo sapiens; identical to SEQ ID NO: 6510

SEQ ID NO: 61432 - DNA, 32 bp, Homo sapiens; identical to SEQ ID NO: 6511

SEQ ID NO: 61433 - DNA, 31 bp, Homo sapiens; identical to SEQ ID NO: 6513

SEQ ID NO: 61434 - DNA, 28 bp, Homo sapiens
gaaagtcagccctcgacacaagggtttg

SEQ ID NO: 61435 - DNA, 29 bp, Homo sapiens
gaaagtcagccctcgacacaagggtttgt

SEQ ID NO: 61436 - DNA, 25 bp, Homo sapiens
gtcagccctcgacacaagggtttgt

SEQ ID NO: 61437 - DNA, 23 bp, Homo sapiens
cagccctcgacacaagggtttgt

SEQ ID NO: 61438 - DNA, 22 bp, Homo sapiens
agccctcgacacaagggtttgt

SEQ ID NO: 61439 - DNA, 19 bp, Homo sapiens
ccctcgacacaagggtttg

SEQ ID NO: 61440 - DNA, 20 bp, Homo sapiens
ccctcgacacaagggtttgt

SEQ ID NO: 61441 - DNA, 18 bp, Homo sapiens
cctcgacacaagggtttg

SEQ ID NO: 61442 - DNA, 19 bp, Homo sapiens
cctcgacacaagggtttgt

SEQ ID NO: 61443 - DNA, 17 bp, Homo sapiens
ctcgacacaagggtttg

SEQ ID NO: 61444 - DNA, 18 bp, Homo sapiens
ctcgacacaagggtttgt

SEQ ID NO: 61445 - DNA, 16 bp, Homo sapiens
tcgacacaagggtttg

SEQ ID NO: 61446 - DNA, 17 bp, Homo sapiens
tcgacacaagggtttgt

SEQ ID NO: 61447 - DNA, 16 bp, Homo sapiens
cgacacaagggtttgt

SEQ ID NO: 61448 - DNA, 20 bp, Homo sapiens
gtctacggccataccaccct

SEQ ID NO: 61449 - DNA, 22 bp, Homo sapiens
gtctacggccataccaccctga

SEQ ID NO: 61450 - DNA, 23 bp, Homo sapiens
gtctacggccataccaccctgaa

SEQ ID NO: 61451 - DNA, 24 bp, Homo sapiens
gtctacggccataccaccctgaac

SEQ ID NO: 61452 - DNA, 25 bp, Homo sapiens
gtctacggccataccaccctgaacg

SEQ ID NO: 61453 - DNA, 27 bp, Homo sapiens
gtctacggccataccaccctgaacgcg

SEQ ID NO: 61454 - DNA, 29 bp, Homo sapiens
gtctacggccataccaccctgaacgcgcc

SEQ ID NO: 61455 - DNA, 32 bp, Homo sapiens; identical to SEQ ID NO: 10

SEQ ID NO: 61456 - DNA, 33 bp, Homo sapiens; identical to SEQ ID NO: 11

SEQ ID NO: 61457 - DNA, 34 bp, Homo sapiens; identical to SEQ ID NO: 6542

SEQ ID NO: 61458 - DNA, 35 bp, Homo sapiens; identical to SEQ ID NO: 6543

SEQ ID NO: 61459 - DNA, 37 bp, Homo sapiens; identical to SEQ ID NO: 6545

SEQ ID NO: 61460 - DNA, 38 bp, Homo sapiens; identical to SEQ ID NO: 6546

SEQ ID NO: 61461 - DNA, 39 bp, Homo sapiens; identical to SEQ ID NO: 6547

SEQ ID NO: 61462 - DNA, 42 bp, Homo sapiens; identical to SEQ ID NO: 6550

SEQ ID NO: 61463 - DNA, 29 bp, Homo sapiens
ataccaccctgaacgcgcccgatctcgtc

SEQ ID NO: 61464 - DNA, 24 bp, Homo sapiens
accctgaacgcgcccgatctcgtc

SEQ ID NO: 61465 - DNA, 40 bp, Homo sapiens
ctgaacgcgcccgatctcgtctgatctcggaagctaagca

SEQ ID NO: 61466 - DNA, 27 bp, Homo sapiens
cagggtcgggcctggttagtacttgga

SEQ ID NO: 61467 - DNA, 26 bp, Homo sapiens
agggtcgggcctggttagtacttgga

SEQ ID NO: 61468 - DNA, 16 bp, Homo sapiens
tggatgggagaccgcc

SEQ ID NO: 61469 - DNA, 35 bp, Homo sapiens; identical to SEQ ID NO: 56898

SEQ ID NO: 61470 - DNA, 30 bp, Homo sapiens; identical to SEQ ID NO: 7014

SEQ ID NO: 61471 - DNA, 28 bp, Homo sapiens
gcctgggaataccgggtgctgtaggctt

SEQ ID NO: 61472 - DNA, 29 bp, Homo sapiens
gcctgggaataccgggtgctgtaggcttt

SEQ ID NO: 61473 - DNA, 32 bp, Homo sapiens; identical to SEQ ID NO: 215

SEQ ID NO: 61474 - DNA, 35 bp, Homo sapiens
aaagctaaaactcacctgagttgtaaaaaactcca

SEQ ID NO: 61475 - DNA, 32 bp, Homo sapiens
ctcacctgagttgtaaaaaactccagttgaca

SEQ ID NO: 61476 - DNA, 36 bp, Homo sapiens
tgacacaaaatagactacgaaagtggctttaacata

SEQ ID NO: 61477 - DNA, 37 bp, Homo sapiens
acaatagctaagacccaaactgggattagatacccca

SEQ ID NO: 61478 - DNA, 19 bp, Homo sapiens
ggacatttaactaaaaccc

SEQ ID NO: 61479 - DNA, 18 bp, Homo sapiens
gacatttaactaaaaccc

SEQ ID NO: 61480 - DNA, 19 bp, Homo sapiens
gacatttaactaaaacccc

SEQ ID NO: 61481 - DNA, 20 bp, Homo sapiens
gacatttaactaaaacccct

SEQ ID NO: 61482 - DNA, 21 bp, Homo sapiens
gacatttaactaaaaccccta

SEQ ID NO: 61483 - DNA, 31 bp, Homo sapiens
ggtaagtgtactggaaagtgcacttggacga

SEQ ID NO: 61484 - DNA, 16 bp, Homo sapiens
gctaaacctagcccca

SEQ ID NO: 61485 - DNA, 19 bp, Homo sapiens
gctaaacctagccccaaac

SEQ ID NO: 61486 - DNA, 20 bp, Homo sapiens
gctaaacctagccccaaacc

SEQ ID NO: 61487 - DNA, 21 bp, Homo sapiens
gctaaacctagccccaaaccc

SEQ ID NO: 61488 - DNA, 22 bp, Homo sapiens
gctaaacctagccccaaaccca

SEQ ID NO: 61489 - DNA, 23 bp, Homo sapiens
gctaaacctagccccaaacccac

SEQ ID NO: 61490 - DNA, 24 bp, Homo sapiens
gctaaacctagccccaaacccact

SEQ ID NO: 61491 - DNA, 25 bp, Homo sapiens
gctaaacctagccccaaacccactc

SEQ ID NO: 61492 - DNA, 26 bp, Homo sapiens
gctaaacctagccccaaacccactcc

SEQ ID NO: 61493 - DNA, 27 bp, Homo sapiens
gctaaacctagccccaaacccactcca

SEQ ID NO: 61494 - DNA, 28 bp, Homo sapiens
gctaaacctagccccaaacccactccac

SEQ ID NO: 61495 - DNA, 29 bp, Homo sapiens
gctaaacctagccccaaacccactccacc

SEQ ID NO: 61496 - DNA, 30 bp, Homo sapiens; identical to SEQ ID NO: 832

SEQ ID NO: 61497 - DNA, 31 bp, Homo sapiens; identical to SEQ ID NO: 833

SEQ ID NO: 61498 - DNA, 32 bp, Homo sapiens; identical to SEQ ID NO: 834

SEQ ID NO: 61499 - DNA, 33 bp, Homo sapiens; identical to SEQ ID NO: 835

SEQ ID NO: 61500 - DNA, 34 bp, Homo sapiens; identical to SEQ ID NO: 8827

SEQ ID NO: 61501 - DNA, 35 bp, Homo sapiens; identical to SEQ ID NO: 8828

SEQ ID NO: 61502 - DNA, 36 bp, Homo sapiens; identical to SEQ ID NO: 8829

SEQ ID NO: 61503 - DNA, 37 bp, Homo sapiens; identical to SEQ ID NO: 8830

SEQ ID NO: 61504 - DNA, 38 bp, Homo sapiens; identical to SEQ ID NO: 8831

SEQ ID NO: 61505 - DNA, 39 bp, Homo sapiens; identical to SEQ ID NO: 8832

SEQ ID NO: 61506 - DNA, 40 bp, Homo sapiens; identical to SEQ ID NO: 8833

SEQ ID NO: 61507 - DNA, 41 bp, Homo sapiens; identical to SEQ ID NO: 8834

SEQ ID NO: 61508 - DNA, 42 bp, Homo sapiens; identical to SEQ ID NO: 8835

SEQ ID NO: 61509 - DNA, 43 bp, Homo sapiens; identical to SEQ ID NO: 8836

SEQ ID NO: 61510 - DNA, 44 bp, Homo sapiens; identical to SEQ ID NO: 8837

SEQ ID NO: 61511 - DNA, 45 bp, Homo sapiens; identical to SEQ ID NO: 8838

SEQ ID NO: 61512 - DNA, 46 bp, Homo sapiens; identical to SEQ ID NO: 8839

SEQ ID NO: 61513 - DNA, 18 bp, Homo sapiens
actacctaaaaaatccca

SEQ ID NO: 61514 - DNA, 39 bp, Homo sapiens
aacatcacctctagcatcaccagtattagaggcaccgcc

SEQ ID NO: 61515 - DNA, 20 bp, Homo sapiens
ctagcatcaccagtattaga

SEQ ID NO: 61516 - DNA, 26 bp, Homo sapiens
ctagcatcaccagtattagaggcacc

SEQ ID NO: 61517 - DNA, 33 bp, Homo sapiens; identical to SEQ ID NO: 1528

SEQ ID NO: 61518 - DNA, 30 bp, Homo sapiens; identical to SEQ ID NO: 1532

SEQ ID NO: 61519 - DNA, 32 bp, Homo sapiens; identical to SEQ ID NO: 1534

SEQ ID NO: 61520 - DNA, 31 bp, Homo sapiens; identical to SEQ ID NO: 1538

SEQ ID NO: 61521 - DNA, 41 bp, Homo sapiens
taatgcaaacagtacctaacaaacccacaggtcctaaacta

SEQ ID NO: 61522 - DNA, 44 bp, Homo sapiens
taatgcaaacagtacctaacaaacccacaggtcctaaactacca

SEQ ID NO: 61523 - DNA, 40 bp, Homo sapiens
aatgcaaacagtacctaacaaacccacaggtcctaaacta

SEQ ID NO: 61524 - DNA, 33 bp, Homo sapiens
gtacctaacaaacccacaggtcctaaactacca

SEQ ID NO: 61525 - DNA, 22 bp, Homo sapiens
aacccacaggtcctaaactacc

SEQ ID NO: 61526 - DNA, 31 bp, Homo sapiens; identical to SEQ ID NO: 11252

SEQ ID NO: 61527 - DNA, 33 bp, Homo sapiens; identical to SEQ ID NO: 1669

SEQ ID NO: 61528 - DNA, 34 bp, Homo sapiens; identical to SEQ ID NO: 11254

SEQ ID NO: 61529 - DNA, 32 bp, Homo sapiens; identical to SEQ ID NO: 1672

SEQ ID NO: 61530 - DNA, 39 bp, Homo sapiens
agcagtacatgctaagacttcaccagtcaaagcgaacta

SEQ ID NO: 61531 - DNA, 36 bp, Homo sapiens
agtacatgctaagacttcaccagtcaaagcgaacta

SEQ ID NO: 61532 - DNA, 34 bp, Homo sapiens
gtacatgctaagacttcaccagtcaaagcgaact

SEQ ID NO: 61533 - DNA, 35 bp, Homo sapiens
gtacatgctaagacttcaccagtcaaagcgaacta

SEQ ID NO: 61534 - DNA, 29 bp, Homo sapiens
gaacaagttaccctagggataacagcgca

SEQ ID NO: 61535 - DNA, 32 bp, Homo sapiens
agtccatatcaacaatagggtttacgacctcg

SEQ ID NO: 61536 - DNA, 45 bp, Homo sapiens
agtccatatcaacaatagggtttacgacctcgatgttggatcagg

SEQ ID NO: 61537 - DNA, 25 bp, Homo sapiens
gctgacacgctgtcctctggcgacc

SEQ ID NO: 61538 - DNA, 26 bp, Homo sapiens
gctgacacgctgtcctctggcgacct

SEQ ID NO: 61539 - DNA, 27 bp, Homo sapiens
gctgacacgctgtcctctggcgacctg

SEQ ID NO: 61540 - DNA, 22 bp, Homo sapiens
cttcgtgatcgatgtggtgacg

SEQ ID NO: 61541 - DNA, 24 bp, Homo sapiens
cttcgtgatcgatgtggtgacgtc

SEQ ID NO: 61542 - DNA, 25 bp, Homo sapiens
cttcgtgatcgatgtggtgacgtcg

SEQ ID NO: 61543 - DNA, 27 bp, Homo sapiens
cttcgtgatcgatgtggtgacgtcgtg

SEQ ID NO: 61544 - DNA, 28 bp, Homo sapiens
cttcgtgatcgatgtggtgacgtcgtgc

SEQ ID NO: 61545 - DNA, 29 bp, Homo sapiens
cttcgtgatcgatgtggtgacgtcgtgct

SEQ ID NO: 61546 - DNA, 30 bp, Homo sapiens; identical to SEQ ID NO: 1878

SEQ ID NO: 61547 - DNA, 31 bp, Homo sapiens; identical to SEQ ID NO: 1879

SEQ ID NO: 61548 - DNA, 32 bp, Homo sapiens; identical to SEQ ID NO: 1880

SEQ ID NO: 61549 - DNA, 35 bp, Homo sapiens; identical to SEQ ID NO: 11915

SEQ ID NO: 61550 - DNA, 36 bp, Homo sapiens; identical to SEQ ID NO: 11916

SEQ ID NO: 61551 - DNA, 37 bp, Homo sapiens; identical to SEQ ID NO: 11917

SEQ ID NO: 61552 - DNA, 42 bp, Homo sapiens; identical to SEQ ID NO: 11922

SEQ ID NO: 61553 - DNA, 44 bp, Homo sapiens; identical to SEQ ID NO: 11924

SEQ ID NO: 61554 - DNA, 46 bp, Homo sapiens; identical to SEQ ID NO: 11926

SEQ ID NO: 61555 - DNA, 26 bp, Homo sapiens
ttcgtgatcgatgtggtgacgtcgtg

SEQ ID NO: 61556 - DNA, 28 bp, Homo sapiens
ttcgtgatcgatgtggtgacgtcgtgct

SEQ ID NO: 61557 - DNA, 30 bp, Homo sapiens; identical to SEQ ID NO: 1888

SEQ ID NO: 61558 - DNA, 35 bp, Homo sapiens; identical to SEQ ID NO: 11944

SEQ ID NO: 61559 - DNA, 45 bp, Homo sapiens; identical to SEQ ID NO: 11952

SEQ ID NO: 61560 - DNA, 16 bp, Homo sapiens
gatcgatgtggtgacg

SEQ ID NO: 61561 - DNA, 18 bp, Homo sapiens
gatcgatgtggtgacgtc

SEQ ID NO: 61562 - DNA, 19 bp, Homo sapiens
gatcgatgtggtgacgtcg

SEQ ID NO: 61563 - DNA, 21 bp, Homo sapiens
gatcgatgtggtgacgtcgtg

SEQ ID NO: 61564 - DNA, 23 bp, Homo sapiens
gatcgatgtggtgacgtcgtgct

SEQ ID NO: 61565 - DNA, 24 bp, Homo sapiens
gatcgatgtggtgacgtcgtgctc

SEQ ID NO: 61566 - DNA, 25 bp, Homo sapiens
gatcgatgtggtgacgtcgtgctct

SEQ ID NO: 61567 - DNA, 29 bp, Homo sapiens
gatcgatgtggtgacgtcgtgctctcccg

SEQ ID NO: 61568 - DNA, 30 bp, Homo sapiens; identical to SEQ ID NO: 1894

SEQ ID NO: 61569 - DNA, 38 bp, Homo sapiens; identical to SEQ ID NO: 11977

SEQ ID NO: 61570 - DNA, 40 bp, Homo sapiens; identical to SEQ ID NO: 11979

SEQ ID NO: 61571 - DNA, 41 bp, Homo sapiens; identical to SEQ ID NO: 11980

SEQ ID NO: 61572 - DNA, 42 bp, Homo sapiens; identical to SEQ ID NO: 11981

SEQ ID NO: 61573 - DNA, 45 bp, Homo sapiens
gatcgatgtggtgacgtcgtgctctcccgggccgggtccgagccg

SEQ ID NO: 61574 - DNA, 46 bp, Homo sapiens
gatcgatgtggtgacgtcgtgctctcccgggccgggtccgagccgc

SEQ ID NO: 61575 - DNA, 17 bp, Homo sapiens
atcgatgtggtgacgtc

SEQ ID NO: 61576 - DNA, 18 bp, Homo sapiens
atcgatgtggtgacgtcg

SEQ ID NO: 61577 - DNA, 20 bp, Homo sapiens
atcgatgtggtgacgtcgtg

SEQ ID NO: 61578 - DNA, 22 bp, Homo sapiens
atcgatgtggtgacgtcgtgct

SEQ ID NO: 61579 - DNA, 23 bp, Homo sapiens
atcgatgtggtgacgtcgtgctc

SEQ ID NO: 61580 - DNA, 24 bp, Homo sapiens
atcgatgtggtgacgtcgtgctct

SEQ ID NO: 61581 - DNA, 28 bp, Homo sapiens
atcgatgtggtgacgtcgtgctctcccg

SEQ ID NO: 61582 - DNA, 29 bp, Homo sapiens
atcgatgtggtgacgtcgtgctctcccgg

SEQ ID NO: 61583 - DNA, 30 bp, Homo sapiens; identical to SEQ ID NO: 1904

SEQ ID NO: 61584 - DNA, 35 bp, Homo sapiens; identical to SEQ ID NO: 12000

SEQ ID NO: 61585 - DNA, 37 bp, Homo sapiens; identical to SEQ ID NO: 12002

SEQ ID NO: 61586 - DNA, 38 bp, Homo sapiens; identical to SEQ ID NO: 12003

SEQ ID NO: 61587 - DNA, 39 bp, Homo sapiens; identical to SEQ ID NO: 12004

SEQ ID NO: 61588 - DNA, 40 bp, Homo sapiens; identical to SEQ ID NO: 12005

SEQ ID NO: 61589 - DNA, 41 bp, Homo sapiens; identical to SEQ ID NO: 12006

SEQ ID NO: 61590 - DNA, 42 bp, Homo sapiens; identical to SEQ ID NO: 12007

SEQ ID NO: 61591 - DNA, 43 bp, Homo sapiens; identical to SEQ ID NO: 12008

SEQ ID NO: 61592 - DNA, 44 bp, Homo sapiens; identical to SEQ ID NO: 12009

SEQ ID NO: 61593 - DNA, 45 bp, Homo sapiens; identical to SEQ ID NO: 12010

SEQ ID NO: 61594 - DNA, 46 bp, Homo sapiens; identical to SEQ ID NO: 12011

SEQ ID NO: 61595 - DNA, 16 bp, Homo sapiens
ccgctcgctccctccc

SEQ ID NO: 61596 - DNA, 17 bp, Homo sapiens
tacctggttgatcctgc

SEQ ID NO: 61597 - DNA, 18 bp, Homo sapiens
tacctggttgatcctgcc

SEQ ID NO: 61598 - DNA, 19 bp, Homo sapiens
tacctggttgatcctgcca

SEQ ID NO: 61599 - DNA, 21 bp, Homo sapiens
tacctggttgatcctgccagt

SEQ ID NO: 61600 - DNA, 22 bp, Homo sapiens
tacctggttgatcctgccagta

SEQ ID NO: 61601 - DNA, 24 bp, Homo sapiens
tacctggttgatcctgccagtagc

SEQ ID NO: 61602 - DNA, 25 bp, Homo sapiens
tacctggttgatcctgccagtagca

SEQ ID NO: 61603 - DNA, 26 bp, Homo sapiens
tacctggttgatcctgccagtagcat

SEQ ID NO: 61604 - DNA, 30 bp, Homo sapiens; identical to SEQ ID NO: 12067

SEQ ID NO: 61605 - DNA, 31 bp, Homo sapiens; identical to SEQ ID NO: 12068

SEQ ID NO: 61606 - DNA, 32 bp, Homo sapiens; identical to SEQ ID NO: 12069

SEQ ID NO: 61607 - DNA, 35 bp, Homo sapiens; identical to SEQ ID NO: 12071

SEQ ID NO: 61608 - DNA, 37 bp, Homo sapiens; identical to SEQ ID NO: 12073

SEQ ID NO: 61609 - DNA, 38 bp, Homo sapiens; identical to SEQ ID NO: 12074

SEQ ID NO: 61610 - DNA, 40 bp, Homo sapiens; identical to SEQ ID NO: 12075

SEQ ID NO: 61611 - DNA, 42 bp, Homo sapiens; identical to SEQ ID NO: 12077

SEQ ID NO: 61612 - DNA, 44 bp, Homo sapiens; identical to SEQ ID NO: 12079

SEQ ID NO: 61613 - DNA, 17 bp, Homo sapiens
acctggttgatcctgcc

SEQ ID NO: 61614 - DNA, 19 bp, Homo sapiens
cctggttgatcctgccagt

SEQ ID NO: 61615 - DNA, 18 bp, Homo sapiens
ggtacagtgaaactgcga

SEQ ID NO: 61616 - DNA, 24 bp, Homo sapiens
agttatggttcctttggtcgctcg

SEQ ID NO: 61617 - DNA, 33 bp, Homo sapiens
tcctttggtcgctcgctcctctcctacttggat

SEQ ID NO: 61618 - DNA, 20 bp, Homo sapiens
tggtcgctcgctcctctcct

SEQ ID NO: 61619 - DNA, 27 bp, Homo sapiens
tggtcgctcgctcctctcctacttgga

SEQ ID NO: 61620 - DNA, 43 bp, Homo sapiens; identical to SEQ ID NO: 12482

SEQ ID NO: 61621 - DNA, 41 bp, Homo sapiens
cctacttggataactgtggtaattctagagctaatacatgc

SEQ ID NO: 61622 - DNA, 42 bp, Homo sapiens; identical to SEQ ID NO: 12493

SEQ ID NO: 61623 - DNA, 43 bp, Homo sapiens; identical to SEQ ID NO: 57022

SEQ ID NO: 61624 - DNA, 44 bp, Homo sapiens; identical to SEQ ID NO: 57023

SEQ ID NO: 61625 - DNA, 44 bp, Homo sapiens
gcgggggggatgcgtgcatttatcagatcaaaaccaacccggtc

SEQ ID NO: 61626 - DNA, 18 bp, Homo sapiens
atcaaaaccaacccggtc

SEQ ID NO: 61627 - DNA, 22 bp, Homo sapiens
atcaaaaccaacccggtcagcc

SEQ ID NO: 61628 - DNA, 25 bp, Homo sapiens
atcaaaaccaacccggtcagcccct

SEQ ID NO: 61629 - DNA, 26 bp, Homo sapiens
atcaaaaccaacccggtcagcccctc

SEQ ID NO: 61630 - DNA, 27 bp, Homo sapiens
atcaaaaccaacccggtcagcccctct

SEQ ID NO: 61631 - DNA, 28 bp, Homo sapiens
atcaaaaccaacccggtcagcccctctc

SEQ ID NO: 61632 - DNA, 29 bp, Homo sapiens
atcaaaaccaacccggtcagcccctctcc

SEQ ID NO: 61633 - DNA, 30 bp, Homo sapiens; identical to SEQ ID NO: 12703

SEQ ID NO: 61634 - DNA, 16 bp, Homo sapiens
caaaaccaacccggtc

SEQ ID NO: 61635 - DNA, 26 bp, Homo sapiens
caaaaccaacccggtcagcccctctc

SEQ ID NO: 61636 - DNA, 27 bp, Homo sapiens
caaaaccaacccggtcagcccctctcc

SEQ ID NO: 61637 - DNA, 37 bp, Homo sapiens
ggctttggtgactctagataacctcgggccgatcgca

SEQ ID NO: 61638 - DNA, 38 bp, Homo sapiens; identical to SEQ ID NO: 12749

SEQ ID NO: 61639 - DNA, 39 bp, Homo sapiens; identical to SEQ ID NO: 12750

SEQ ID NO: 61640 - DNA, 43 bp, Homo sapiens; identical to SEQ ID NO: 57043

SEQ ID NO: 61641 - DNA, 36 bp, Homo sapiens
gctttggtgactctagataacctcgggccgatcgca

SEQ ID NO: 61642 - DNA, 37 bp, Homo sapiens; identical to SEQ ID NO: 12761

SEQ ID NO: 61643 - DNA, 36 bp, Homo sapiens; identical to SEQ ID NO: 12767

SEQ ID NO: 61644 - DNA, 37 bp, Homo sapiens; identical to SEQ ID NO: 12768

SEQ ID NO: 61645 - DNA, 19 bp, Homo sapiens
cgacccggggaggtagtga

SEQ ID NO: 61646 - DNA, 34 bp, Homo sapiens
cgtccccgccccttgcctctcggcgccccctcga

SEQ ID NO: 61647 - DNA, 23 bp, Homo sapiens
ctcggcgccccctcgatgctctt

SEQ ID NO: 61648 - DNA, 21 bp, Homo sapiens
tcggcgccccctcgatgctct

SEQ ID NO: 61649 - DNA, 24 bp, Homo sapiens
gctgagtgtcccgcggggcccgaa

SEQ ID NO: 61650 - DNA, 23 bp, Homo sapiens
ctgagtgtcccgcggggcccgaa

SEQ ID NO: 61651 - DNA, 22 bp, Homo sapiens
tgagtgtcccgcggggcccgaa

SEQ ID NO: 61652 - DNA, 20 bp, Homo sapiens
gagtgtcccgcggggcccga

SEQ ID NO: 61653 - DNA, 21 bp, Homo sapiens
gagtgtcccgcggggcccgaa

SEQ ID NO: 61654 - DNA, 43 bp, Homo sapiens
gaagcgtttactttgaaaaaattagagtgttcaaagcaggccc

SEQ ID NO: 61655 - DNA, 44 bp, Homo sapiens; identical to SEQ ID NO: 57068

SEQ ID NO: 61656 - DNA, 42 bp, Homo sapiens
aagcgtttactttgaaaaaattagagtgttcaaagcaggccc

SEQ ID NO: 61657 - DNA, 43 bp, Homo sapiens; identical to SEQ ID NO: 58749

SEQ ID NO: 61658 - DNA, 41 bp, Homo sapiens
agcgtttactttgaaaaaattagagtgttcaaagcaggccc

SEQ ID NO: 61659 - DNA, 42 bp, Homo sapiens; identical to SEQ ID NO: 58750

SEQ ID NO: 61660 - DNA, 41 bp, Homo sapiens
gcgtttactttgaaaaaattagagtgttcaaagcaggcccg

SEQ ID NO: 61661 - DNA, 34 bp, Homo sapiens
agccgcctggataccgcagctaggaataatggaa

SEQ ID NO: 61662 - DNA, 35 bp, Homo sapiens
agccgcctggataccgcagctaggaataatggaat

SEQ ID NO: 61663 - DNA, 36 bp, Homo sapiens
agccgcctggataccgcagctaggaataatggaata

SEQ ID NO: 61664 - DNA, 33 bp, Homo sapiens
gccgcctggataccgcagctaggaataatggaa

SEQ ID NO: 61665 - DNA, 34 bp, Homo sapiens
gccgcctggataccgcagctaggaataatggaat

SEQ ID NO: 61666 - DNA, 35 bp, Homo sapiens
gccgcctggataccgcagctaggaataatggaata

SEQ ID NO: 61667 - DNA, 31 bp, Homo sapiens
tgccaagaatgttttcattaatcaagaacga

SEQ ID NO: 61668 - DNA, 35 bp, Homo sapiens
gacggaagggcaccaccaggagtggagcctgcggc

SEQ ID NO: 61669 - DNA, 28 bp, Homo sapiens
ccggacacggacaggattgacagattga

SEQ ID NO: 61670 - DNA, 16 bp, Homo sapiens
gagcggtcggcgtccc

SEQ ID NO: 61671 - DNA, 17 bp, Homo sapiens
gagcggtcggcgtcccc

SEQ ID NO: 61672 - DNA, 19 bp, Homo sapiens
agccacccgagattgagca

SEQ ID NO: 61673 - DNA, 20 bp, Homo sapiens
agccacccgagattgagcaa

SEQ ID NO: 61674 - DNA, 22 bp, Homo sapiens
ccattcgtgatggggatcgggg

SEQ ID NO: 61675 - DNA, 21 bp, Homo sapiens
cattcgtgatggggatcgggg

SEQ ID NO: 61676 - DNA, 28 bp, Homo sapiens
acggccctggcggagcgctgagaagacg

SEQ ID NO: 61677 - DNA, 41 bp, Homo sapiens; identical to SEQ ID NO: 17003

SEQ ID NO: 61678 - DNA, 24 bp, Homo sapiens
ggccctggcggagcgctgagaaga

SEQ ID NO: 61679 - DNA, 40 bp, Homo sapiens
ggccctggcggagcgctgagaagacggtcgaacttgacta

SEQ ID NO: 61680 - DNA, 41 bp, Homo sapiens
agcgctgagaagacggtcgaacttgactatctagaggaagt

SEQ ID NO: 61681 - DNA, 28 bp, Homo sapiens
gcgctgagaagacggtcgaacttgacta

SEQ ID NO: 61682 - DNA, 40 bp, Homo sapiens; identical to SEQ ID NO: 59071

SEQ ID NO: 61683 - DNA, 44 bp, Homo sapiens
gcgctgagaagacggtcgaacttgactatctagaggaagtaaaa

SEQ ID NO: 61684 - DNA, 17 bp, Homo sapiens
ctctctctctctccccc

SEQ ID NO: 61685 - DNA, 36 bp, Homo sapiens
cccgcgccgtgggggcgggaacccccgggcgcctgt

SEQ ID NO: 61686 - DNA, 42 bp, Homo sapiens
cctcgtacgactcttagcggtggatcactcggctcgtgcgtc

SEQ ID NO: 61687 - DNA, 25 bp, Homo sapiens
ctcgtacgactcttagcggtggatc

SEQ ID NO: 61688 - DNA, 37 bp, Homo sapiens; identical to SEQ ID NO: 17316

SEQ ID NO: 61689 - DNA, 41 bp, Homo sapiens
ctcgtacgactcttagcggtggatcactcggctcgtgcgtc

SEQ ID NO: 61690 - DNA, 43 bp, Homo sapiens
ctcgtacgactcttagcggtggatcactcggctcgtgcgtcga

SEQ ID NO: 61691 - DNA, 24 bp, Homo sapiens
tcgtacgactcttagcggtggatc

SEQ ID NO: 61692 - DNA, 35 bp, Homo sapiens
tcgtacgactcttagcggtggatcactcggctcgt

SEQ ID NO: 61693 - DNA, 36 bp, Homo sapiens; identical to SEQ ID NO: 17332

SEQ ID NO: 61694 - DNA, 38 bp, Homo sapiens; identical to SEQ ID NO: 17334

SEQ ID NO: 61695 - DNA, 39 bp, Homo sapiens
tcgtacgactcttagcggtggatcactcggctcgtgcgt

SEQ ID NO: 61696 - DNA, 40 bp, Homo sapiens; identical to SEQ ID NO: 57207

SEQ ID NO: 61697 - DNA, 41 bp, Homo sapiens
tcgtacgactcttagcggtggatcactcggctcgtgcgtcg

SEQ ID NO: 61698 - DNA, 42 bp, Homo sapiens; identical to SEQ ID NO: 57208

SEQ ID NO: 61699 - DNA, 23 bp, Homo sapiens
cgtacgactcttagcggtggatc

SEQ ID NO: 61700 - DNA, 31 bp, Homo sapiens; identical to SEQ ID NO: 3560

SEQ ID NO: 61701 - DNA, 34 bp, Homo sapiens
cgtacgactcttagcggtggatcactcggctcgt

SEQ ID NO: 61702 - DNA, 35 bp, Homo sapiens; identical to SEQ ID NO: 17346

SEQ ID NO: 61703 - DNA, 37 bp, Homo sapiens; identical to SEQ ID NO: 17348

SEQ ID NO: 61704 - DNA, 38 bp, Homo sapiens
cgtacgactcttagcggtggatcactcggctcgtgcgt

SEQ ID NO: 61705 - DNA, 40 bp, Homo sapiens
cgtacgactcttagcggtggatcactcggctcgtgcgtcg

SEQ ID NO: 61706 - DNA, 41 bp, Homo sapiens
cgtacgactcttagcggtggatcactcggctcgtgcgtcga

SEQ ID NO: 61707 - DNA, 22 bp, Homo sapiens
gtacgactcttagcggtggatc

SEQ ID NO: 61708 - DNA, 30 bp, Homo sapiens; identical to SEQ ID NO: 3563

SEQ ID NO: 61709 - DNA, 33 bp, Homo sapiens; identical to SEQ ID NO: 3566

SEQ ID NO: 61710 - DNA, 34 bp, Homo sapiens; identical to SEQ ID NO: 59173

SEQ ID NO: 61711 - DNA, 36 bp, Homo sapiens; identical to SEQ ID NO: 57213

SEQ ID NO: 61712 - DNA, 37 bp, Homo sapiens
gtacgactcttagcggtggatcactcggctcgtgcgt

SEQ ID NO: 61713 - DNA, 38 bp, Homo sapiens
gtacgactcttagcggtggatcactcggctcgtgcgtc

SEQ ID NO: 61714 - DNA, 39 bp, Homo sapiens
gtacgactcttagcggtggatcactcggctcgtgcgtcg

SEQ ID NO: 61715 - DNA, 40 bp, Homo sapiens
gtacgactcttagcggtggatcactcggctcgtgcgtcga

SEQ ID NO: 61716 - DNA, 41 bp, Homo sapiens
gtacgactcttagcggtggatcactcggctcgtgcgtcgat

SEQ ID NO: 61717 - DNA, 43 bp, Homo sapiens
gtacgactcttagcggtggatcactcggctcgtgcgtcgatga

SEQ ID NO: 61718 - DNA, 44 bp, Homo sapiens
gtacgactcttagcggtggatcactcggctcgtgcgtcgatgaa

SEQ ID NO: 61719 - DNA, 32 bp, Homo sapiens; identical to SEQ ID NO: 17366

SEQ ID NO: 61720 - DNA, 33 bp, Homo sapiens; identical to SEQ ID NO: 17367

SEQ ID NO: 61721 - DNA, 35 bp, Homo sapiens; identical to SEQ ID NO: 59175

SEQ ID NO: 61722 - DNA, 36 bp, Homo sapiens
tacgactcttagcggtggatcactcggctcgtgcgt

SEQ ID NO: 61723 - DNA, 39 bp, Homo sapiens
tacgactcttagcggtggatcactcggctcgtgcgtcga

SEQ ID NO: 61724 - DNA, 18 bp, Homo sapiens
acgactcttagcggtgga

SEQ ID NO: 61725 - DNA, 20 bp, Homo sapiens
acgactcttagcggtggatc

SEQ ID NO: 61726 - DNA, 28 bp, Homo sapiens
acgactcttagcggtggatcactcggct

SEQ ID NO: 61727 - DNA, 30 bp, Homo sapiens; identical to SEQ ID NO: 17373

SEQ ID NO: 61728 - DNA, 31 bp, Homo sapiens; identical to SEQ ID NO: 3569

SEQ ID NO: 61729 - DNA, 32 bp, Homo sapiens; identical to SEQ ID NO: 17375

SEQ ID NO: 61730 - DNA, 34 bp, Homo sapiens; identical to SEQ ID NO: 59178

SEQ ID NO: 61731 - DNA, 35 bp, Homo sapiens
acgactcttagcggtggatcactcggctcgtgcgt

SEQ ID NO: 61732 - DNA, 37 bp, Homo sapiens
acgactcttagcggtggatcactcggctcgtgcgtcg

SEQ ID NO: 61733 - DNA, 38 bp, Homo sapiens
acgactcttagcggtggatcactcggctcgtgcgtcga

SEQ ID NO: 61734 - DNA, 39 bp, Homo sapiens
acgactcttagcggtggatcactcggctcgtgcgtcgat

SEQ ID NO: 61735 - DNA, 16 bp, Homo sapiens
cgactcttagcggtgg

SEQ ID NO: 61736 - DNA, 17 bp, Homo sapiens
cgactcttagcggtgga

SEQ ID NO: 61737 - DNA, 18 bp, Homo sapiens
cgactcttagcggtggat

SEQ ID NO: 61738 - DNA, 19 bp, Homo sapiens
cgactcttagcggtggatc

SEQ ID NO: 61739 - DNA, 20 bp, Homo sapiens
cgactcttagcggtggatca

SEQ ID NO: 61740 - DNA, 22 bp, Homo sapiens
cgactcttagcggtggatcact

SEQ ID NO: 61741 - DNA, 25 bp, Homo sapiens
cgactcttagcggtggatcactcgg

SEQ ID NO: 61742 - DNA, 26 bp, Homo sapiens
cgactcttagcggtggatcactcggc

SEQ ID NO: 61743 - DNA, 27 bp, Homo sapiens
cgactcttagcggtggatcactcggct

SEQ ID NO: 61744 - DNA, 28 bp, Homo sapiens
cgactcttagcggtggatcactcggctc

SEQ ID NO: 61745 - DNA, 29 bp, Homo sapiens
cgactcttagcggtggatcactcggctcg

SEQ ID NO: 61746 - DNA, 30 bp, Homo sapiens; identical to SEQ ID NO: 3579

SEQ ID NO: 61747 - DNA, 31 bp, Homo sapiens; identical to SEQ ID NO: 3580

SEQ ID NO: 61748 - DNA, 32 bp, Homo sapiens; identical to SEQ ID NO: 3581

SEQ ID NO: 61749 - DNA, 33 bp, Homo sapiens; identical to SEQ ID NO: 3582

SEQ ID NO: 61750 - DNA, 34 bp, Homo sapiens; identical to SEQ ID NO: 17395

SEQ ID NO: 61751 - DNA, 35 bp, Homo sapiens; identical to SEQ ID NO: 17396

SEQ ID NO: 61752 - DNA, 36 bp, Homo sapiens; identical to SEQ ID NO: 17397

SEQ ID NO: 61753 - DNA, 37 bp, Homo sapiens; identical to SEQ ID NO: 17398

SEQ ID NO: 61754 - DNA, 38 bp, Homo sapiens; identical to SEQ ID NO: 17399

SEQ ID NO: 61755 - DNA, 39 bp, Homo sapiens; identical to SEQ ID NO: 17400

SEQ ID NO: 61756 - DNA, 40 bp, Homo sapiens
cgactcttagcggtggatcactcggctcgtgcgtcgatga

SEQ ID NO: 61757 - DNA, 41 bp, Homo sapiens
cgactcttagcggtggatcactcggctcgtgcgtcgatgaa

SEQ ID NO: 61758 - DNA, 42 bp, Homo sapiens; identical to SEQ ID NO: 17401

SEQ ID NO: 61759 - DNA, 43 bp, Homo sapiens; identical to SEQ ID NO: 17402

SEQ ID NO: 61760 - DNA, 44 bp, Homo sapiens; identical to SEQ ID NO: 17403

SEQ ID NO: 61761 - DNA, 46 bp, Homo sapiens; identical to SEQ ID NO: 17405

SEQ ID NO: 61762 - DNA, 16 bp, Homo sapiens
gactcttagcggtgga

SEQ ID NO: 61763 - DNA, 17 bp, Homo sapiens
gactcttagcggtggat

SEQ ID NO: 61764 - DNA, 18 bp, Homo sapiens
gactcttagcggtggatc

SEQ ID NO: 61765 - DNA, 19 bp, Homo sapiens
gactcttagcggtggatca

SEQ ID NO: 61766 - DNA, 21 bp, Homo sapiens
gactcttagcggtggatcact

SEQ ID NO: 61767 - DNA, 24 bp, Homo sapiens
gactcttagcggtggatcactcgg

SEQ ID NO: 61768 - DNA, 25 bp, Homo sapiens
gactcttagcggtggatcactcggc

SEQ ID NO: 61769 - DNA, 26 bp, Homo sapiens
gactcttagcggtggatcactcggct

SEQ ID NO: 61770 - DNA, 27 bp, Homo sapiens
gactcttagcggtggatcactcggctc

SEQ ID NO: 61771 - DNA, 28 bp, Homo sapiens
gactcttagcggtggatcactcggctcg

SEQ ID NO: 61772 - DNA, 29 bp, Homo sapiens
gactcttagcggtggatcactcggctcgt

SEQ ID NO: 61773 - DNA, 30 bp, Homo sapiens; identical to SEQ ID NO: 3590

SEQ ID NO: 61774 - DNA, 32 bp, Homo sapiens; identical to SEQ ID NO: 3591

SEQ ID NO: 61775 - DNA, 33 bp, Homo sapiens; identical to SEQ ID NO: 17420

SEQ ID NO: 61776 - DNA, 34 bp, Homo sapiens; identical to SEQ ID NO: 17421

SEQ ID NO: 61777 - DNA, 35 bp, Homo sapiens
gactcttagcggtggatcactcggctcgtgcgtcg

SEQ ID NO: 61778 - DNA, 36 bp, Homo sapiens; identical to SEQ ID NO: 17422

SEQ ID NO: 61779 - DNA, 37 bp, Homo sapiens; identical to SEQ ID NO: 17423

SEQ ID NO: 61780 - DNA, 38 bp, Homo sapiens
gactcttagcggtggatcactcggctcgtgcgtcgatg

SEQ ID NO: 61781 - DNA, 39 bp, Homo sapiens
gactcttagcggtggatcactcggctcgtgcgtcgatga

SEQ ID NO: 61782 - DNA, 40 bp, Homo sapiens
gactcttagcggtggatcactcggctcgtgcgtcgatgaa

SEQ ID NO: 61783 - DNA, 41 bp, Homo sapiens
gactcttagcggtggatcactcggctcgtgcgtcgatgaag

SEQ ID NO: 61784 - DNA, 43 bp, Homo sapiens
gactcttagcggtggatcactcggctcgtgcgtcgatgaagaa

SEQ ID NO: 61785 - DNA, 45 bp, Homo sapiens
gactcttagcggtggatcactcggctcgtgcgtcgatgaagaacg

SEQ ID NO: 61786 - DNA, 17 bp, Homo sapiens
actcttagcggtggatc

SEQ ID NO: 61787 - DNA, 27 bp, Homo sapiens
actcttagcggtggatcactcggctcg

SEQ ID NO: 61788 - DNA, 28 bp, Homo sapiens
actcttagcggtggatcactcggctcgt

SEQ ID NO: 61789 - DNA, 29 bp, Homo sapiens
actcttagcggtggatcactcggctcgtg

SEQ ID NO: 61790 - DNA, 31 bp, Homo sapiens; identical to SEQ ID NO: 17434

SEQ ID NO: 61791 - DNA, 32 bp, Homo sapiens; identical to SEQ ID NO: 17435

SEQ ID NO: 61792 - DNA, 35 bp, Homo sapiens
actcttagcggtggatcactcggctcgtgcgtcga

SEQ ID NO: 61793 - DNA, 30 bp, Homo sapiens; identical to SEQ ID NO: 29290

SEQ ID NO: 61794 - DNA, 23 bp, Homo sapiens
cggtggatcactcggctcgtgcg

SEQ ID NO: 61795 - DNA, 38 bp, Homo sapiens
tggatcactcggctcgtgcgtcgatgaagaacgcagct

SEQ ID NO: 61796 - DNA, 25 bp, Homo sapiens
gcaggacacattgatcatcgacact

SEQ ID NO: 61797 - DNA, 30 bp, Homo sapiens
gcaggacacattgatcatcgacacttcgaa

SEQ ID NO: 61798 - DNA, 33 bp, Homo sapiens
gcaggacacattgatcatcgacacttcgaacgc

SEQ ID NO: 61799 - DNA, 36 bp, Homo sapiens
gcaggacacattgatcatcgacacttcgaacgcact

SEQ ID NO: 61800 - DNA, 27 bp, Homo sapiens
gacacttcgaacgcacttgcggccccg

SEQ ID NO: 61801 - DNA, 26 bp, Homo sapiens
acacttcgaacgcacttgcggccccg

SEQ ID NO: 61802 - DNA, 36 bp, Homo sapiens; identical to SEQ ID NO: 17981

SEQ ID NO: 61803 - DNA, 34 bp, Homo sapiens; identical to SEQ ID NO: 17993

SEQ ID NO: 61804 - DNA, 33 bp, Homo sapiens; identical to SEQ ID NO: 3741

SEQ ID NO: 61805 - DNA, 32 bp, Homo sapiens; identical to SEQ ID NO: 3743

SEQ ID NO: 61806 - DNA, 26 bp, Homo sapiens
ctcccggggctacgcctgtctgagcg

SEQ ID NO: 61807 - DNA, 27 bp, Homo sapiens
ctcccggggctacgcctgtctgagcgt

SEQ ID NO: 61808 - DNA, 21 bp, Homo sapiens
cccggggctacgcctgtctga

SEQ ID NO: 61809 - DNA, 22 bp, Homo sapiens
cccggggctacgcctgtctgag

SEQ ID NO: 61810 - DNA, 24 bp, Homo sapiens
cccggggctacgcctgtctgagcg

SEQ ID NO: 61811 - DNA, 25 bp, Homo sapiens
cccggggctacgcctgtctgagcgt

SEQ ID NO: 61812 - DNA, 29 bp, Homo sapiens
cccggggctacgcctgtctgagcgtcgct

SEQ ID NO: 61813 - DNA, 27 bp, Homo sapiens
cggggctacgcctgtctgagcgtcgct

SEQ ID NO: 61814 - DNA, 26 bp, Homo sapiens
ggggctacgcctgtctgagcgtcgct

SEQ ID NO: 61815 - DNA, 25 bp, Homo sapiens
gggctacgcctgtctgagcgtcgct

SEQ ID NO: 61816 - DNA, 22 bp, Homo sapiens
ctacgcctgtctgagcgtcgct

SEQ ID NO: 61817 - DNA, 23 bp, Homo sapiens
ctacgcctgtctgagcgtcgctt

SEQ ID NO: 61818 - DNA, 21 bp, Homo sapiens
tacgcctgtctgagcgtcgct

SEQ ID NO: 61819 - DNA, 20 bp, Homo sapiens
acgcctgtctgagcgtcgct

SEQ ID NO: 61820 - DNA, 30 bp, Homo sapiens; identical to SEQ ID NO: 3832

SEQ ID NO: 61821 - DNA, 33 bp, Homo sapiens; identical to SEQ ID NO: 3835

SEQ ID NO: 61822 - DNA, 35 bp, Homo sapiens; identical to SEQ ID NO: 18197

SEQ ID NO: 61823 - DNA, 36 bp, Homo sapiens; identical to SEQ ID NO: 18198

SEQ ID NO: 61824 - DNA, 38 bp, Homo sapiens; identical to SEQ ID NO: 18200

SEQ ID NO: 61825 - DNA, 39 bp, Homo sapiens; identical to SEQ ID NO: 18201

SEQ ID NO: 61826 - DNA, 18 bp, Homo sapiens
acgcgacctcagatcaga

SEQ ID NO: 61827 - DNA, 19 bp, Homo sapiens
acgcgacctcagatcagac

SEQ ID NO: 61828 - DNA, 20 bp, Homo sapiens
acgcgacctcagatcagacg

SEQ ID NO: 61829 - DNA, 21 bp, Homo sapiens
acgcgacctcagatcagacgt

SEQ ID NO: 61830 - DNA, 25 bp, Homo sapiens
acgcgacctcagatcagacgtggcg

SEQ ID NO: 61831 - DNA, 26 bp, Homo sapiens
acgcgacctcagatcagacgtggcga

SEQ ID NO: 61832 - DNA, 27 bp, Homo sapiens
acgcgacctcagatcagacgtggcgac

SEQ ID NO: 61833 - DNA, 28 bp, Homo sapiens
acgcgacctcagatcagacgtggcgacc

SEQ ID NO: 61834 - DNA, 29 bp, Homo sapiens
acgcgacctcagatcagacgtggcgaccc

SEQ ID NO: 61835 - DNA, 30 bp, Homo sapiens; identical to SEQ ID NO: 3848

SEQ ID NO: 61836 - DNA, 32 bp, Homo sapiens; identical to SEQ ID NO: 3850

SEQ ID NO: 61837 - DNA, 33 bp, Homo sapiens; identical to SEQ ID NO: 3851

SEQ ID NO: 61838 - DNA, 34 bp, Homo sapiens; identical to SEQ ID NO: 18226

SEQ ID NO: 61839 - DNA, 35 bp, Homo sapiens; identical to SEQ ID NO: 18227

SEQ ID NO: 61840 - DNA, 36 bp, Homo sapiens; identical to SEQ ID NO: 18228

SEQ ID NO: 61841 - DNA, 37 bp, Homo sapiens; identical to SEQ ID NO: 18229

SEQ ID NO: 61842 - DNA, 38 bp, Homo sapiens; identical to SEQ ID NO: 18230

SEQ ID NO: 61843 - DNA, 39 bp, Homo sapiens; identical to SEQ ID NO: 18231

SEQ ID NO: 61844 - DNA, 42 bp, Homo sapiens; identical to SEQ ID NO: 18234

SEQ ID NO: 61845 - DNA, 43 bp, Homo sapiens; identical to SEQ ID NO: 18235

SEQ ID NO: 61846 - DNA, 16 bp, Homo sapiens
cgcgacctcagatcag

SEQ ID NO: 61847 - DNA, 17 bp, Homo sapiens
cgcgacctcagatcaga

SEQ ID NO: 61848 - DNA, 18 bp, Homo sapiens
cgcgacctcagatcagac

SEQ ID NO: 61849 - DNA, 19 bp, Homo sapiens
cgcgacctcagatcagacg

SEQ ID NO: 61850 - DNA, 20 bp, Homo sapiens
cgcgacctcagatcagacgt

SEQ ID NO: 61851 - DNA, 21 bp, Homo sapiens
cgcgacctcagatcagacgtg

SEQ ID NO: 61852 - DNA, 22 bp, Homo sapiens
cgcgacctcagatcagacgtgg

SEQ ID NO: 61853 - DNA, 23 bp, Homo sapiens
cgcgacctcagatcagacgtggc

SEQ ID NO: 61854 - DNA, 24 bp, Homo sapiens
cgcgacctcagatcagacgtggcg

SEQ ID NO: 61855 - DNA, 25 bp, Homo sapiens
cgcgacctcagatcagacgtggcga

SEQ ID NO: 61856 - DNA, 26 bp, Homo sapiens
cgcgacctcagatcagacgtggcgac

SEQ ID NO: 61857 - DNA, 27 bp, Homo sapiens
cgcgacctcagatcagacgtggcgacc

SEQ ID NO: 61858 - DNA, 28 bp, Homo sapiens
cgcgacctcagatcagacgtggcgaccc

SEQ ID NO: 61859 - DNA, 29 bp, Homo sapiens
cgcgacctcagatcagacgtggcgacccg

SEQ ID NO: 61860 - DNA, 30 bp, Homo sapiens; identical to SEQ ID NO: 3865

SEQ ID NO: 61861 - DNA, 31 bp, Homo sapiens; identical to SEQ ID NO: 3866

SEQ ID NO: 61862 - DNA, 32 bp, Homo sapiens; identical to SEQ ID NO: 3867

SEQ ID NO: 61863 - DNA, 33 bp, Homo sapiens; identical to SEQ ID NO: 3868

SEQ ID NO: 61864 - DNA, 34 bp, Homo sapiens; identical to SEQ ID NO: 18258

SEQ ID NO: 61865 - DNA, 35 bp, Homo sapiens; identical to SEQ ID NO: 18259

SEQ ID NO: 61866 - DNA, 36 bp, Homo sapiens; identical to SEQ ID NO: 18260

SEQ ID NO: 61867 - DNA, 37 bp, Homo sapiens; identical to SEQ ID NO: 18261

SEQ ID NO: 61868 - DNA, 38 bp, Homo sapiens; identical to SEQ ID NO: 18262

SEQ ID NO: 61869 - DNA, 39 bp, Homo sapiens; identical to SEQ ID NO: 18263

SEQ ID NO: 61870 - DNA, 40 bp, Homo sapiens; identical to SEQ ID NO: 18264

SEQ ID NO: 61871 - DNA, 41 bp, Homo sapiens; identical to SEQ ID NO: 18265

SEQ ID NO: 61872 - DNA, 42 bp, Homo sapiens; identical to SEQ ID NO: 18266

SEQ ID NO: 61873 - DNA, 43 bp, Homo sapiens; identical to SEQ ID NO: 18267

SEQ ID NO: 61874 - DNA, 44 bp, Homo sapiens; identical to SEQ ID NO: 18268

SEQ ID NO: 61875 - DNA, 20 bp, Homo sapiens
gcgacctcagatcagacgtg

SEQ ID NO: 61876 - DNA, 22 bp, Homo sapiens
gcgacctcagatcagacgtggc

SEQ ID NO: 61877 - DNA, 23 bp, Homo sapiens
gcgacctcagatcagacgtggcg

SEQ ID NO: 61878 - DNA, 24 bp, Homo sapiens
gcgacctcagatcagacgtggcga

SEQ ID NO: 61879 - DNA, 25 bp, Homo sapiens
gcgacctcagatcagacgtggcgac

SEQ ID NO: 61880 - DNA, 26 bp, Homo sapiens
gcgacctcagatcagacgtggcgacc

SEQ ID NO: 61881 - DNA, 28 bp, Homo sapiens
gcgacctcagatcagacgtggcgacccg

SEQ ID NO: 61882 - DNA, 30 bp, Homo sapiens; identical to SEQ ID NO: 3876

SEQ ID NO: 61883 - DNA, 32 bp, Homo sapiens; identical to SEQ ID NO: 3878

SEQ ID NO: 61884 - DNA, 33 bp, Homo sapiens; identical to SEQ ID NO: 3879

SEQ ID NO: 61885 - DNA, 34 bp, Homo sapiens; identical to SEQ ID NO: 18287

SEQ ID NO: 61886 - DNA, 35 bp, Homo sapiens; identical to SEQ ID NO: 18288

SEQ ID NO: 61887 - DNA, 36 bp, Homo sapiens; identical to SEQ ID NO: 18289

SEQ ID NO: 61888 - DNA, 22 bp, Homo sapiens
cgacctcagatcagacgtggcg

SEQ ID NO: 61889 - DNA, 23 bp, Homo sapiens
cgacctcagatcagacgtggcga

SEQ ID NO: 61890 - DNA, 25 bp, Homo sapiens
cgacctcagatcagacgtggcgacc

SEQ ID NO: 61891 - DNA, 29 bp, Homo sapiens
cgacctcagatcagacgtggcgacccgct

SEQ ID NO: 61892 - DNA, 32 bp, Homo sapiens; identical to SEQ ID NO: 3890

SEQ ID NO: 61893 - DNA, 18 bp, Homo sapiens
gacctcagatcagacgtg

SEQ ID NO: 61894 - DNA, 21 bp, Homo sapiens
gacctcagatcagacgtggcg

SEQ ID NO: 61895 - DNA, 22 bp, Homo sapiens
gacctcagatcagacgtggcga

SEQ ID NO: 61896 - DNA, 23 bp, Homo sapiens
gacctcagatcagacgtggcgac

SEQ ID NO: 61897 - DNA, 30 bp, Homo sapiens
gacctcagatcagacgtggcgacccgctga

SEQ ID NO: 61898 - DNA, 31 bp, Homo sapiens; identical to SEQ ID NO: 18325

SEQ ID NO: 61899 - DNA, 20 bp, Homo sapiens
acctcagatcagacgtggcg

SEQ ID NO: 61900 - DNA, 21 bp, Homo sapiens
acctcagatcagacgtggcga

SEQ ID NO: 61901 - DNA, 20 bp, Homo sapiens
agacgtggcgacccgctgaa

SEQ ID NO: 61902 - DNA, 37 bp, Homo sapiens; identical to SEQ ID NO: 59457

SEQ ID NO: 61903 - DNA, 38 bp, Homo sapiens
agtgaacagggaagagcccagcgccgaatccccgcccc

SEQ ID NO: 61904 - DNA, 22 bp, Homo sapiens
agagcccagcgccgaatccccg

SEQ ID NO: 61905 - DNA, 19 bp, Homo sapiens
gagcccagcgccgaatccc

SEQ ID NO: 61906 - DNA, 20 bp, Homo sapiens
gagcccagcgccgaatcccc

SEQ ID NO: 61907 - DNA, 21 bp, Homo sapiens
gagcccagcgccgaatccccg

SEQ ID NO: 61908 - DNA, 22 bp, Homo sapiens
gagcccagcgccgaatccccgc

SEQ ID NO: 61909 - DNA, 23 bp, Homo sapiens
gagcccagcgccgaatccccgcc

SEQ ID NO: 61910 - DNA, 24 bp, Homo sapiens
gagcccagcgccgaatccccgccc

SEQ ID NO: 61911 - DNA, 25 bp, Homo sapiens
gagcccagcgccgaatccccgcccc

SEQ ID NO: 61912 - DNA, 26 bp, Homo sapiens
gagcccagcgccgaatccccgccccg

SEQ ID NO: 61913 - DNA, 27 bp, Homo sapiens
gagcccagcgccgaatccccgccccgc

SEQ ID NO: 61914 - DNA, 20 bp, Homo sapiens
agcccagcgccgaatccccg

SEQ ID NO: 61915 - DNA, 23 bp, Homo sapiens
agcccagcgccgaatccccgccc

SEQ ID NO: 61916 - DNA, 19 bp, Homo sapiens
cggaagacccgctccccgg

SEQ ID NO: 61917 - DNA, 27 bp, Homo sapiens
ccggcgccgctcgtggggggcccaagt

SEQ ID NO: 61918 - DNA, 28 bp, Homo sapiens
ccggcgccgctcgtggggggcccaagtc

SEQ ID NO: 61919 - DNA, 29 bp, Homo sapiens
gcccaagtccttctgatcgaggcccagcc

SEQ ID NO: 61920 - DNA, 25 bp, Homo sapiens
gaggcccagcccgtggacggtgtga

SEQ ID NO: 61921 - DNA, 26 bp, Homo sapiens
gaggcccagcccgtggacggtgtgag

SEQ ID NO: 61922 - DNA, 24 bp, Homo sapiens
aggcccagcccgtggacggtgtga

SEQ ID NO: 61923 - DNA, 25 bp, Homo sapiens
aggcccagcccgtggacggtgtgag

SEQ ID NO: 61924 - DNA, 23 bp, Homo sapiens
ggcccagcccgtggacggtgtga

SEQ ID NO: 61925 - DNA, 24 bp, Homo sapiens
ggcccagcccgtggacggtgtgag

SEQ ID NO: 61926 - DNA, 23 bp, Homo sapiens
gcccagcccgtggacggtgtgag

SEQ ID NO: 61927 - DNA, 24 bp, Homo sapiens
gcccgtggacggtgtgaggccggt

SEQ ID NO: 61928 - DNA, 25 bp, Homo sapiens
ccatctaaggctaaataccggcacg

SEQ ID NO: 61929 - DNA, 28 bp, Homo sapiens
ccatctaaggctaaataccggcacgaga

SEQ ID NO: 61930 - DNA, 30 bp, Homo sapiens; identical to SEQ ID NO: 41278

SEQ ID NO: 61931 - DNA, 36 bp, Homo sapiens; identical to SEQ ID NO: 57468

SEQ ID NO: 61932 - DNA, 35 bp, Homo sapiens; identical to SEQ ID NO: 57469

SEQ ID NO: 61933 - DNA, 34 bp, Homo sapiens; identical to SEQ ID NO: 57470

SEQ ID NO: 61934 - DNA, 24 bp, Homo sapiens
cccggcggatctttcccgcccccc

SEQ ID NO: 61935 - DNA, 25 bp, Homo sapiens
cccggcggatctttcccgccccccg

SEQ ID NO: 61936 - DNA, 26 bp, Homo sapiens
cccggcggatctttcccgccccccgt

SEQ ID NO: 61937 - DNA, 27 bp, Homo sapiens
cccggcggatctttcccgccccccgtt

SEQ ID NO: 61938 - DNA, 24 bp, Homo sapiens
ccggcggatctttcccgccccccg

SEQ ID NO: 61939 - DNA, 25 bp, Homo sapiens
ccggcggatctttcccgccccccgt

SEQ ID NO: 61940 - DNA, 18 bp, Homo sapiens
cgttcctcccgacccctc

SEQ ID NO: 61941 - DNA, 28 bp, Homo sapiens
cgttcctcccgacccctccacccgccct

SEQ ID NO: 61942 - DNA, 16 bp, Homo sapiens
gttcctcccgacccct

SEQ ID NO: 61943 - DNA, 17 bp, Homo sapiens
gttcctcccgacccctc

SEQ ID NO: 61944 - DNA, 18 bp, Homo sapiens
gttcctcccgacccctcc

SEQ ID NO: 61945 - DNA, 19 bp, Homo sapiens
gttcctcccgacccctcca

SEQ ID NO: 61946 - DNA, 21 bp, Homo sapiens
gttcctcccgacccctccacc

SEQ ID NO: 61947 - DNA, 27 bp, Homo sapiens
gttcctcccgacccctccacccgccct

SEQ ID NO: 61948 - DNA, 28 bp, Homo sapiens
gttcctcccgacccctccacccgccctc

SEQ ID NO: 61949 - DNA, 16 bp, Homo sapiens
ttcctcccgacccctc

SEQ ID NO: 61950 - DNA, 26 bp, Homo sapiens
ttcctcccgacccctccacccgccct

SEQ ID NO: 61951 - DNA, 24 bp, Homo sapiens
cctcccgacccctccacccgccct

SEQ ID NO: 61952 - DNA, 17 bp, Homo sapiens
ctcccgacccctccacc

SEQ ID NO: 61953 - DNA, 23 bp, Homo sapiens
ctcccgacccctccacccgccct

SEQ ID NO: 61954 - DNA, 24 bp, Homo sapiens
ctcccgacccctccacccgccctc

SEQ ID NO: 61955 - DNA, 16 bp, Homo sapiens
tcccgacccctccacc

SEQ ID NO: 61956 - DNA, 22 bp, Homo sapiens
tcccgacccctccacccgccct

SEQ ID NO: 61957 - DNA, 23 bp, Homo sapiens
tcccgacccctccacccgccctc

SEQ ID NO: 61958 - DNA, 24 bp, Homo sapiens
tcccgacccctccacccgccctcc

SEQ ID NO: 61959 - DNA, 21 bp, Homo sapiens
cccgacccctccacccgccct

SEQ ID NO: 61960 - DNA, 22 bp, Homo sapiens
cccgacccctccacccgccctc

SEQ ID NO: 61961 - DNA, 22 bp, Homo sapiens
cccttcccccgccgcccctcct

SEQ ID NO: 61962 - DNA, 23 bp, Homo sapiens
cccttcccccgccgcccctcctc

SEQ ID NO: 61963 - DNA, 24 bp, Homo sapiens
cccttcccccgccgcccctcctcc

SEQ ID NO: 61964 - DNA, 25 bp, Homo sapiens
cccttcccccgccgcccctcctcct

SEQ ID NO: 61965 - DNA, 26 bp, Homo sapiens
cccttcccccgccgcccctcctcctc

SEQ ID NO: 61966 - DNA, 27 bp, Homo sapiens
cccttcccccgccgcccctcctcctcc

SEQ ID NO: 61967 - DNA, 28 bp, Homo sapiens
cccttcccccgccgcccctcctcctcct

SEQ ID NO: 61968 - DNA, 29 bp, Homo sapiens
cccttcccccgccgcccctcctcctcctc

SEQ ID NO: 61969 - DNA, 30 bp, Homo sapiens; identical to SEQ ID NO: 41805

SEQ ID NO: 61970 - DNA, 33 bp, Homo sapiens
cccttcccccgccgcccctcctcctcctccccg

SEQ ID NO: 61971 - DNA, 22 bp, Homo sapiens
ccttcccccgccgcccctcctc

SEQ ID NO: 61972 - DNA, 23 bp, Homo sapiens
ccttcccccgccgcccctcctcc

SEQ ID NO: 61973 - DNA, 24 bp, Homo sapiens
ccttcccccgccgcccctcctcct

SEQ ID NO: 61974 - DNA, 26 bp, Homo sapiens
ccttcccccgccgcccctcctcctcc

SEQ ID NO: 61975 - DNA, 27 bp, Homo sapiens
ccttcccccgccgcccctcctcctcct

SEQ ID NO: 61976 - DNA, 28 bp, Homo sapiens
ccttcccccgccgcccctcctcctcctc

SEQ ID NO: 61977 - DNA, 29 bp, Homo sapiens
ccttcccccgccgcccctcctcctcctcc

SEQ ID NO: 61978 - DNA, 19 bp, Homo sapiens
cgtccgtccgtccgtccgt

SEQ ID NO: 61979 - DNA, 20 bp, Homo sapiens
cgtccgtccgtccgtccgtc

SEQ ID NO: 61980 - DNA, 17 bp, Homo sapiens
gtccgtccgtccgtccg

SEQ ID NO: 61981 - DNA, 18 bp, Homo sapiens
gtccgtccgtccgtccgt

SEQ ID NO: 61982 - DNA, 19 bp, Homo sapiens
gtccgtccgtccgtccgtc

SEQ ID NO: 61983 - DNA, 20 bp, Homo sapiens
gtccgtccgtccgtccgtcc

SEQ ID NO: 61984 - DNA, 21 bp, Homo sapiens
gtccgtccgtccgtccgtcct

SEQ ID NO: 61985 - DNA, 17 bp, Homo sapiens
tccgtccgtccgtccgt

SEQ ID NO: 61986 - DNA, 18 bp, Homo sapiens
tccgtccgtccgtccgtc

SEQ ID NO: 61987 - DNA, 21 bp, Homo sapiens
ctccctcgggagggcgcgcgg

SEQ ID NO: 61988 - DNA, 22 bp, Homo sapiens
ctccctcgggagggcgcgcggg

SEQ ID NO: 61989 - DNA, 20 bp, Homo sapiens
tccctcgggagggcgcgcgg

SEQ ID NO: 61990 - DNA, 21 bp, Homo sapiens
tccctcgggagggcgcgcggg

SEQ ID NO: 61991 - DNA, 23 bp, Homo sapiens
tccctcgggagggcgcgcgggtc

SEQ ID NO: 61992 - DNA, 17 bp, Homo sapiens
ccctcgggagggcgcgc

SEQ ID NO: 61993 - DNA, 19 bp, Homo sapiens
ccctcgggagggcgcgcgg

SEQ ID NO: 61994 - DNA, 20 bp, Homo sapiens
ccctcgggagggcgcgcggg

SEQ ID NO: 61995 - DNA, 22 bp, Homo sapiens
ccctcgggagggcgcgcgggtc

SEQ ID NO: 61996 - DNA, 41 bp, Homo sapiens
ggcagcagcactcgccgaatcccggggccgagggagcgaga

SEQ ID NO: 61997 - DNA, 32 bp, Homo sapiens; identical to SEQ ID NO: 19741

SEQ ID NO: 61998 - DNA, 35 bp, Homo sapiens
agcactcgccgaatcccggggccgagggagcgaga

SEQ ID NO: 61999 - DNA, 36 bp, Homo sapiens; identical to SEQ ID NO: 57624

SEQ ID NO: 62000 - DNA, 37 bp, Homo sapiens; identical to SEQ ID NO: 59878

SEQ ID NO: 62001 - DNA, 34 bp, Homo sapiens
gcactcgccgaatcccggggccgagggagcgaga

SEQ ID NO: 62002 - DNA, 30 bp, Homo sapiens; identical to SEQ ID NO: 19759

SEQ ID NO: 62003 - DNA, 27 bp, Homo sapiens
ccgaatcccggggccgagggagcgaga

SEQ ID NO: 62004 - DNA, 26 bp, Homo sapiens
cgaatcccggggccgagggagcgaga

SEQ ID NO: 62005 - DNA, 23 bp, Homo sapiens
atcccggggccgagggagcgaga

SEQ ID NO: 62006 - DNA, 24 bp, Homo sapiens
cggcgcccacccccgcggggaatc

SEQ ID NO: 62007 - DNA, 16 bp, Homo sapiens
ggcgcccacccccgcg

SEQ ID NO: 62008 - DNA, 20 bp, Homo sapiens
ggcgcccacccccgcgggga

SEQ ID NO: 62009 - DNA, 21 bp, Homo sapiens
ggcgcccacccccgcggggaa

SEQ ID NO: 62010 - DNA, 22 bp, Homo sapiens
ggcgcccacccccgcggggaat

SEQ ID NO: 62011 - DNA, 23 bp, Homo sapiens
ggcgcccacccccgcggggaatc

SEQ ID NO: 62012 - DNA, 19 bp, Homo sapiens
gcgcccacccccgcgggga

SEQ ID NO: 62013 - DNA, 20 bp, Homo sapiens
gcgcccacccccgcggggaa

SEQ ID NO: 62014 - DNA, 21 bp, Homo sapiens
gcgcccacccccgcggggaat

SEQ ID NO: 62015 - DNA, 22 bp, Homo sapiens
gcgcccacccccgcggggaatc

SEQ ID NO: 62016 - DNA, 16 bp, Homo sapiens
cgcccacccccgcggg

SEQ ID NO: 62017 - DNA, 18 bp, Homo sapiens
cgcccacccccgcgggga

SEQ ID NO: 62018 - DNA, 19 bp, Homo sapiens
cgcccacccccgcggggaa

SEQ ID NO: 62019 - DNA, 20 bp, Homo sapiens
cgcccacccccgcggggaat

SEQ ID NO: 62020 - DNA, 21 bp, Homo sapiens
cgcccacccccgcggggaatc

SEQ ID NO: 62021 - DNA, 17 bp, Homo sapiens
gcccacccccgcgggga

SEQ ID NO: 62022 - DNA, 18 bp, Homo sapiens
gcccacccccgcggggaa

SEQ ID NO: 62023 - DNA, 19 bp, Homo sapiens
gcccacccccgcggggaat

SEQ ID NO: 62024 - DNA, 20 bp, Homo sapiens
gcccacccccgcggggaatc

SEQ ID NO: 62025 - DNA, 22 bp, Homo sapiens
ctcccacggcgcgaccgctctc

SEQ ID NO: 62026 - DNA, 23 bp, Homo sapiens
ctcccacggcgcgaccgctctcc

SEQ ID NO: 62027 - DNA, 20 bp, Homo sapiens
acccctcctccccgcgcccc

SEQ ID NO: 62028 - DNA, 24 bp, Homo sapiens
acccctcctccccgcgcccccgcc

SEQ ID NO: 62029 - DNA, 19 bp, Homo sapiens
ctcggggccacgcgcgcgt

SEQ ID NO: 62030 - DNA, 20 bp, Homo sapiens
ctcggggccacgcgcgcgtc

SEQ ID NO: 62031 - DNA, 24 bp, Homo sapiens
ctcggggccacgcgcgcgtccccc

SEQ ID NO: 62032 - DNA, 19 bp, Homo sapiens
tcggggccacgcgcgcgtc

SEQ ID NO: 62033 - DNA, 17 bp, Homo sapiens
cggggccacgcgcgcgt

SEQ ID NO: 62034 - DNA, 18 bp, Homo sapiens
cggggccacgcgcgcgtc

SEQ ID NO: 62035 - DNA, 19 bp, Homo sapiens
cggggccacgcgcgcgtcc

SEQ ID NO: 62036 - DNA, 20 bp, Homo sapiens
gcacggggtcggcggcgacg

SEQ ID NO: 62037 - DNA, 18 bp, Homo sapiens
ggagtctaacacgtgcgc

SEQ ID NO: 62038 - DNA, 30 bp, Homo sapiens; identical to SEQ ID NO: 44352

SEQ ID NO: 62039 - DNA, 28 bp, Homo sapiens
ccgagggcgcaccaccggcccgtctcgc

SEQ ID NO: 62040 - DNA, 21 bp, Homo sapiens
agcgcacgtgttaggacccga

SEQ ID NO: 62041 - DNA, 20 bp, Homo sapiens
gcgcacgtgttaggacccga

SEQ ID NO: 62042 - DNA, 20 bp, Homo sapiens
cgtagcggtcctgacgtgca

SEQ ID NO: 62043 - DNA, 36 bp, Homo sapiens; identical to SEQ ID NO: 20874

SEQ ID NO: 62044 - DNA, 28 bp, Homo sapiens
cgcagacccgacgcacccccgccacgca

SEQ ID NO: 62045 - DNA, 27 bp, Homo sapiens
gcagacccgacgcacccccgccacgca

SEQ ID NO: 62046 - DNA, 19 bp, Homo sapiens
gacgcacccccgccacgca

SEQ ID NO: 62047 - DNA, 44 bp, Homo sapiens
cccccgccacgcagttttatccggtaaagcgaatgattagaggt

SEQ ID NO: 62048 - DNA, 45 bp, Homo sapiens
cccccgccacgcagttttatccggtaaagcgaatgattagaggtc

SEQ ID NO: 62049 - DNA, 24 bp, Homo sapiens
ccccgccacgcagttttatccggt

SEQ ID NO: 62050 - DNA, 32 bp, Homo sapiens
ccccgccacgcagttttatccggtaaagcgaa

SEQ ID NO: 62051 - DNA, 35 bp, Homo sapiens
ccccgccacgcagttttatccggtaaagcgaatga

SEQ ID NO: 62052 - DNA, 43 bp, Homo sapiens
ccccgccacgcagttttatccggtaaagcgaatgattagaggt

SEQ ID NO: 62053 - DNA, 44 bp, Homo sapiens
ccccgccacgcagttttatccggtaaagcgaatgattagaggtc

SEQ ID NO: 62054 - DNA, 34 bp, Homo sapiens
cccgccacgcagttttatccggtaaagcgaatga

SEQ ID NO: 62055 - DNA, 43 bp, Homo sapiens; identical to SEQ ID NO: 57761

SEQ ID NO: 62056 - DNA, 30 bp, Homo sapiens
gaatgattagaggtcttggggccgaaacga

SEQ ID NO: 62057 - DNA, 29 bp, Homo sapiens
aatgattagaggtcttggggccgaaacga

SEQ ID NO: 62058 - DNA, 28 bp, Homo sapiens
cgaaacgatctcaacctattctcaaact

SEQ ID NO: 62059 - DNA, 29 bp, Homo sapiens
cgaaacgatctcaacctattctcaaactt

SEQ ID NO: 62060 - DNA, 31 bp, Homo sapiens
ccgaacgccgggttaaggcgcccgatgccga

SEQ ID NO: 62061 - DNA, 37 bp, Homo sapiens
ccgaacgccgggttaaggcgcccgatgccgacgctca

SEQ ID NO: 62062 - DNA, 29 bp, Homo sapiens
gaacgccgggttaaggcgcccgatgccga

SEQ ID NO: 62063 - DNA, 27 bp, Homo sapiens
acgccgggttaaggcgcccgatgccga

SEQ ID NO: 62064 - DNA, 24 bp, Homo sapiens
cgcccgatgccgacgctcatcaga

SEQ ID NO: 62065 - DNA, 22 bp, Homo sapiens
cccgatgccgacgctcatcaga

SEQ ID NO: 62066 - DNA, 25 bp, Homo sapiens
ggcggcggcggcggcgggggtgtgg

SEQ ID NO: 62067 - DNA, 24 bp, Homo sapiens
gcggcggcggcggcgggggtgtgg

SEQ ID NO: 62068 - DNA, 17 bp, Homo sapiens
ggtccttcccccgcccc

SEQ ID NO: 62069 - DNA, 18 bp, Homo sapiens
ggtccttcccccgccccc

SEQ ID NO: 62070 - DNA, 19 bp, Homo sapiens
ggtccttcccccgcccccc

SEQ ID NO: 62071 - DNA, 20 bp, Homo sapiens
ggtccttcccccgccccccc

SEQ ID NO: 62072 - DNA, 23 bp, Homo sapiens
gcctcctcccctcctcccgccca

SEQ ID NO: 62073 - DNA, 29 bp, Homo sapiens
agggccgctgcggtgagccttgaagccta

SEQ ID NO: 62074 - DNA, 32 bp, Homo sapiens; identical to SEQ ID NO: 4742

SEQ ID NO: 62075 - DNA, 34 bp, Homo sapiens
agggccgctgcggtgagccttgaagcctagggcg

SEQ ID NO: 62076 - DNA, 31 bp, Homo sapiens; identical to SEQ ID NO: 22212

SEQ ID NO: 62077 - DNA, 41 bp, Homo sapiens
gggtggagccgccgcaggtgcagatcttggtggtagtagca

SEQ ID NO: 62078 - DNA, 28 bp, Homo sapiens
ctcggccgatcgaaagggagtcgggttc

SEQ ID NO: 62079 - DNA, 30 bp, Homo sapiens; identical to SEQ ID NO: 47678

SEQ ID NO: 62080 - DNA, 21 bp, Homo sapiens
gtccagtgcggtaacgcgacc

SEQ ID NO: 62081 - DNA, 25 bp, Homo sapiens
gtccagtgcggtaacgcgaccgatc

SEQ ID NO: 62082 - DNA, 26 bp, Homo sapiens
gtccagtgcggtaacgcgaccgatcc

SEQ ID NO: 62083 - DNA, 27 bp, Homo sapiens
gtccagtgcggtaacgcgaccgatccc

SEQ ID NO: 62084 - DNA, 20 bp, Homo sapiens
tccagtgcggtaacgcgacc

SEQ ID NO: 62085 - DNA, 22 bp, Homo sapiens
tccagtgcggtaacgcgaccga

SEQ ID NO: 62086 - DNA, 23 bp, Homo sapiens
tccagtgcggtaacgcgaccgat

SEQ ID NO: 62087 - DNA, 17 bp, Homo sapiens
ccagtgcggtaacgcga

SEQ ID NO: 62088 - DNA, 18 bp, Homo sapiens
ccagtgcggtaacgcgac

SEQ ID NO: 62089 - DNA, 19 bp, Homo sapiens
ccagtgcggtaacgcgacc

SEQ ID NO: 62090 - DNA, 21 bp, Homo sapiens
ccagtgcggtaacgcgaccga

SEQ ID NO: 62091 - DNA, 22 bp, Homo sapiens
ccagtgcggtaacgcgaccgat

SEQ ID NO: 62092 - DNA, 23 bp, Homo sapiens
ccagtgcggtaacgcgaccgatc

SEQ ID NO: 62093 - DNA, 27 bp, Homo sapiens
ccagtgcggtaacgcgaccgatcccgg

SEQ ID NO: 62094 - DNA, 28 bp, Homo sapiens
ccagtgcggtaacgcgaccgatcccgga

SEQ ID NO: 62095 - DNA, 30 bp, Homo sapiens; identical to SEQ ID NO: 22929

SEQ ID NO: 62096 - DNA, 31 bp, Homo sapiens; identical to SEQ ID NO: 22930

SEQ ID NO: 62097 - DNA, 32 bp, Homo sapiens
ccagtgcggtaacgcgaccgatcccggagaag

SEQ ID NO: 62098 - DNA, 16 bp, Homo sapiens
cagtgcggtaacgcga

SEQ ID NO: 62099 - DNA, 18 bp, Homo sapiens
cagtgcggtaacgcgacc

SEQ ID NO: 62100 - DNA, 19 bp, Homo sapiens
cagtgcggtaacgcgaccg

SEQ ID NO: 62101 - DNA, 20 bp, Homo sapiens
cagtgcggtaacgcgaccga

SEQ ID NO: 62102 - DNA, 21 bp, Homo sapiens
cagtgcggtaacgcgaccgat

SEQ ID NO: 62103 - DNA, 29 bp, Homo sapiens
cagtgcggtaacgcgaccgatcccggaga

SEQ ID NO: 62104 - DNA, 30 bp, Homo sapiens; identical to SEQ ID NO: 4944

SEQ ID NO: 62105 - DNA, 28 bp, Homo sapiens
agtgcggtaacgcgaccgatcccggaga

SEQ ID NO: 62106 - DNA, 29 bp, Homo sapiens
agtgcggtaacgcgaccgatcccggagaa

SEQ ID NO: 62107 - DNA, 18 bp, Homo sapiens
gtgcggtaacgcgaccga

SEQ ID NO: 62108 - DNA, 19 bp, Homo sapiens
gtgcggtaacgcgaccgat

SEQ ID NO: 62109 - DNA, 20 bp, Homo sapiens
gccggcgggagccccgggga

SEQ ID NO: 62110 - DNA, 40 bp, Homo sapiens
ggcgccctggaatgggttcgccccgagagaggggcccgtg

SEQ ID NO: 62111 - DNA, 38 bp, Homo sapiens; identical to SEQ ID NO: 23194

SEQ ID NO: 62112 - DNA, 40 bp, Homo sapiens; identical to SEQ ID NO: 23196

SEQ ID NO: 62113 - DNA, 26 bp, Homo sapiens
cggcggcgtccggtgagctctcgctg

SEQ ID NO: 62114 - DNA, 31 bp, Homo sapiens; identical to SEQ ID NO: 5042

SEQ ID NO: 62115 - DNA, 33 bp, Homo sapiens; identical to SEQ ID NO: 23248

SEQ ID NO: 62116 - DNA, 25 bp, Homo sapiens
ggcggcgtccggtgagctctcgctg

SEQ ID NO: 62117 - DNA, 29 bp, Homo sapiens
ggcggcgtccggtgagctctcgctggccc

SEQ ID NO: 62118 - DNA, 30 bp, Homo sapiens; identical to SEQ ID NO: 5051

SEQ ID NO: 62119 - DNA, 31 bp, Homo sapiens; identical to SEQ ID NO: 5052

SEQ ID NO: 62120 - DNA, 32 bp, Homo sapiens; identical to SEQ ID NO: 23261

SEQ ID NO: 62121 - DNA, 28 bp, Homo sapiens
gcggcgtccggtgagctctcgctggccc

SEQ ID NO: 62122 - DNA, 29 bp, Homo sapiens
gcggcgtccggtgagctctcgctggccct

SEQ ID NO: 62123 - DNA, 30 bp, Homo sapiens; identical to SEQ ID NO: 23276

SEQ ID NO: 62124 - DNA, 31 bp, Homo sapiens; identical to SEQ ID NO: 5063

SEQ ID NO: 62125 - DNA, 32 bp, Homo sapiens
gcggcgtccggtgagctctcgctggcccttga

SEQ ID NO: 62126 - DNA, 17 bp, Homo sapiens
tgagctctcgctggccc

SEQ ID NO: 62127 - DNA, 16 bp, Homo sapiens
gagctctcgctggccc

SEQ ID NO: 62128 - DNA, 17 bp, Homo sapiens
gggcgcgaagcggggct

SEQ ID NO: 62129 - DNA, 16 bp, Homo sapiens
ggcgcgaagcggggct

SEQ ID NO: 62130 - DNA, 18 bp, Homo sapiens
ggcgcgaagcggggctgg

SEQ ID NO: 62131 - DNA, 16 bp, Homo sapiens
gggcgcgcgccgcggc

SEQ ID NO: 62132 - DNA, 17 bp, Homo sapiens
gggcgcgcgccgcggct

SEQ ID NO: 62133 - DNA, 24 bp, Homo sapiens
ggctggacgaggcgccgccgcccc

SEQ ID NO: 62134 - DNA, 25 bp, Homo sapiens
ggctggacgaggcgccgccgccccc

SEQ ID NO: 62135 - DNA, 26 bp, Homo sapiens
ggctggacgaggcgccgccgcccccc

SEQ ID NO: 62136 - DNA, 22 bp, Homo sapiens
gctggacgaggcgccgccgccc

SEQ ID NO: 62137 - DNA, 23 bp, Homo sapiens
gctggacgaggcgccgccgcccc

SEQ ID NO: 62138 - DNA, 24 bp, Homo sapiens
gctggacgaggcgccgccgccccc

SEQ ID NO: 62139 - DNA, 25 bp, Homo sapiens
gctggacgaggcgccgccgcccccc

SEQ ID NO: 62140 - DNA, 26 bp, Homo sapiens
gctggacgaggcgccgccgccccccc

SEQ ID NO: 62141 - DNA, 28 bp, Homo sapiens
gctggacgaggcgccgccgcccccccca

SEQ ID NO: 62142 - DNA, 23 bp, Homo sapiens
ctggacgaggcgccgccgccccc

SEQ ID NO: 62143 - DNA, 24 bp, Homo sapiens
ctggacgaggcgccgccgcccccc

SEQ ID NO: 62144 - DNA, 19 bp, Homo sapiens
tggacgaggcgccgccgcc

SEQ ID NO: 62145 - DNA, 20 bp, Homo sapiens
tggacgaggcgccgccgccc

SEQ ID NO: 62146 - DNA, 21 bp, Homo sapiens
tggacgaggcgccgccgcccc

SEQ ID NO: 62147 - DNA, 22 bp, Homo sapiens
tggacgaggcgccgccgccccc

SEQ ID NO: 62148 - DNA, 23 bp, Homo sapiens
tggacgaggcgccgccgcccccc

SEQ ID NO: 62149 - DNA, 24 bp, Homo sapiens
tggacgaggcgccgccgccccccc

SEQ ID NO: 62150 - DNA, 26 bp, Homo sapiens
tggacgaggcgccgccgcccccccca

SEQ ID NO: 62151 - DNA, 28 bp, Homo sapiens
tggacgaggcgccgccgccccccccacg

SEQ ID NO: 62152 - DNA, 20 bp, Homo sapiens
ggacgaggcgccgccgcccc

SEQ ID NO: 62153 - DNA, 21 bp, Homo sapiens
ggacgaggcgccgccgccccc

SEQ ID NO: 62154 - DNA, 22 bp, Homo sapiens
ggacgaggcgccgccgcccccc

SEQ ID NO: 62155 - DNA, 24 bp, Homo sapiens
gccgccccccccacgcccggggca

SEQ ID NO: 62156 - DNA, 23 bp, Homo sapiens
ccgccccccccacgcccggggca

SEQ ID NO: 62157 - DNA, 16 bp, Homo sapiens
ccccacgcccggggca

SEQ ID NO: 62158 - DNA, 21 bp, Homo sapiens
ccacgcccggggcacccccct

SEQ ID NO: 62159 - DNA, 33 bp, Homo sapiens
ccacgcccggggcacccccctcgcggccctccc

SEQ ID NO: 62160 - DNA, 34 bp, Homo sapiens
ccacgcccggggcacccccctcgcggccctcccc

SEQ ID NO: 62161 - DNA, 19 bp, Homo sapiens
gggcacccccctcgcggcc

SEQ ID NO: 62162 - DNA, 23 bp, Homo sapiens
gggcacccccctcgcggccctcc

SEQ ID NO: 62163 - DNA, 24 bp, Homo sapiens
gggcacccccctcgcggccctccc

SEQ ID NO: 62164 - DNA, 25 bp, Homo sapiens
gggcacccccctcgcggccctcccc

SEQ ID NO: 62165 - DNA, 18 bp, Homo sapiens
ggcacccccctcgcggcc

SEQ ID NO: 62166 - DNA, 18 bp, Homo sapiens
cccccctcgcggccctcc

SEQ ID NO: 62167 - DNA, 19 bp, Homo sapiens
cccccctcgcggccctccc

SEQ ID NO: 62168 - DNA, 20 bp, Homo sapiens
cccccctcgcggccctcccc

SEQ ID NO: 62169 - DNA, 22 bp, Homo sapiens
ctcgcggccctcccccgcccca

SEQ ID NO: 62170 - DNA, 16 bp, Homo sapiens
cgccccaccccgcgcg

SEQ ID NO: 62171 - DNA, 19 bp, Homo sapiens
cgccccaccccgcgcgcgc

SEQ ID NO: 62172 - DNA, 26 bp, Homo sapiens
gccccaccccgcgcgcgccgctcgct

SEQ ID NO: 62173 - DNA, 21 bp, Homo sapiens
accccgcgcgcgccgctcgct

SEQ ID NO: 62174 - DNA, 19 bp, Homo sapiens
cccgcgcgcgccgctcgct

SEQ ID NO: 62175 - DNA, 20 bp, Homo sapiens
cccgcgcgcgccgctcgctc

SEQ ID NO: 62176 - DNA, 21 bp, Homo sapiens
cccgcgcgcgccgctcgctcc

SEQ ID NO: 62177 - DNA, 16 bp, Homo sapiens
ccgcgcgcgccgctcg

SEQ ID NO: 62178 - DNA, 17 bp, Homo sapiens
ccgcgcgcgccgctcgc

SEQ ID NO: 62179 - DNA, 18 bp, Homo sapiens
ccgcgcgcgccgctcgct

SEQ ID NO: 62180 - DNA, 19 bp, Homo sapiens
ccgcgcgcgccgctcgctc

SEQ ID NO: 62181 - DNA, 20 bp, Homo sapiens
ccgcgcgcgccgctcgctcc

SEQ ID NO: 62182 - DNA, 21 bp, Homo sapiens
ccgcgcgcgccgctcgctccc

SEQ ID NO: 62183 - DNA, 22 bp, Homo sapiens
ccgcgcgcgccgctcgctccct

SEQ ID NO: 62184 - DNA, 23 bp, Homo sapiens
ccgcgcgcgccgctcgctccctc

SEQ ID NO: 62185 - DNA, 24 bp, Homo sapiens
ccgcgcgcgccgctcgctccctcc

SEQ ID NO: 62186 - DNA, 25 bp, Homo sapiens
ccgcgcgcgccgctcgctccctccc

SEQ ID NO: 62187 - DNA, 16 bp, Homo sapiens
cgcgcgcgccgctcgc

SEQ ID NO: 62188 - DNA, 17 bp, Homo sapiens
cgcgcgcgccgctcgct

SEQ ID NO: 62189 - DNA, 18 bp, Homo sapiens
cgcgcgcgccgctcgctc

SEQ ID NO: 62190 - DNA, 19 bp, Homo sapiens
cgcgcgcgccgctcgctcc

SEQ ID NO: 62191 - DNA, 20 bp, Homo sapiens
cgcgcgcgccgctcgctccc

SEQ ID NO: 62192 - DNA, 21 bp, Homo sapiens
cgcgcgcgccgctcgctccct

SEQ ID NO: 62193 - DNA, 22 bp, Homo sapiens
cgcgcgcgccgctcgctccctc

SEQ ID NO: 62194 - DNA, 23 bp, Homo sapiens
cgcgcgcgccgctcgctccctcc

SEQ ID NO: 62195 - DNA, 24 bp, Homo sapiens
cgcgcgcgccgctcgctccctccc

SEQ ID NO: 62196 - DNA, 16 bp, Homo sapiens
gcgcgcgccgctcgct

SEQ ID NO: 62197 - DNA, 17 bp, Homo sapiens
gcgcgcgccgctcgctc

SEQ ID NO: 62198 - DNA, 18 bp, Homo sapiens
gcgcgcgccgctcgctcc

SEQ ID NO: 62199 - DNA, 20 bp, Homo sapiens
gcgcgcgccgctcgctccct

SEQ ID NO: 62200 - DNA, 21 bp, Homo sapiens
gcgcgcgccgctcgctccctc

SEQ ID NO: 62201 - DNA, 22 bp, Homo sapiens
gcgcgcgccgctcgctccctcc

SEQ ID NO: 62202 - DNA, 23 bp, Homo sapiens
gcgcgcgccgctcgctccctccc

SEQ ID NO: 62203 - DNA, 20 bp, Homo sapiens
cgcgcgccgctcgctccctc

SEQ ID NO: 62204 - DNA, 16 bp, Homo sapiens
ccgctcgctccctccc

SEQ ID NO: 62205 - DNA, 16 bp, Homo sapiens
ccgccccgcgccctct

SEQ ID NO: 62206 - DNA, 16 bp, Homo sapiens
cgccccgcgccctctc

SEQ ID NO: 62207 - DNA, 17 bp, Homo sapiens
cgccccgcgccctctct

SEQ ID NO: 62208 - DNA, 20 bp, Homo sapiens
cgccccgcgccctctctctc

SEQ ID NO: 62209 - DNA, 21 bp, Homo sapiens
cgccccgcgccctctctctct

SEQ ID NO: 62210 - DNA, 22 bp, Homo sapiens
cgccccgcgccctctctctctc

SEQ ID NO: 62211 - DNA, 23 bp, Homo sapiens
cgccccgcgccctctctctctct

SEQ ID NO: 62212 - DNA, 33 bp, Homo sapiens
ccctctctctctctctctcccccgctccccgtc

SEQ ID NO: 62213 - DNA, 32 bp, Homo sapiens
cctctctctctctctctcccccgctccccgtc

SEQ ID NO: 62214 - DNA, 33 bp, Homo sapiens
cctctctctctctctctcccccgctccccgtcc

SEQ ID NO: 62215 - DNA, 35 bp, Homo sapiens
cctctctctctctctctcccccgctccccgtcctc

SEQ ID NO: 62216 - DNA, 41 bp, Homo sapiens
cctctctctctctctctcccccgctccccgtcctcccccct

SEQ ID NO: 62217 - DNA, 31 bp, Homo sapiens
ctctctctctctctctcccccgctccccgtc

SEQ ID NO: 62218 - DNA, 29 bp, Homo sapiens
ctctctctctctctcccccgctccccgtc

SEQ ID NO: 62219 - DNA, 38 bp, Homo sapiens
ctctctctctctctcccccgctccccgtcctcccccct

SEQ ID NO: 62220 - DNA, 28 bp, Homo sapiens
tctctctctctctcccccgctccccgtc

SEQ ID NO: 62221 - DNA, 37 bp, Homo sapiens
tctctctctctctcccccgctccccgtcctcccccct

SEQ ID NO: 62222 - DNA, 17 bp, Homo sapiens
ctctctctctctccccc

SEQ ID NO: 62223 - DNA, 25 bp, Homo sapiens
ctctctctctctcccccgctccccg

SEQ ID NO: 62224 - DNA, 26 bp, Homo sapiens
ctctctctctctcccccgctccccgt

SEQ ID NO: 62225 - DNA, 27 bp, Homo sapiens
ctctctctctctcccccgctccccgtc

SEQ ID NO: 62226 - DNA, 28 bp, Homo sapiens
ctctctctctctcccccgctccccgtcc

SEQ ID NO: 62227 - DNA, 29 bp, Homo sapiens
ctctctctctctcccccgctccccgtcct

SEQ ID NO: 62228 - DNA, 30 bp, Homo sapiens; identical to SEQ ID NO: 49600

SEQ ID NO: 62229 - DNA, 31 bp, Homo sapiens
ctctctctctctcccccgctccccgtcctcc

SEQ ID NO: 62230 - DNA, 33 bp, Homo sapiens
ctctctctctctcccccgctccccgtcctcccc

SEQ ID NO: 62231 - DNA, 34 bp, Homo sapiens
ctctctctctctcccccgctccccgtcctccccc

SEQ ID NO: 62232 - DNA, 35 bp, Homo sapiens
ctctctctctctcccccgctccccgtcctcccccc

SEQ ID NO: 62233 - DNA, 36 bp, Homo sapiens
ctctctctctctcccccgctccccgtcctcccccct

SEQ ID NO: 62234 - DNA, 37 bp, Homo sapiens
ctctctctctctcccccgctccccgtcctcccccctc

SEQ ID NO: 62235 - DNA, 25 bp, Homo sapiens
tctctctctctcccccgctccccgt

SEQ ID NO: 62236 - DNA, 26 bp, Homo sapiens
tctctctctctcccccgctccccgtc

SEQ ID NO: 62237 - DNA, 27 bp, Homo sapiens
tctctctctctcccccgctccccgtcc

SEQ ID NO: 62238 - DNA, 28 bp, Homo sapiens
tctctctctctcccccgctccccgtcct

SEQ ID NO: 62239 - DNA, 29 bp, Homo sapiens
tctctctctctcccccgctccccgtcctc

SEQ ID NO: 62240 - DNA, 30 bp, Homo sapiens
tctctctctctcccccgctccccgtcctcc

SEQ ID NO: 62241 - DNA, 34 bp, Homo sapiens
tctctctctctcccccgctccccgtcctcccccc

SEQ ID NO: 62242 - DNA, 35 bp, Homo sapiens
tctctctctctcccccgctccccgtcctcccccct

SEQ ID NO: 62243 - DNA, 36 bp, Homo sapiens
tctctctctctcccccgctccccgtcctcccccctc

SEQ ID NO: 62244 - DNA, 18 bp, Homo sapiens
ctctctctctcccccgct

SEQ ID NO: 62245 - DNA, 21 bp, Homo sapiens
ctctctctctcccccgctccc

SEQ ID NO: 62246 - DNA, 23 bp, Homo sapiens
ctctctctctcccccgctccccg

SEQ ID NO: 62247 - DNA, 24 bp, Homo sapiens
ctctctctctcccccgctccccgt

SEQ ID NO: 62248 - DNA, 25 bp, Homo sapiens
ctctctctctcccccgctccccgtc

SEQ ID NO: 62249 - DNA, 26 bp, Homo sapiens
ctctctctctcccccgctccccgtcc

SEQ ID NO: 62250 - DNA, 27 bp, Homo sapiens
ctctctctctcccccgctccccgtcct

SEQ ID NO: 62251 - DNA, 28 bp, Homo sapiens
ctctctctctcccccgctccccgtcctc

SEQ ID NO: 62252 - DNA, 29 bp, Homo sapiens
ctctctctctcccccgctccccgtcctcc

SEQ ID NO: 62253 - DNA, 30 bp, Homo sapiens; identical to SEQ ID NO: 49626

SEQ ID NO: 62254 - DNA, 31 bp, Homo sapiens
ctctctctctcccccgctccccgtcctcccc

SEQ ID NO: 62255 - DNA, 32 bp, Homo sapiens
ctctctctctcccccgctccccgtcctccccc

SEQ ID NO: 62256 - DNA, 33 bp, Homo sapiens
ctctctctctcccccgctccccgtcctcccccc

SEQ ID NO: 62257 - DNA, 34 bp, Homo sapiens; identical to SEQ ID NO: 24068

SEQ ID NO: 62258 - DNA, 35 bp, Homo sapiens
ctctctctctcccccgctccccgtcctcccccctc

SEQ ID NO: 62259 - DNA, 36 bp, Homo sapiens
ctctctctctcccccgctccccgtcctcccccctcc

SEQ ID NO: 62260 - DNA, 24 bp, Homo sapiens
tctctctctcccccgctccccgtc

SEQ ID NO: 62261 - DNA, 25 bp, Homo sapiens
tctctctctcccccgctccccgtcc

SEQ ID NO: 62262 - DNA, 33 bp, Homo sapiens; identical to SEQ ID NO: 24069

SEQ ID NO: 62263 - DNA, 34 bp, Homo sapiens
tctctctctcccccgctccccgtcctcccccctc

SEQ ID NO: 62264 - DNA, 21 bp, Homo sapiens
ctctctctcccccgctccccg

SEQ ID NO: 62265 - DNA, 22 bp, Homo sapiens
ctctctctcccccgctccccgt

SEQ ID NO: 62266 - DNA, 23 bp, Homo sapiens
ctctctctcccccgctccccgtc

SEQ ID NO: 62267 - DNA, 24 bp, Homo sapiens
ctctctctcccccgctccccgtcc

SEQ ID NO: 62268 - DNA, 25 bp, Homo sapiens
ctctctctcccccgctccccgtcct

SEQ ID NO: 62269 - DNA, 26 bp, Homo sapiens
ctctctctcccccgctccccgtcctc

SEQ ID NO: 62270 - DNA, 27 bp, Homo sapiens
ctctctctcccccgctccccgtcctcc

SEQ ID NO: 62271 - DNA, 29 bp, Homo sapiens
ctctctctcccccgctccccgtcctcccc

SEQ ID NO: 62272 - DNA, 30 bp, Homo sapiens; identical to SEQ ID NO: 49651

SEQ ID NO: 62273 - DNA, 31 bp, Homo sapiens
ctctctctcccccgctccccgtcctcccccc

SEQ ID NO: 62274 - DNA, 32 bp, Homo sapiens; identical to SEQ ID NO: 24070

SEQ ID NO: 62275 - DNA, 33 bp, Homo sapiens
ctctctctcccccgctccccgtcctcccccctc

SEQ ID NO: 62276 - DNA, 22 bp, Homo sapiens
tctctctcccccgctccccgtc

SEQ ID NO: 62277 - DNA, 31 bp, Homo sapiens; identical to SEQ ID NO: 24071

SEQ ID NO: 62278 - DNA, 32 bp, Homo sapiens
tctctctcccccgctccccgtcctcccccctc

SEQ ID NO: 62279 - DNA, 20 bp, Homo sapiens
ctctctcccccgctccccgt

SEQ ID NO: 62280 - DNA, 21 bp, Homo sapiens
ctctctcccccgctccccgtc

SEQ ID NO: 62281 - DNA, 22 bp, Homo sapiens
ctctctcccccgctccccgtcc

SEQ ID NO: 62282 - DNA, 23 bp, Homo sapiens
ctctctcccccgctccccgtcct

SEQ ID NO: 62283 - DNA, 24 bp, Homo sapiens
ctctctcccccgctccccgtcctc

SEQ ID NO: 62284 - DNA, 25 bp, Homo sapiens
ctctctcccccgctccccgtcctcc

SEQ ID NO: 62285 - DNA, 29 bp, Homo sapiens
ctctctcccccgctccccgtcctcccccc

SEQ ID NO: 62286 - DNA, 30 bp, Homo sapiens; identical to SEQ ID NO: 24072

SEQ ID NO: 62287 - DNA, 31 bp, Homo sapiens
ctctctcccccgctccccgtcctcccccctc

SEQ ID NO: 62288 - DNA, 20 bp, Homo sapiens
tctctcccccgctccccgtc

SEQ ID NO: 62289 - DNA, 23 bp, Homo sapiens
tctctcccccgctccccgtcctc

SEQ ID NO: 62290 - DNA, 29 bp, Homo sapiens
tctctcccccgctccccgtcctcccccct

SEQ ID NO: 62291 - DNA, 30 bp, Homo sapiens
tctctcccccgctccccgtcctcccccctc

SEQ ID NO: 62292 - DNA, 17 bp, Homo sapiens
ctctcccccgctccccg

SEQ ID NO: 62293 - DNA, 18 bp, Homo sapiens
ctctcccccgctccccgt

SEQ ID NO: 62294 - DNA, 19 bp, Homo sapiens
ctctcccccgctccccgtc

SEQ ID NO: 62295 - DNA, 20 bp, Homo sapiens
ctctcccccgctccccgtcc

SEQ ID NO: 62296 - DNA, 21 bp, Homo sapiens
ctctcccccgctccccgtcct

SEQ ID NO: 62297 - DNA, 22 bp, Homo sapiens
ctctcccccgctccccgtcctc

SEQ ID NO: 62298 - DNA, 23 bp, Homo sapiens
ctctcccccgctccccgtcctcc

SEQ ID NO: 62299 - DNA, 24 bp, Homo sapiens
ctctcccccgctccccgtcctccc

SEQ ID NO: 62300 - DNA, 25 bp, Homo sapiens
ctctcccccgctccccgtcctcccc

SEQ ID NO: 62301 - DNA, 26 bp, Homo sapiens
ctctcccccgctccccgtcctccccc

SEQ ID NO: 62302 - DNA, 27 bp, Homo sapiens
ctctcccccgctccccgtcctcccccc

SEQ ID NO: 62303 - DNA, 28 bp, Homo sapiens
ctctcccccgctccccgtcctcccccct

SEQ ID NO: 62304 - DNA, 29 bp, Homo sapiens
ctctcccccgctccccgtcctcccccctc

SEQ ID NO: 62305 - DNA, 30 bp, Homo sapiens; identical to SEQ ID NO: 49701

SEQ ID NO: 62306 - DNA, 17 bp, Homo sapiens
tctcccccgctccccgt

SEQ ID NO: 62307 - DNA, 18 bp, Homo sapiens
tctcccccgctccccgtc

SEQ ID NO: 62308 - DNA, 19 bp, Homo sapiens
tctcccccgctccccgtcc

SEQ ID NO: 62309 - DNA, 21 bp, Homo sapiens
tctcccccgctccccgtcctc

SEQ ID NO: 62310 - DNA, 22 bp, Homo sapiens
tctcccccgctccccgtcctcc

SEQ ID NO: 62311 - DNA, 26 bp, Homo sapiens
tctcccccgctccccgtcctcccccc

SEQ ID NO: 62312 - DNA, 27 bp, Homo sapiens
tctcccccgctccccgtcctcccccct

SEQ ID NO: 62313 - DNA, 28 bp, Homo sapiens
tctcccccgctccccgtcctcccccctc

SEQ ID NO: 62314 - DNA, 16 bp, Homo sapiens
ctcccccgctccccgt

SEQ ID NO: 62315 - DNA, 17 bp, Homo sapiens
ctcccccgctccccgtc

SEQ ID NO: 62316 - DNA, 18 bp, Homo sapiens
ctcccccgctccccgtcc

SEQ ID NO: 62317 - DNA, 19 bp, Homo sapiens
ctcccccgctccccgtcct

SEQ ID NO: 62318 - DNA, 20 bp, Homo sapiens
ctcccccgctccccgtcctc

SEQ ID NO: 62319 - DNA, 21 bp, Homo sapiens
ctcccccgctccccgtcctcc

SEQ ID NO: 62320 - DNA, 22 bp, Homo sapiens
ctcccccgctccccgtcctccc

SEQ ID NO: 62321 - DNA, 23 bp, Homo sapiens
ctcccccgctccccgtcctcccc

SEQ ID NO: 62322 - DNA, 24 bp, Homo sapiens
ctcccccgctccccgtcctccccc

SEQ ID NO: 62323 - DNA, 25 bp, Homo sapiens
ctcccccgctccccgtcctcccccc

SEQ ID NO: 62324 - DNA, 26 bp, Homo sapiens
ctcccccgctccccgtcctcccccct

SEQ ID NO: 62325 - DNA, 27 bp, Homo sapiens
ctcccccgctccccgtcctcccccctc

SEQ ID NO: 62326 - DNA, 28 bp, Homo sapiens
ctcccccgctccccgtcctcccccctcc

SEQ ID NO: 62327 - DNA, 16 bp, Homo sapiens
tcccccgctccccgtc

SEQ ID NO: 62328 - DNA, 17 bp, Homo sapiens
tcccccgctccccgtcc

SEQ ID NO: 62329 - DNA, 18 bp, Homo sapiens
tcccccgctccccgtcct

SEQ ID NO: 62330 - DNA, 19 bp, Homo sapiens
tcccccgctccccgtcctc

SEQ ID NO: 62331 - DNA, 20 bp, Homo sapiens
tcccccgctccccgtcctcc

SEQ ID NO: 62332 - DNA, 24 bp, Homo sapiens
tcccccgctccccgtcctcccccc

SEQ ID NO: 62333 - DNA, 25 bp, Homo sapiens
tcccccgctccccgtcctcccccct

SEQ ID NO: 62334 - DNA, 26 bp, Homo sapiens
tcccccgctccccgtcctcccccctc

SEQ ID NO: 62335 - DNA, 27 bp, Homo sapiens
tcccccgctccccgtcctcccccctcc

SEQ ID NO: 62336 - DNA, 16 bp, Homo sapiens
cccccgctccccgtcc

SEQ ID NO: 62337 - DNA, 17 bp, Homo sapiens
cccccgctccccgtcct

SEQ ID NO: 62338 - DNA, 18 bp, Homo sapiens
cccccgctccccgtcctc

SEQ ID NO: 62339 - DNA, 19 bp, Homo sapiens
cccccgctccccgtcctcc

SEQ ID NO: 62340 - DNA, 20 bp, Homo sapiens
cccccgctccccgtcctccc

SEQ ID NO: 62341 - DNA, 21 bp, Homo sapiens
cccccgctccccgtcctcccc

SEQ ID NO: 62342 - DNA, 22 bp, Homo sapiens
cccccgctccccgtcctccccc

SEQ ID NO: 62343 - DNA, 23 bp, Homo sapiens
cccccgctccccgtcctcccccc

SEQ ID NO: 62344 - DNA, 24 bp, Homo sapiens
cccccgctccccgtcctcccccct

SEQ ID NO: 62345 - DNA, 25 bp, Homo sapiens
cccccgctccccgtcctcccccctc

SEQ ID NO: 62346 - DNA, 26 bp, Homo sapiens
cccccgctccccgtcctcccccctcc

SEQ ID NO: 62347 - DNA, 17 bp, Homo sapiens
ccccgctccccgtcctc

SEQ ID NO: 62348 - DNA, 18 bp, Homo sapiens
ccccgctccccgtcctcc

SEQ ID NO: 62349 - DNA, 22 bp, Homo sapiens
ccccgctccccgtcctcccccc

SEQ ID NO: 62350 - DNA, 23 bp, Homo sapiens
ccccgctccccgtcctcccccct

SEQ ID NO: 62351 - DNA, 24 bp, Homo sapiens
ccccgctccccgtcctcccccctc

SEQ ID NO: 62352 - DNA, 25 bp, Homo sapiens
ccccgctccccgtcctcccccctcc

SEQ ID NO: 62353 - DNA, 16 bp, Homo sapiens
cccgctccccgtcctc

SEQ ID NO: 62354 - DNA, 17 bp, Homo sapiens
cccgctccccgtcctcc

SEQ ID NO: 62355 - DNA, 21 bp, Homo sapiens
cccgctccccgtcctcccccc

SEQ ID NO: 62356 - DNA, 22 bp, Homo sapiens
cccgctccccgtcctcccccct

SEQ ID NO: 62357 - DNA, 23 bp, Homo sapiens
cccgctccccgtcctcccccctc

SEQ ID NO: 62358 - DNA, 16 bp, Homo sapiens
ccgctccccgtcctcc

SEQ ID NO: 62359 - DNA, 19 bp, Homo sapiens
ccgctccccgtcctccccc

SEQ ID NO: 62360 - DNA, 20 bp, Homo sapiens
ccgctccccgtcctcccccc

SEQ ID NO: 62361 - DNA, 21 bp, Homo sapiens
ccgctccccgtcctcccccct

SEQ ID NO: 62362 - DNA, 22 bp, Homo sapiens
ccgctccccgtcctcccccctc

SEQ ID NO: 62363 - DNA, 23 bp, Homo sapiens
ccgctccccgtcctcccccctcc

SEQ ID NO: 62364 - DNA, 19 bp, Homo sapiens
cgctccccgtcctcccccc

SEQ ID NO: 62365 - DNA, 20 bp, Homo sapiens
cgctccccgtcctcccccct

SEQ ID NO: 62366 - DNA, 21 bp, Homo sapiens
cgctccccgtcctcccccctc

SEQ ID NO: 62367 - DNA, 22 bp, Homo sapiens
cgctccccgtcctcccccctcc

SEQ ID NO: 62368 - DNA, 16 bp, Homo sapiens
gctccccgtcctcccc

SEQ ID NO: 62369 - DNA, 17 bp, Homo sapiens
gctccccgtcctccccc

SEQ ID NO: 62370 - DNA, 18 bp, Homo sapiens
gctccccgtcctcccccc

SEQ ID NO: 62371 - DNA, 19 bp, Homo sapiens
gctccccgtcctcccccct

SEQ ID NO: 62372 - DNA, 20 bp, Homo sapiens
gctccccgtcctcccccctc

SEQ ID NO: 62373 - DNA, 21 bp, Homo sapiens
gctccccgtcctcccccctcc

SEQ ID NO: 62374 - DNA, 22 bp, Homo sapiens
gctccccgtcctcccccctccc

SEQ ID NO: 62375 - DNA, 23 bp, Homo sapiens
gctccccgtcctcccccctcccc

SEQ ID NO: 62376 - DNA, 24 bp, Homo sapiens
gctccccgtcctcccccctccccg

SEQ ID NO: 62377 - DNA, 17 bp, Homo sapiens
ctccccgtcctcccccc

SEQ ID NO: 62378 - DNA, 18 bp, Homo sapiens
ctccccgtcctcccccct

SEQ ID NO: 62379 - DNA, 19 bp, Homo sapiens
ctccccgtcctcccccctc

SEQ ID NO: 62380 - DNA, 20 bp, Homo sapiens
ctccccgtcctcccccctcc

SEQ ID NO: 62381 - DNA, 17 bp, Homo sapiens
tccccgtcctcccccct

SEQ ID NO: 62382 - DNA, 18 bp, Homo sapiens
tccccgtcctcccccctc

SEQ ID NO: 62383 - DNA, 16 bp, Homo sapiens
ccccgtcctcccccct

SEQ ID NO: 62384 - DNA, 17 bp, Homo sapiens
ccccgtcctcccccctc

SEQ ID NO: 62385 - DNA, 16 bp, Homo sapiens
cccgtcctcccccctc

SEQ ID NO: 62386 - DNA, 17 bp, Homo sapiens
ccctccccgggggagcg

SEQ ID NO: 62387 - DNA, 16 bp, Homo sapiens
cctccccgggggagcg

SEQ ID NO: 62388 - DNA, 17 bp, Homo sapiens
cctccccgggggagcgc

SEQ ID NO: 62389 - DNA, 17 bp, Homo sapiens
ctccccgggggagcgcc

SEQ ID NO: 62390 - DNA, 17 bp, Homo sapiens
cgggggagcgccgcgtg

SEQ ID NO: 62391 - DNA, 31 bp, Homo sapiens
cgggggagcgccgcgtgggggcggcggcggg

SEQ ID NO: 62392 - DNA, 27 bp, Homo sapiens
gggggagcgccgcgtgggggcggcggc

SEQ ID NO: 62393 - DNA, 28 bp, Homo sapiens
gggggagcgccgcgtgggggcggcggcg

SEQ ID NO: 62394 - DNA, 20 bp, Homo sapiens
cggcggcccgccgcggggcc

SEQ ID NO: 62395 - DNA, 16 bp, Homo sapiens
cggcggcgggggcacg

SEQ ID NO: 62396 - DNA, 19 bp, Homo sapiens
cggcggcgggggcacggtc

SEQ ID NO: 62397 - DNA, 18 bp, Homo sapiens
ggcggcgggggcacggtc

SEQ ID NO: 62398 - DNA, 17 bp, Homo sapiens
cccgcgaggggggcccg

SEQ ID NO: 62399 - DNA, 16 bp, Homo sapiens
ccgcgaggggggcccg

SEQ ID NO: 62400 - DNA, 17 bp, Homo sapiens
gggcacccggggggccg

SEQ ID NO: 62401 - DNA, 16 bp, Homo sapiens
ggcacccggggggccg

SEQ ID NO: 62402 - DNA, 22 bp, Homo sapiens
ggcacccggggggccggcggcg

SEQ ID NO: 62403 - DNA, 31 bp, Homo sapiens; identical to SEQ ID NO: 60612

SEQ ID NO: 62404 - DNA, 30 bp, Homo sapiens; identical to SEQ ID NO: 50326

SEQ ID NO: 62405 - DNA, 28 bp, Homo sapiens
acccggggggccggcggcggcggcgact

SEQ ID NO: 62406 - DNA, 27 bp, Homo sapiens
cccggggggccggcggcggcggcgact

SEQ ID NO: 62407 - DNA, 25 bp, Homo sapiens
cggggggccggcggcggcggcgact

SEQ ID NO: 62408 - DNA, 24 bp, Homo sapiens
ggggggccggcggcggcggcgact

SEQ ID NO: 62409 - DNA, 26 bp, Homo sapiens
ggggggccggcggcggcggcgactct

SEQ ID NO: 62410 - DNA, 23 bp, Homo sapiens
gggggccggcggcggcggcgact

SEQ ID NO: 62411 - DNA, 25 bp, Homo sapiens
gggggccggcggcggcggcgactct

SEQ ID NO: 62412 - DNA, 22 bp, Homo sapiens
ggggccggcggcggcggcgact

SEQ ID NO: 62413 - DNA, 21 bp, Homo sapiens
gggccggcggcggcggcgact

SEQ ID NO: 62414 - DNA, 18 bp, Homo sapiens
ccggcggcggcggcgact

SEQ ID NO: 62415 - DNA, 22 bp, Homo sapiens
gcggcgactctggacgcgagcc

SEQ ID NO: 62416 - DNA, 20 bp, Homo sapiens
ctggacgcgagccgggccct

SEQ ID NO: 62417 - DNA, 21 bp, Homo sapiens
ctggacgcgagccgggccctt

SEQ ID NO: 62418 - DNA, 22 bp, Homo sapiens
ctggacgcgagccgggcccttc

SEQ ID NO: 62419 - DNA, 36 bp, Homo sapiens; identical to SEQ ID NO: 60772

SEQ ID NO: 62420 - DNA, 20 bp, Homo sapiens
tggacgcgagccgggccctt

SEQ ID NO: 62421 - DNA, 21 bp, Homo sapiens
tggacgcgagccgggcccttc

SEQ ID NO: 62422 - DNA, 16 bp, Homo sapiens
ggacgcgagccgggcc

SEQ ID NO: 62423 - DNA, 17 bp, Homo sapiens
ggacgcgagccgggccc

SEQ ID NO: 62424 - DNA, 18 bp, Homo sapiens
ggacgcgagccgggccct

SEQ ID NO: 62425 - DNA, 19 bp, Homo sapiens
ggacgcgagccgggccctt

SEQ ID NO: 62426 - DNA, 20 bp, Homo sapiens
ggacgcgagccgggcccttc

SEQ ID NO: 62427 - DNA, 27 bp, Homo sapiens
ggacgcgagccgggcccttcccgtgga

SEQ ID NO: 62428 - DNA, 28 bp, Homo sapiens
ggacgcgagccgggcccttcccgtggat

SEQ ID NO: 62429 - DNA, 23 bp, Homo sapiens
cgagccgggcccttcccgtggat

SEQ ID NO: 62430 - DNA, 17 bp, Homo sapiens
gggcccttcccgtggat

SEQ ID NO: 62431 - DNA, 24 bp, Homo sapiens
ccccccaccccacgtctcgtcgcg

SEQ ID NO: 62432 - DNA, 19 bp, Homo sapiens
ccccaccccacgtctcgtc

SEQ ID NO: 62433 - DNA, 22 bp, Homo sapiens
ccccaccccacgtctcgtcgcg

SEQ ID NO: 62434 - DNA, 23 bp, Homo sapiens
ccccaccccacgtctcgtcgcgc

SEQ ID NO: 62435 - DNA, 24 bp, Homo sapiens
ccccaccccacgtctcgtcgcgcg

SEQ ID NO: 62436 - DNA, 21 bp, Homo sapiens
cccaccccacgtctcgtcgcg

SEQ ID NO: 62437 - DNA, 17 bp, Homo sapiens
ccaccccacgtctcgtc

SEQ ID NO: 62438 - DNA, 18 bp, Homo sapiens
ccaccccacgtctcgtcg

SEQ ID NO: 62439 - DNA, 19 bp, Homo sapiens
ccaccccacgtctcgtcgc

SEQ ID NO: 62440 - DNA, 20 bp, Homo sapiens
ccaccccacgtctcgtcgcg

SEQ ID NO: 62441 - DNA, 21 bp, Homo sapiens
ccaccccacgtctcgtcgcgc

SEQ ID NO: 62442 - DNA, 22 bp, Homo sapiens
ccaccccacgtctcgtcgcgcg

SEQ ID NO: 62443 - DNA, 23 bp, Homo sapiens
ccaccccacgtctcgtcgcgcgc

SEQ ID NO: 62444 - DNA, 24 bp, Homo sapiens
ccaccccacgtctcgtcgcgcgcg

SEQ ID NO: 62445 - DNA, 25 bp, Homo sapiens
ccaccccacgtctcgtcgcgcgcgc

SEQ ID NO: 62446 - DNA, 28 bp, Homo sapiens
ccaccccacgtctcgtcgcgcgcgcgtc

SEQ ID NO: 62447 - DNA, 32 bp, Homo sapiens
ccaccccacgtctcgtcgcgcgcgcgtccgct

SEQ ID NO: 62448 - DNA, 16 bp, Homo sapiens
accccacgtctcgtcg

SEQ ID NO: 62449 - DNA, 17 bp, Homo sapiens
accccacgtctcgtcgc

SEQ ID NO: 62450 - DNA, 18 bp, Homo sapiens
accccacgtctcgtcgcg

SEQ ID NO: 62451 - DNA, 19 bp, Homo sapiens
accccacgtctcgtcgcgc

SEQ ID NO: 62452 - DNA, 20 bp, Homo sapiens
accccacgtctcgtcgcgcg

SEQ ID NO: 62453 - DNA, 22 bp, Homo sapiens
accccacgtctcgtcgcgcgcg

SEQ ID NO: 62454 - DNA, 23 bp, Homo sapiens
accccacgtctcgtcgcgcgcgc

SEQ ID NO: 62455 - DNA, 26 bp, Homo sapiens
accccacgtctcgtcgcgcgcgcgtc

SEQ ID NO: 62456 - DNA, 30 bp, Homo sapiens
accccacgtctcgtcgcgcgcgcgtccgct

SEQ ID NO: 62457 - DNA, 17 bp, Homo sapiens
ccccacgtctcgtcgcg

SEQ ID NO: 62458 - DNA, 19 bp, Homo sapiens
ccccacgtctcgtcgcgcg

SEQ ID NO: 62459 - DNA, 16 bp, Homo sapiens
cccacgtctcgtcgcg

SEQ ID NO: 62460 - DNA, 24 bp, Homo sapiens
cccacgtctcgtcgcgcgcgcgtc

SEQ ID NO: 62461 - DNA, 23 bp, Homo sapiens
ccacgtctcgtcgcgcgcgcgtc

SEQ ID NO: 62462 - DNA, 21 bp, Homo sapiens
acgtctcgtcgcgcgcgcgtc

SEQ ID NO: 62463 - DNA, 25 bp, Homo sapiens
acgtctcgtcgcgcgcgcgtccgct

SEQ ID NO: 62464 - DNA, 17 bp, Homo sapiens
cgtctcgtcgcgcgcgc

SEQ ID NO: 62465 - DNA, 20 bp, Homo sapiens
cgtctcgtcgcgcgcgcgtc

SEQ ID NO: 62466 - DNA, 24 bp, Homo sapiens
cgtctcgtcgcgcgcgcgtccgct

SEQ ID NO: 62467 - DNA, 19 bp, Homo sapiens
gtctcgtcgcgcgcgcgtc

SEQ ID NO: 62468 - DNA, 23 bp, Homo sapiens
gtctcgtcgcgcgcgcgtccgct

SEQ ID NO: 62469 - DNA, 19 bp, Homo sapiens
cgtcgcgcgcgcgtccgct

SEQ ID NO: 62470 - DNA, 18 bp, Homo sapiens
gtcgcgcgcgcgtccgct

SEQ ID NO: 62471 - DNA, 16 bp, Homo sapiens
cgcgcgcgcgtccgct

SEQ ID NO: 62472 - DNA, 25 bp, Homo sapiens
cgcgcgtccgctgggggcggggagc

SEQ ID NO: 62473 - DNA, 19 bp, Homo sapiens
ccgccccccgttcccccct

SEQ ID NO: 62474 - DNA, 23 bp, Homo sapiens
ccgccccccgttcccccctcctc

SEQ ID NO: 62475 - DNA, 24 bp, Homo sapiens
ccgccccccgttcccccctcctcc

SEQ ID NO: 62476 - DNA, 17 bp, Homo sapiens
gccccccgttcccccct

SEQ ID NO: 62477 - DNA, 22 bp, Homo sapiens
gccccccgttcccccctcctcc

SEQ ID NO: 62478 - DNA, 16 bp, Homo sapiens
ccccccgttcccccct

SEQ ID NO: 62479 - DNA, 20 bp, Homo sapiens
ccccccgttcccccctcctc

SEQ ID NO: 62480 - DNA, 17 bp, Homo sapiens
cccgttcccccctcctc

SEQ ID NO: 62481 - DNA, 18 bp, Homo sapiens
cccgttcccccctcctcc

SEQ ID NO: 62482 - DNA, 16 bp, Homo sapiens
ggcggcggaggggccg

SEQ ID NO: 62483 - DNA, 17 bp, Homo sapiens
cgggccggtcccccccg

SEQ ID NO: 62484 - DNA, 18 bp, Homo sapiens
cgggccggtcccccccgc

SEQ ID NO: 62485 - DNA, 20 bp, Homo sapiens
cgggccggtcccccccgccg

SEQ ID NO: 62486 - DNA, 24 bp, Homo sapiens
cgggccggtcccccccgccgggtc

SEQ ID NO: 62487 - DNA, 25 bp, Homo sapiens
cgggccggtcccccccgccgggtcc

SEQ ID NO: 62488 - DNA, 27 bp, Homo sapiens
cgggccggtcccccccgccgggtccgc

SEQ ID NO: 62489 - DNA, 16 bp, Homo sapiens
gggccggtcccccccg

SEQ ID NO: 62490 - DNA, 23 bp, Homo sapiens
gggccggtcccccccgccgggtc

SEQ ID NO: 62491 - DNA, 16 bp, Homo sapiens
ggccggtcccccccgc

SEQ ID NO: 62492 - DNA, 26 bp, Homo sapiens
ggccggtcccccccgccgggtccgcc

SEQ ID NO: 62493 - DNA, 23 bp, Homo sapiens
cccgccgggtccgcccccggggc

SEQ ID NO: 62494 - DNA, 25 bp, Homo sapiens
cccgccgggtccgcccccggggccg

SEQ ID NO: 62495 - DNA, 26 bp, Homo sapiens
cccgccgggtccgcccccggggccgc

SEQ ID NO: 62496 - DNA, 24 bp, Homo sapiens
ccgccgggtccgcccccggggccg

SEQ ID NO: 62497 - DNA, 25 bp, Homo sapiens
ccgccgggtccgcccccggggccgc

SEQ ID NO: 62498 - DNA, 16 bp, Homo sapiens
cccggggccgcggttc

SEQ ID NO: 62499 - DNA, 34 bp, Homo sapiens
atcgcgaaggcccgcggcgggtgttgacgcgatg

SEQ ID NO: 62500 - DNA, 37 bp, Homo sapiens
atcgcgaaggcccgcggcgggtgttgacgcgatgtga

SEQ ID NO: 62501 - DNA, 33 bp, Homo sapiens
tcgcgaaggcccgcggcgggtgttgacgcgatg

SEQ ID NO: 62502 - DNA, 35 bp, Homo sapiens
tcgcgaaggcccgcggcgggtgttgacgcgatgtg

SEQ ID NO: 62503 - DNA, 36 bp, Homo sapiens
tcgcgaaggcccgcggcgggtgttgacgcgatgtga

SEQ ID NO: 62504 - DNA, 31 bp, Homo sapiens
cgcgaaggcccgcggcgggtgttgacgcgat

SEQ ID NO: 62505 - DNA, 32 bp, Homo sapiens
cgcgaaggcccgcggcgggtgttgacgcgatg

SEQ ID NO: 62506 - DNA, 33 bp, Homo sapiens
cgcgaaggcccgcggcgggtgttgacgcgatgt

SEQ ID NO: 62507 - DNA, 34 bp, Homo sapiens
cgcgaaggcccgcggcgggtgttgacgcgatgtg

SEQ ID NO: 62508 - DNA, 35 bp, Homo sapiens
cgcgaaggcccgcggcgggtgttgacgcgatgtga

SEQ ID NO: 62509 - DNA, 36 bp, Homo sapiens
cgcgaaggcccgcggcgggtgttgacgcgatgtgat

SEQ ID NO: 62510 - DNA, 26 bp, Homo sapiens
gcggcgggtgttgacgcgatgtgatt

SEQ ID NO: 62511 - DNA, 31 bp, Homo sapiens; identical to SEQ ID NO: 5660

SEQ ID NO: 62512 - DNA, 32 bp, Homo sapiens; identical to SEQ ID NO: 5661

SEQ ID NO: 62513 - DNA, 30 bp, Homo sapiens; identical to SEQ ID NO: 5672

SEQ ID NO: 62514 - DNA, 29 bp, Homo sapiens
cccagtgctctgaatgtcaaagtgaagaa

SEQ ID NO: 62515 - DNA, 30 bp, Homo sapiens
cccagtgctctgaatgtcaaagtgaagaaa

SEQ ID NO: 62516 - DNA, 28 bp, Homo sapiens
ccagtgctctgaatgtcaaagtgaagaa

SEQ ID NO: 62517 - DNA, 29 bp, Homo sapiens
ccagtgctctgaatgtcaaagtgaagaaa

SEQ ID NO: 62518 - DNA, 27 bp, Homo sapiens
atgtcaaagtgaagaaattcaatgaag

SEQ ID NO: 62519 - DNA, 28 bp, Homo sapiens
atgtcaaagtgaagaaattcaatgaagc

SEQ ID NO: 62520 - DNA, 30 bp, Homo sapiens
atgtcaaagtgaagaaattcaatgaagcgc

SEQ ID NO: 62521 - DNA, 42 bp, Homo sapiens
caaagtgaagaaattcaatgaagcgcgggtaaacggcgggag

SEQ ID NO: 62522 - DNA, 43 bp, Homo sapiens
caaagtgaagaaattcaatgaagcgcgggtaaacggcgggagt

SEQ ID NO: 62523 - DNA, 30 bp, Homo sapiens
tgaagcgcgggtaaacggcgggagtaacta

SEQ ID NO: 62524 - DNA, 29 bp, Homo sapiens
gaagcgcgggtaaacggcgggagtaacta

SEQ ID NO: 62525 - DNA, 28 bp, Homo sapiens
aagcgcgggtaaacggcgggagtaacta

SEQ ID NO: 62526 - DNA, 27 bp, Homo sapiens
agcgcgggtaaacggcgggagtaacta

SEQ ID NO: 62527 - DNA, 16 bp, Homo sapiens
ggtagccaaatgcctc

SEQ ID NO: 62528 - DNA, 18 bp, Homo sapiens
ggtagccaaatgcctcgt

SEQ ID NO: 62529 - DNA, 19 bp, Homo sapiens
ggtagccaaatgcctcgtc

SEQ ID NO: 62530 - DNA, 20 bp, Homo sapiens
ggtagccaaatgcctcgtca

SEQ ID NO: 62531 - DNA, 16 bp, Homo sapiens
atctaattagtgacgc

SEQ ID NO: 62532 - DNA, 37 bp, Homo sapiens
gacgcgcatgaatggatgaacgagattcccactgtcc

SEQ ID NO: 62533 - DNA, 38 bp, Homo sapiens
gacgcgcatgaatggatgaacgagattcccactgtccc

SEQ ID NO: 62534 - DNA, 35 bp, Homo sapiens; identical to SEQ ID NO: 25842

SEQ ID NO: 62535 - DNA, 36 bp, Homo sapiens; identical to SEQ ID NO: 25843

SEQ ID NO: 62536 - DNA, 38 bp, Homo sapiens
cgcgcatgaatggatgaacgagattcccactgtcccta

SEQ ID NO: 62537 - DNA, 32 bp, Homo sapiens; identical to SEQ ID NO: 25850

SEQ ID NO: 62538 - DNA, 33 bp, Homo sapiens; identical to SEQ ID NO: 25851

SEQ ID NO: 62539 - DNA, 35 bp, Homo sapiens
gcatgaatggatgaacgagattcccactgtcccta

SEQ ID NO: 62540 - DNA, 18 bp, Homo sapiens
tggatgaacgagattccc

SEQ ID NO: 62541 - DNA, 25 bp, Homo sapiens
tggatgaacgagattcccactgtcc

SEQ ID NO: 62542 - DNA, 26 bp, Homo sapiens
tggatgaacgagattcccactgtccc

SEQ ID NO: 62543 - DNA, 28 bp, Homo sapiens
tggatgaacgagattcccactgtcccta

SEQ ID NO: 62544 - DNA, 30 bp, Homo sapiens; identical to SEQ ID NO: 52923

SEQ ID NO: 62545 - DNA, 31 bp, Homo sapiens
tggatgaacgagattcccactgtccctacct

SEQ ID NO: 62546 - DNA, 32 bp, Homo sapiens
tggatgaacgagattcccactgtccctaccta

SEQ ID NO: 62547 - DNA, 37 bp, Homo sapiens
tggatgaacgagattcccactgtccctacctactatc

SEQ ID NO: 62548 - DNA, 38 bp, Homo sapiens
tggatgaacgagattcccactgtccctacctactatcc

SEQ ID NO: 62549 - DNA, 32 bp, Homo sapiens; identical to SEQ ID NO: 25885

SEQ ID NO: 62550 - DNA, 33 bp, Homo sapiens; identical to SEQ ID NO: 25886

SEQ ID NO: 62551 - DNA, 31 bp, Homo sapiens; identical to SEQ ID NO: 5808

SEQ ID NO: 62552 - DNA, 32 bp, Homo sapiens; identical to SEQ ID NO: 5809

SEQ ID NO: 62553 - DNA, 31 bp, Homo sapiens
acgagattcccactgtccctacctactatcc

SEQ ID NO: 62554 - DNA, 18 bp, Homo sapiens
tgtccctacctactatcc

SEQ ID NO: 62555 - DNA, 16 bp, Homo sapiens
gtccctacctactatc

SEQ ID NO: 62556 - DNA, 17 bp, Homo sapiens
gtccctacctactatcc

SEQ ID NO: 62557 - DNA, 24 bp, Homo sapiens
ccctacctactatccagcgaaacc

SEQ ID NO: 62558 - DNA, 16 bp, Homo sapiens
ggcgcccccccggtgt

SEQ ID NO: 62559 - DNA, 17 bp, Homo sapiens
ggcgcccccccggtgtc

SEQ ID NO: 62560 - DNA, 16 bp, Homo sapiens
gcgcccccccggtgtc

SEQ ID NO: 62561 - DNA, 17 bp, Homo sapiens
gcgcccccccggtgtcc

SEQ ID NO: 62562 - DNA, 19 bp, Homo sapiens
gcgcccccccggtgtcccc

SEQ ID NO: 62563 - DNA, 20 bp, Homo sapiens
cccgcgaggggcccggggcg

SEQ ID NO: 62564 - DNA, 19 bp, Homo sapiens
ccgcgaggggcccggggcg

SEQ ID NO: 62565 - DNA, 29 bp, Homo sapiens
ccgcgaggggcccggggcggggtccgccg

SEQ ID NO: 62566 - DNA, 30 bp, Homo sapiens; identical to SEQ ID NO: 26176

SEQ ID NO: 62567 - DNA, 27 bp, Homo sapiens
tgcgggccgccggtgaaataccactac

SEQ ID NO: 62568 - DNA, 28 bp, Homo sapiens
tgcgggccgccggtgaaataccactact

SEQ ID NO: 62569 - DNA, 32 bp, Homo sapiens; identical to SEQ ID NO: 5835

SEQ ID NO: 62570 - DNA, 24 bp, Homo sapiens
gcgggccgccggtgaaataccact

SEQ ID NO: 62571 - DNA, 25 bp, Homo sapiens
gcgggccgccggtgaaataccacta

SEQ ID NO: 62572 - DNA, 26 bp, Homo sapiens
gcgggccgccggtgaaataccactac

SEQ ID NO: 62573 - DNA, 27 bp, Homo sapiens
gcgggccgccggtgaaataccactact

SEQ ID NO: 62574 - DNA, 28 bp, Homo sapiens
gcgggccgccggtgaaataccactactc

SEQ ID NO: 62575 - DNA, 29 bp, Homo sapiens
gcgggccgccggtgaaataccactactct

SEQ ID NO: 62576 - DNA, 30 bp, Homo sapiens; identical to SEQ ID NO: 5841

SEQ ID NO: 62577 - DNA, 31 bp, Homo sapiens; identical to SEQ ID NO: 5842

SEQ ID NO: 62578 - DNA, 32 bp, Homo sapiens; identical to SEQ ID NO: 5843

SEQ ID NO: 62579 - DNA, 25 bp, Homo sapiens
cgggccgccggtgaaataccactac

SEQ ID NO: 62580 - DNA, 26 bp, Homo sapiens
cgggccgccggtgaaataccactact

SEQ ID NO: 62581 - DNA, 27 bp, Homo sapiens
cgggccgccggtgaaataccactactc

SEQ ID NO: 62582 - DNA, 29 bp, Homo sapiens
cgggccgccggtgaaataccactactctg

SEQ ID NO: 62583 - DNA, 30 bp, Homo sapiens; identical to SEQ ID NO: 5848

SEQ ID NO: 62584 - DNA, 24 bp, Homo sapiens
gggccgccggtgaaataccactac

SEQ ID NO: 62585 - DNA, 25 bp, Homo sapiens
gggccgccggtgaaataccactact

SEQ ID NO: 62586 - DNA, 26 bp, Homo sapiens
gggccgccggtgaaataccactactc

SEQ ID NO: 62587 - DNA, 27 bp, Homo sapiens
gggccgccggtgaaataccactactct

SEQ ID NO: 62588 - DNA, 28 bp, Homo sapiens
gggccgccggtgaaataccactactctg

SEQ ID NO: 62589 - DNA, 29 bp, Homo sapiens
gggccgccggtgaaataccactactctga

SEQ ID NO: 62590 - DNA, 30 bp, Homo sapiens; identical to SEQ ID NO: 5852

SEQ ID NO: 62591 - DNA, 22 bp, Homo sapiens
ggccgccggtgaaataccacta

SEQ ID NO: 62592 - DNA, 23 bp, Homo sapiens
ggccgccggtgaaataccactac

SEQ ID NO: 62593 - DNA, 24 bp, Homo sapiens
ggccgccggtgaaataccactact

SEQ ID NO: 62594 - DNA, 25 bp, Homo sapiens
ggccgccggtgaaataccactactc

SEQ ID NO: 62595 - DNA, 26 bp, Homo sapiens
ggccgccggtgaaataccactactct

SEQ ID NO: 62596 - DNA, 27 bp, Homo sapiens
ggccgccggtgaaataccactactctg

SEQ ID NO: 62597 - DNA, 28 bp, Homo sapiens
ggccgccggtgaaataccactactctga

SEQ ID NO: 62598 - DNA, 29 bp, Homo sapiens
ggccgccggtgaaataccactactctgat

SEQ ID NO: 62599 - DNA, 30 bp, Homo sapiens; identical to SEQ ID NO: 5857

SEQ ID NO: 62600 - DNA, 21 bp, Homo sapiens
gccgccggtgaaataccacta

SEQ ID NO: 62601 - DNA, 22 bp, Homo sapiens
gccgccggtgaaataccactac

SEQ ID NO: 62602 - DNA, 23 bp, Homo sapiens
gccgccggtgaaataccactact

SEQ ID NO: 62603 - DNA, 24 bp, Homo sapiens
gccgccggtgaaataccactactc

SEQ ID NO: 62604 - DNA, 25 bp, Homo sapiens
gccgccggtgaaataccactactct

SEQ ID NO: 62605 - DNA, 26 bp, Homo sapiens
gccgccggtgaaataccactactctg

SEQ ID NO: 62606 - DNA, 27 bp, Homo sapiens
gccgccggtgaaataccactactctga

SEQ ID NO: 62607 - DNA, 28 bp, Homo sapiens
gccgccggtgaaataccactactctgat

SEQ ID NO: 62608 - DNA, 29 bp, Homo sapiens
gccgccggtgaaataccactactctgatc

SEQ ID NO: 62609 - DNA, 30 bp, Homo sapiens; identical to SEQ ID NO: 5864

SEQ ID NO: 62610 - DNA, 44 bp, Homo sapiens
gccgccggtgaaataccactactctgatcgttttttcactgacc

SEQ ID NO: 62611 - DNA, 46 bp, Homo sapiens; identical to SEQ ID NO: 61161

SEQ ID NO: 62612 - DNA, 22 bp, Homo sapiens
ccgccggtgaaataccactact

SEQ ID NO: 62613 - DNA, 37 bp, Homo sapiens
gaggggctctcgcttctggcgccaagcgcccggccgc

SEQ ID NO: 62614 - DNA, 36 bp, Homo sapiens; identical to SEQ ID NO: 58128

SEQ ID NO: 62615 - DNA, 30 bp, Homo sapiens; identical to SEQ ID NO: 26397

SEQ ID NO: 62616 - DNA, 27 bp, Homo sapiens
ctcgcttctggcgccaagcgcccggcc

SEQ ID NO: 62617 - DNA, 29 bp, Homo sapiens
gctccggggacagtgccaggtggggagtt

SEQ ID NO: 62618 - DNA, 30 bp, Homo sapiens; identical to SEQ ID NO: 53900

SEQ ID NO: 62619 - DNA, 33 bp, Homo sapiens
gtgccaggtggggagtttgactggggcggtaca

SEQ ID NO: 62620 - DNA, 32 bp, Homo sapiens
cgcaggtgtcctaaggcgagctcagggaggac

SEQ ID NO: 62621 - DNA, 38 bp, Homo sapiens
aaacctcccgtggagcagaagggcaaaagctcgcttga

SEQ ID NO: 62622 - DNA, 32 bp, Homo sapiens
cccgtggagcagaagggcaaaagctcgcttga

SEQ ID NO: 62623 - DNA, 27 bp, Homo sapiens
ggagcagaagggcaaaagctcgcttga

SEQ ID NO: 62624 - DNA, 32 bp, Homo sapiens
acagaccgtgaaagcggggcctcacgatcctt

SEQ ID NO: 62625 - DNA, 25 bp, Homo sapiens
gaccgtgaaagcggggcctcacgat

SEQ ID NO: 62626 - DNA, 23 bp, Homo sapiens
accgtgaaagcggggcctcacga

SEQ ID NO: 62627 - DNA, 19 bp, Homo sapiens
tgatccttcgatgtcggct

SEQ ID NO: 62628 - DNA, 20 bp, Homo sapiens
tgatccttcgatgtcggctc

SEQ ID NO: 62629 - DNA, 23 bp, Homo sapiens
tgatccttcgatgtcggctcttc

SEQ ID NO: 62630 - DNA, 24 bp, Homo sapiens
tgatccttcgatgtcggctcttcc

SEQ ID NO: 62631 - DNA, 25 bp, Homo sapiens
tgatccttcgatgtcggctcttcct

SEQ ID NO: 62632 - DNA, 24 bp, Homo sapiens
gatccttcgatgtcggctcttcct

SEQ ID NO: 62633 - DNA, 17 bp, Homo sapiens
atccttcgatgtcggct

SEQ ID NO: 62634 - DNA, 22 bp, Homo sapiens
atccttcgatgtcggctcttcc

SEQ ID NO: 62635 - DNA, 22 bp, Homo sapiens
ccaagcgttggattgttcaccc

SEQ ID NO: 62636 - DNA, 18 bp, Homo sapiens
gcgttggattgttcaccc

SEQ ID NO: 62637 - DNA, 21 bp, Homo sapiens
gcgttggattgttcacccact

SEQ ID NO: 62638 - DNA, 17 bp, Homo sapiens
cgttggattgttcaccc

SEQ ID NO: 62639 - DNA, 21 bp, Homo sapiens
ccgtcgtgagacaggttagtt

SEQ ID NO: 62640 - DNA, 18 bp, Homo sapiens
cagtacgagaggaaccgc

SEQ ID NO: 62641 - DNA, 16 bp, Homo sapiens
agtacgagaggaaccg

SEQ ID NO: 62642 - DNA, 17 bp, Homo sapiens
agtacgagaggaaccgc

SEQ ID NO: 62643 - DNA, 19 bp, Homo sapiens
agtacgagaggaaccgcag

SEQ ID NO: 62644 - DNA, 24 bp, Homo sapiens
accatctgtgggattatgactgaa

SEQ ID NO: 62645 - DNA, 17 bp, Homo sapiens
gtgggattatgactgaa

SEQ ID NO: 62646 - DNA, 35 bp, Homo sapiens
acggcagcgccgcggagcctcggttggcctcggat

SEQ ID NO: 62647 - DNA, 34 bp, Homo sapiens
gcagcgccgcggagcctcggttggcctcggatag

SEQ ID NO: 62648 - DNA, 40 bp, Homo sapiens; identical to SEQ ID NO: 27768

SEQ ID NO: 62649 - DNA, 41 bp, Homo sapiens; identical to SEQ ID NO: 58141

SEQ ID NO: 62650 - DNA, 42 bp, Homo sapiens; identical to SEQ ID NO: 58142

SEQ ID NO: 62651 - DNA, 43 bp, Homo sapiens; identical to SEQ ID NO: 61281

SEQ ID NO: 62652 - DNA, 39 bp, Homo sapiens
agcgccgcggagcctcggttggcctcggatagccggtcc

SEQ ID NO: 62653 - DNA, 40 bp, Homo sapiens
agcgccgcggagcctcggttggcctcggatagccggtccc

SEQ ID NO: 62654 - DNA, 43 bp, Homo sapiens
agcgccgcggagcctcggttggcctcggatagccggtcccccg

SEQ ID NO: 62655 - DNA, 36 bp, Homo sapiens; identical to SEQ ID NO: 27809

SEQ ID NO: 62656 - DNA, 30 bp, Homo sapiens; identical to SEQ ID NO: 6334

SEQ ID NO: 62657 - DNA, 32 bp, Homo sapiens; identical to SEQ ID NO: 6335

SEQ ID NO: 62658 - DNA, 33 bp, Homo sapiens
ggagcctcggttggcctcggatagccggtcccc

SEQ ID NO: 62659 - DNA, 34 bp, Homo sapiens
ggagcctcggttggcctcggatagccggtccccc

SEQ ID NO: 62660 - DNA, 35 bp, Homo sapiens; identical to SEQ ID NO: 58157

SEQ ID NO: 62661 - DNA, 36 bp, Homo sapiens; identical to SEQ ID NO: 58158

SEQ ID NO: 62662 - DNA, 37 bp, Homo sapiens; identical to SEQ ID NO: 58159

SEQ ID NO: 62663 - DNA, 31 bp, Homo sapiens; identical to SEQ ID NO: 27824

SEQ ID NO: 62664 - DNA, 32 bp, Homo sapiens; identical to SEQ ID NO: 58162

SEQ ID NO: 62665 - DNA, 34 bp, Homo sapiens; identical to SEQ ID NO: 27825

SEQ ID NO: 62666 - DNA, 35 bp, Homo sapiens; identical to SEQ ID NO: 58165

SEQ ID NO: 62667 - DNA, 29 bp, Homo sapiens
agcctcggttggcctcggatagccggtcc

SEQ ID NO: 62668 - DNA, 30 bp, Homo sapiens; identical to SEQ ID NO: 27830

SEQ ID NO: 62669 - DNA, 31 bp, Homo sapiens; identical to SEQ ID NO: 58168

SEQ ID NO: 62670 - DNA, 32 bp, Homo sapiens; identical to SEQ ID NO: 58169

SEQ ID NO: 62671 - DNA, 33 bp, Homo sapiens; identical to SEQ ID NO: 6337

SEQ ID NO: 62672 - DNA, 34 bp, Homo sapiens; identical to SEQ ID NO: 58171

SEQ ID NO: 62673 - DNA, 24 bp, Homo sapiens
cctgtccccgccggcgggccgccc

SEQ ID NO: 62674 - DNA, 23 bp, Homo sapiens
ctgtccccgccggcgggccgccc

SEQ ID NO: 62675 - DNA, 16 bp, Homo sapiens
ccctccacgcgccccg

SEQ ID NO: 62676 - DNA, 18 bp, Homo sapiens
ccctccacgcgccccgcg

SEQ ID NO: 62677 - DNA, 39 bp, Homo sapiens; identical to SEQ ID NO: 58207

SEQ ID NO: 62678 - DNA, 38 bp, Homo sapiens; identical to SEQ ID NO: 61371

SEQ ID NO: 62679 - DNA, 44 bp, Homo sapiens; identical to SEQ ID NO: 28041

SEQ ID NO: 62680 - DNA, 29 bp, Homo sapiens
cgctaaaccattcgtagacgacctgcttc

SEQ ID NO: 62681 - DNA, 28 bp, Homo sapiens
gctaaaccattcgtagacgacctgcttc

SEQ ID NO: 62682 - DNA, 28 bp, Homo sapiens
gtagacgacctgcttctgggtcggggtt

SEQ ID NO: 62683 - DNA, 29 bp, Homo sapiens
gtagacgacctgcttctgggtcggggttt

SEQ ID NO: 62684 - DNA, 17 bp, Homo sapiens
gctccctcgctgcgatc

SEQ ID NO: 62685 - DNA, 16 bp, Homo sapiens
tccctcgctgcgatct

SEQ ID NO: 62686 - DNA, 38 bp, Homo sapiens; identical to SEQ ID NO: 61401

SEQ ID NO: 62687 - DNA, 37 bp, Homo sapiens
cctcgctgcgatctattgaaagtcagccctcgacaca

SEQ ID NO: 62688 - DNA, 46 bp, Homo sapiens; identical to SEQ ID NO: 28404

SEQ ID NO: 62689 - DNA, 34 bp, Homo sapiens
ctcgctgcgatctattgaaagtcagccctcgaca

SEQ ID NO: 62690 - DNA, 36 bp, Homo sapiens; identical to SEQ ID NO: 28409

SEQ ID NO: 62691 - DNA, 37 bp, Homo sapiens
ctcgctgcgatctattgaaagtcagccctcgacacaa

SEQ ID NO: 62692 - DNA, 42 bp, Homo sapiens; identical to SEQ ID NO: 28411

SEQ ID NO: 62693 - DNA, 44 bp, Homo sapiens; identical to SEQ ID NO: 28412

SEQ ID NO: 62694 - DNA, 45 bp, Homo sapiens; identical to SEQ ID NO: 28413

SEQ ID NO: 62695 - DNA, 35 bp, Homo sapiens; identical to SEQ ID NO: 58227

SEQ ID NO: 62696 - DNA, 43 bp, Homo sapiens; identical to SEQ ID NO: 28424

SEQ ID NO: 62697 - DNA, 44 bp, Homo sapiens; identical to SEQ ID NO: 28425

SEQ ID NO: 62698 - DNA, 34 bp, Homo sapiens; identical to SEQ ID NO: 58230

SEQ ID NO: 62699 - DNA, 42 bp, Homo sapiens; identical to SEQ ID NO: 28436

SEQ ID NO: 62700 - DNA, 43 bp, Homo sapiens; identical to SEQ ID NO: 28437

SEQ ID NO: 62701 - DNA, 44 bp, Homo sapiens; identical to SEQ ID NO: 61415

SEQ ID NO: 62702 - DNA, 19 bp, Homo sapiens
gctgcgatctattgaaagt

SEQ ID NO: 62703 - DNA, 20 bp, Homo sapiens
gctgcgatctattgaaagtc

SEQ ID NO: 62704 - DNA, 33 bp, Homo sapiens; identical to SEQ ID NO: 58233

SEQ ID NO: 62705 - DNA, 41 bp, Homo sapiens; identical to SEQ ID NO: 28443

SEQ ID NO: 62706 - DNA, 42 bp, Homo sapiens; identical to SEQ ID NO: 28444

SEQ ID NO: 62707 - DNA, 43 bp, Homo sapiens
gctgcgatctattgaaagtcagccctcgacacaagggtttgtc

SEQ ID NO: 62708 - DNA, 29 bp, Homo sapiens
gaaagtcagccctcgacacaagggtttgt

SEQ ID NO: 62709 - DNA, 28 bp, Homo sapiens
aaagtcagccctcgacacaagggtttgt

SEQ ID NO: 62710 - DNA, 17 bp, Homo sapiens
agtcagccctcgacaca

SEQ ID NO: 62711 - DNA, 16 bp, Homo sapiens
agccctcgacacaagg

SEQ ID NO: 62712 - DNA, 19 bp, Homo sapiens
cctcgacacaagggtttgt

SEQ ID NO: 62713 - DNA, 16 bp, Homo sapiens
ctcgacacaagggttt

SEQ ID NO: 62714 - DNA, 16 bp, Homo sapiens
tcgacacaagggtttg

SEQ ID NO: 62715 - DNA, 17 bp, Homo sapiens
tcgacacaagggtttgt

SEQ ID NO: 62716 - DNA, 16 bp, Homo sapiens
cgacacaagggtttgt

SEQ ID NO: 62717 - DNA, 17 bp, Homo sapiens
ctctctctctctccccc

SEQ ID NO: 62718 - DNA, 33 bp, Homo sapiens; identical to SEQ ID NO: 11

SEQ ID NO: 62719 - DNA, 34 bp, Homo sapiens; identical to SEQ ID NO: 6542

SEQ ID NO: 62720 - DNA, 37 bp, Homo sapiens; identical to SEQ ID NO: 6545

SEQ ID NO: 62721 - DNA, 37 bp, Homo sapiens; identical to SEQ ID NO: 7003

SEQ ID NO: 62722 - DNA, 32 bp, Homo sapiens; identical to SEQ ID NO: 215

SEQ ID NO: 62723 - DNA, 35 bp, Homo sapiens
cagttgacacaaaatagactacgaaagtggcttta

SEQ ID NO: 62724 - DNA, 38 bp, Homo sapiens
cagttgacacaaaatagactacgaaagtggctttaaca

SEQ ID NO: 62725 - DNA, 40 bp, Homo sapiens
cagttgacacaaaatagactacgaaagtggctttaacata

SEQ ID NO: 62726 - DNA, 37 bp, Homo sapiens; identical to SEQ ID NO: 61477

SEQ ID NO: 62727 - DNA, 42 bp, Homo sapiens
aagtcgtaacatggtaagtgtactggaaagtgcacttggacg

SEQ ID NO: 62728 - DNA, 43 bp, Homo sapiens
aagtcgtaacatggtaagtgtactggaaagtgcacttggacga

SEQ ID NO: 62729 - DNA, 44 bp, Homo sapiens
aagtcgtaacatggtaagtgtactggaaagtgcacttggacgaa

SEQ ID NO: 62730 - DNA, 39 bp, Homo sapiens
cgtaacatggtaagtgtactggaaagtgcacttggacga

SEQ ID NO: 62731 - DNA, 38 bp, Homo sapiens
gtaacatggtaagtgtactggaaagtgcacttggacga

SEQ ID NO: 62732 - DNA, 36 bp, Homo sapiens
aacatggtaagtgtactggaaagtgcacttggacga

SEQ ID NO: 62733 - DNA, 33 bp, Homo sapiens
atggtaagtgtactggaaagtgcacttggacga

SEQ ID NO: 62734 - DNA, 19 bp, Homo sapiens
gctaaacctagccccaaac

SEQ ID NO: 62735 - DNA, 20 bp, Homo sapiens
gctaaacctagccccaaacc

SEQ ID NO: 62736 - DNA, 21 bp, Homo sapiens
gctaaacctagccccaaaccc

SEQ ID NO: 62737 - DNA, 22 bp, Homo sapiens
gctaaacctagccccaaaccca

SEQ ID NO: 62738 - DNA, 23 bp, Homo sapiens
gctaaacctagccccaaacccac

SEQ ID NO: 62739 - DNA, 24 bp, Homo sapiens
gctaaacctagccccaaacccact

SEQ ID NO: 62740 - DNA, 25 bp, Homo sapiens
gctaaacctagccccaaacccactc

SEQ ID NO: 62741 - DNA, 27 bp, Homo sapiens
gctaaacctagccccaaacccactcca

SEQ ID NO: 62742 - DNA, 29 bp, Homo sapiens
gctaaacctagccccaaacccactccacc

SEQ ID NO: 62743 - DNA, 30 bp, Homo sapiens; identical to SEQ ID NO: 832

SEQ ID NO: 62744 - DNA, 31 bp, Homo sapiens; identical to SEQ ID NO: 833

SEQ ID NO: 62745 - DNA, 32 bp, Homo sapiens; identical to SEQ ID NO: 834

SEQ ID NO: 62746 - DNA, 34 bp, Homo sapiens; identical to SEQ ID NO: 8827

SEQ ID NO: 62747 - DNA, 35 bp, Homo sapiens; identical to SEQ ID NO: 8828

SEQ ID NO: 62748 - DNA, 36 bp, Homo sapiens; identical to SEQ ID NO: 8829

SEQ ID NO: 62749 - DNA, 37 bp, Homo sapiens; identical to SEQ ID NO: 8830

SEQ ID NO: 62750 - DNA, 38 bp, Homo sapiens; identical to SEQ ID NO: 8831

SEQ ID NO: 62751 - DNA, 40 bp, Homo sapiens; identical to SEQ ID NO: 8833

SEQ ID NO: 62752 - DNA, 41 bp, Homo sapiens; identical to SEQ ID NO: 8834

SEQ ID NO: 62753 - DNA, 42 bp, Homo sapiens; identical to SEQ ID NO: 8835

SEQ ID NO: 62754 - DNA, 43 bp, Homo sapiens; identical to SEQ ID NO: 8836

SEQ ID NO: 62755 - DNA, 44 bp, Homo sapiens; identical to SEQ ID NO: 8837

SEQ ID NO: 62756 - DNA, 45 bp, Homo sapiens; identical to SEQ ID NO: 8838

SEQ ID NO: 62757 - DNA, 46 bp, Homo sapiens; identical to SEQ ID NO: 8839

SEQ ID NO: 62758 - DNA, 31 bp, Homo sapiens
taccaaacctgcattaaaaatttcggttggg

SEQ ID NO: 62759 - DNA, 45 bp, Homo sapiens
agagtccatatcaacaatagggtttacgacctcgatgttggatca

SEQ ID NO: 62760 - DNA, 38 bp, Homo sapiens
catcccgatggtgcagccgctattaaaggttcgtttgt

SEQ ID NO: 62761 - DNA, 18 bp, Homo sapiens
tacctggttgatcctgcc

SEQ ID NO: 62762 - DNA, 21 bp, Homo sapiens
tacctggttgatcctgccagt

SEQ ID NO: 62763 - DNA, 22 bp, Homo sapiens
tacctggttgatcctgccagta

SEQ ID NO: 62764 - DNA, 24 bp, Homo sapiens
tacctggttgatcctgccagtagc

SEQ ID NO: 62765 - DNA, 25 bp, Homo sapiens
tacctggttgatcctgccagtagca

SEQ ID NO: 62766 - DNA, 35 bp, Homo sapiens; identical to SEQ ID NO: 12071

SEQ ID NO: 62767 - DNA, 45 bp, Homo sapiens
tcctacttggataactgtggtaattctagagctaatacatgccga

SEQ ID NO: 62768 - DNA, 41 bp, Homo sapiens; identical to SEQ ID NO: 61621

SEQ ID NO: 62769 - DNA, 42 bp, Homo sapiens; identical to SEQ ID NO: 12493

SEQ ID NO: 62770 - DNA, 43 bp, Homo sapiens; identical to SEQ ID NO: 57022

SEQ ID NO: 62771 - DNA, 44 bp, Homo sapiens; identical to SEQ ID NO: 57023

SEQ ID NO: 62772 - DNA, 42 bp, Homo sapiens; identical to SEQ ID NO: 57025

SEQ ID NO: 62773 - DNA, 43 bp, Homo sapiens; identical to SEQ ID NO: 57026

SEQ ID NO: 62774 - DNA, 41 bp, Homo sapiens; identical to SEQ ID NO: 57028

SEQ ID NO: 62775 - DNA, 42 bp, Homo sapiens; identical to SEQ ID NO: 58580

SEQ ID NO: 62776 - DNA, 26 bp, Homo sapiens
ggctttggtgactctagataacctcg

SEQ ID NO: 62777 - DNA, 27 bp, Homo sapiens
ggctttggtgactctagataacctcgg

SEQ ID NO: 62778 - DNA, 37 bp, Homo sapiens; identical to SEQ ID NO: 61637

SEQ ID NO: 62779 - DNA, 38 bp, Homo sapiens; identical to SEQ ID NO: 12749

SEQ ID NO: 62780 - DNA, 39 bp, Homo sapiens; identical to SEQ ID NO: 12750

SEQ ID NO: 62781 - DNA, 40 bp, Homo sapiens; identical to SEQ ID NO: 57040

SEQ ID NO: 62782 - DNA, 42 bp, Homo sapiens; identical to SEQ ID NO: 57042

SEQ ID NO: 62783 - DNA, 36 bp, Homo sapiens; identical to SEQ ID NO: 61641

SEQ ID NO: 62784 - DNA, 37 bp, Homo sapiens; identical to SEQ ID NO: 12761

SEQ ID NO: 62785 - DNA, 38 bp, Homo sapiens
gctttggtgactctagataacctcgggccgatcgcacg

SEQ ID NO: 62786 - DNA, 39 bp, Homo sapiens; identical to SEQ ID NO: 58636

SEQ ID NO: 62787 - DNA, 36 bp, Homo sapiens; identical to SEQ ID NO: 12767

SEQ ID NO: 62788 - DNA, 37 bp, Homo sapiens; identical to SEQ ID NO: 12768

SEQ ID NO: 62789 - DNA, 37 bp, Homo sapiens
cccgccccttgcctctcggcgccccctcgatgctctt

SEQ ID NO: 62790 - DNA, 24 bp, Homo sapiens
ctctcggcgccccctcgatgctct

SEQ ID NO: 62791 - DNA, 25 bp, Homo sapiens
ctctcggcgccccctcgatgctctt

SEQ ID NO: 62792 - DNA, 22 bp, Homo sapiens
ctcggcgccccctcgatgctct

SEQ ID NO: 62793 - DNA, 23 bp, Homo sapiens
ctcggcgccccctcgatgctctt

SEQ ID NO: 62794 - DNA, 45 bp, Homo sapiens; identical to SEQ ID NO: 58747

SEQ ID NO: 62795 - DNA, 43 bp, Homo sapiens; identical to SEQ ID NO: 61654

SEQ ID NO: 62796 - DNA, 44 bp, Homo sapiens; identical to SEQ ID NO: 57068

SEQ ID NO: 62797 - DNA, 45 bp, Homo sapiens
gaagcgtttactttgaaaaaattagagtgttcaaagcaggcccga

SEQ ID NO: 62798 - DNA, 43 bp, Homo sapiens; identical to SEQ ID NO: 58749

SEQ ID NO: 62799 - DNA, 44 bp, Homo sapiens
aagcgtttactttgaaaaaattagagtgttcaaagcaggcccga

SEQ ID NO: 62800 - DNA, 42 bp, Homo sapiens; identical to SEQ ID NO: 58750

SEQ ID NO: 62801 - DNA, 43 bp, Homo sapiens
agcgtttactttgaaaaaattagagtgttcaaagcaggcccga

SEQ ID NO: 62802 - DNA, 41 bp, Homo sapiens; identical to SEQ ID NO: 61660

SEQ ID NO: 62803 - DNA, 40 bp, Homo sapiens; identical to SEQ ID NO: 58751

SEQ ID NO: 62804 - DNA, 26 bp, Homo sapiens
aaattagagtgttcaaagcaggcccg

SEQ ID NO: 62805 - DNA, 35 bp, Homo sapiens; identical to SEQ ID NO: 61662

SEQ ID NO: 62806 - DNA, 36 bp, Homo sapiens; identical to SEQ ID NO: 61663

SEQ ID NO: 62807 - DNA, 37 bp, Homo sapiens
agccgcctggataccgcagctaggaataatggaatag

SEQ ID NO: 62808 - DNA, 34 bp, Homo sapiens; identical to SEQ ID NO: 61665

SEQ ID NO: 62809 - DNA, 35 bp, Homo sapiens; identical to SEQ ID NO: 61666

SEQ ID NO: 62810 - DNA, 36 bp, Homo sapiens
gccgcctggataccgcagctaggaataatggaatag

SEQ ID NO: 62811 - DNA, 35 bp, Homo sapiens; identical to SEQ ID NO: 17346

SEQ ID NO: 62812 - DNA, 37 bp, Homo sapiens; identical to SEQ ID NO: 17348

SEQ ID NO: 62813 - DNA, 36 bp, Homo sapiens; identical to SEQ ID NO: 57213

SEQ ID NO: 62814 - DNA, 35 bp, Homo sapiens; identical to SEQ ID NO: 59175

SEQ ID NO: 62815 - DNA, 34 bp, Homo sapiens; identical to SEQ ID NO: 59178

SEQ ID NO: 62816 - DNA, 18 bp, Homo sapiens
cgactcttagcggtggat

SEQ ID NO: 62817 - DNA, 19 bp, Homo sapiens
cgactcttagcggtggatc

SEQ ID NO: 62818 - DNA, 20 bp, Homo sapiens
cgactcttagcggtggatca

SEQ ID NO: 62819 - DNA, 22 bp, Homo sapiens
cgactcttagcggtggatcact

SEQ ID NO: 62820 - DNA, 25 bp, Homo sapiens
cgactcttagcggtggatcactcgg

SEQ ID NO: 62821 - DNA, 26 bp, Homo sapiens
cgactcttagcggtggatcactcggc

SEQ ID NO: 62822 - DNA, 27 bp, Homo sapiens
cgactcttagcggtggatcactcggct

SEQ ID NO: 62823 - DNA, 29 bp, Homo sapiens
cgactcttagcggtggatcactcggctcg

SEQ ID NO: 62824 - DNA, 30 bp, Homo sapiens; identical to SEQ ID NO: 3579

SEQ ID NO: 62825 - DNA, 31 bp, Homo sapiens; identical to SEQ ID NO: 3580

SEQ ID NO: 62826 - DNA, 33 bp, Homo sapiens; identical to SEQ ID NO: 3582

SEQ ID NO: 62827 - DNA, 34 bp, Homo sapiens; identical to SEQ ID NO: 17395

SEQ ID NO: 62828 - DNA, 36 bp, Homo sapiens; identical to SEQ ID NO: 17397

SEQ ID NO: 62829 - DNA, 37 bp, Homo sapiens; identical to SEQ ID NO: 17398

SEQ ID NO: 62830 - DNA, 38 bp, Homo sapiens; identical to SEQ ID NO: 17399

SEQ ID NO: 62831 - DNA, 39 bp, Homo sapiens; identical to SEQ ID NO: 17400

SEQ ID NO: 62832 - DNA, 21 bp, Homo sapiens
gactcttagcggtggatcact

SEQ ID NO: 62833 - DNA, 25 bp, Homo sapiens
gactcttagcggtggatcactcggc

SEQ ID NO: 62834 - DNA, 26 bp, Homo sapiens
gactcttagcggtggatcactcggct

SEQ ID NO: 62835 - DNA, 29 bp, Homo sapiens
gactcttagcggtggatcactcggctcgt

SEQ ID NO: 62836 - DNA, 30 bp, Homo sapiens; identical to SEQ ID NO: 3590

SEQ ID NO: 62837 - DNA, 32 bp, Homo sapiens; identical to SEQ ID NO: 3591

SEQ ID NO: 62838 - DNA, 42 bp, Homo sapiens; identical to SEQ ID NO: 17761

SEQ ID NO: 62839 - DNA, 43 bp, Homo sapiens; identical to SEQ ID NO: 17762

SEQ ID NO: 62840 - DNA, 42 bp, Homo sapiens; identical to SEQ ID NO: 17780

SEQ ID NO: 62841 - DNA, 41 bp, Homo sapiens; identical to SEQ ID NO: 17795

SEQ ID NO: 62842 - DNA, 23 bp, Homo sapiens
tcctcccggggctacgcctgtct

SEQ ID NO: 62843 - DNA, 25 bp, Homo sapiens
tcctcccggggctacgcctgtctga

SEQ ID NO: 62844 - DNA, 33 bp, Homo sapiens; identical to SEQ ID NO: 3741

SEQ ID NO: 62845 - DNA, 34 bp, Homo sapiens; identical to SEQ ID NO: 18002

SEQ ID NO: 62846 - DNA, 24 bp, Homo sapiens
cctcccggggctacgcctgtctga

SEQ ID NO: 62847 - DNA, 27 bp, Homo sapiens
cctcccggggctacgcctgtctgagcg

SEQ ID NO: 62848 - DNA, 32 bp, Homo sapiens; identical to SEQ ID NO: 3743

SEQ ID NO: 62849 - DNA, 33 bp, Homo sapiens; identical to SEQ ID NO: 18007

SEQ ID NO: 62850 - DNA, 26 bp, Homo sapiens
ctcccggggctacgcctgtctgagcg

SEQ ID NO: 62851 - DNA, 31 bp, Homo sapiens; identical to SEQ ID NO: 3747

SEQ ID NO: 62852 - DNA, 27 bp, Homo sapiens
cggggctacgcctgtctgagcgtcgct

SEQ ID NO: 62853 - DNA, 26 bp, Homo sapiens
ggggctacgcctgtctgagcgtcgct

SEQ ID NO: 62854 - DNA, 25 bp, Homo sapiens
gggctacgcctgtctgagcgtcgct

SEQ ID NO: 62855 - DNA, 22 bp, Homo sapiens
ctacgcctgtctgagcgtcgct

SEQ ID NO: 62856 - DNA, 21 bp, Homo sapiens
tacgcctgtctgagcgtcgct

SEQ ID NO: 62857 - DNA, 22 bp, Homo sapiens
tacgcctgtctgagcgtcgctt

SEQ ID NO: 62858 - DNA, 23 bp, Homo sapiens
gtcgccgcggttcgccgcccgcc

SEQ ID NO: 62859 - DNA, 24 bp, Homo sapiens
gtcgccgcggttcgccgcccgccc

SEQ ID NO: 62860 - DNA, 18 bp, Homo sapiens
gggacgccgcggtgtcgt

SEQ ID NO: 62861 - DNA, 17 bp, Homo sapiens
cgcgacctcagatcaga

SEQ ID NO: 62862 - DNA, 18 bp, Homo sapiens
cgcgacctcagatcagac

SEQ ID NO: 62863 - DNA, 19 bp, Homo sapiens
cgcgacctcagatcagacg

SEQ ID NO: 62864 - DNA, 20 bp, Homo sapiens
cgcgacctcagatcagacgt

SEQ ID NO: 62865 - DNA, 21 bp, Homo sapiens
cgcgacctcagatcagacgtg

SEQ ID NO: 62866 - DNA, 22 bp, Homo sapiens
cgcgacctcagatcagacgtgg

SEQ ID NO: 62867 - DNA, 24 bp, Homo sapiens
cgcgacctcagatcagacgtggcg

SEQ ID NO: 62868 - DNA, 25 bp, Homo sapiens
cgcgacctcagatcagacgtggcga

SEQ ID NO: 62869 - DNA, 26 bp, Homo sapiens
cgcgacctcagatcagacgtggcgac

SEQ ID NO: 62870 - DNA, 27 bp, Homo sapiens
cgcgacctcagatcagacgtggcgacc

SEQ ID NO: 62871 - DNA, 28 bp, Homo sapiens
cgcgacctcagatcagacgtggcgaccc

SEQ ID NO: 62872 - DNA, 29 bp, Homo sapiens
cgcgacctcagatcagacgtggcgacccg

SEQ ID NO: 62873 - DNA, 30 bp, Homo sapiens; identical to SEQ ID NO: 3865

SEQ ID NO: 62874 - DNA, 31 bp, Homo sapiens; identical to SEQ ID NO: 3866

SEQ ID NO: 62875 - DNA, 32 bp, Homo sapiens; identical to SEQ ID NO: 3867

SEQ ID NO: 62876 - DNA, 33 bp, Homo sapiens; identical to SEQ ID NO: 3868

SEQ ID NO: 62877 - DNA, 34 bp, Homo sapiens; identical to SEQ ID NO: 18258

SEQ ID NO: 62878 - DNA, 35 bp, Homo sapiens; identical to SEQ ID NO: 18259

SEQ ID NO: 62879 - DNA, 36 bp, Homo sapiens; identical to SEQ ID NO: 18260

SEQ ID NO: 62880 - DNA, 37 bp, Homo sapiens; identical to SEQ ID NO: 18261

SEQ ID NO: 62881 - DNA, 38 bp, Homo sapiens; identical to SEQ ID NO: 18262

SEQ ID NO: 62882 - DNA, 40 bp, Homo sapiens; identical to SEQ ID NO: 18264

SEQ ID NO: 62883 - DNA, 41 bp, Homo sapiens; identical to SEQ ID NO: 18265

SEQ ID NO: 62884 - DNA, 42 bp, Homo sapiens; identical to SEQ ID NO: 18266

SEQ ID NO: 62885 - DNA, 44 bp, Homo sapiens; identical to SEQ ID NO: 18268

SEQ ID NO: 62886 - DNA, 24 bp, Homo sapiens
cggaagacccgctccccggcgccg

SEQ ID NO: 62887 - DNA, 26 bp, Homo sapiens
cggaagacccgctccccggcgccgct

SEQ ID NO: 62888 - DNA, 32 bp, Homo sapiens; identical to SEQ ID NO: 4029

SEQ ID NO: 62889 - DNA, 34 bp, Homo sapiens
cgtggggggcccaagtccttctgatcgaggccca

SEQ ID NO: 62890 - DNA, 31 bp, Homo sapiens; identical to SEQ ID NO: 4033

SEQ ID NO: 62891 - DNA, 32 bp, Homo sapiens; identical to SEQ ID NO: 4034

SEQ ID NO: 62892 - DNA, 33 bp, Homo sapiens; identical to SEQ ID NO: 57436

SEQ ID NO: 62893 - DNA, 30 bp, Homo sapiens; identical to SEQ ID NO: 4038

SEQ ID NO: 62894 - DNA, 32 bp, Homo sapiens
tggggggcccaagtccttctgatcgaggccca

SEQ ID NO: 62895 - DNA, 25 bp, Homo sapiens
gcccaagtccttctgatcgaggccc

SEQ ID NO: 62896 - DNA, 28 bp, Homo sapiens
agcccgtggacggtgtgaggccggtagc

SEQ ID NO: 62897 - DNA, 36 bp, Homo sapiens; identical to SEQ ID NO: 57468

SEQ ID NO: 62898 - DNA, 35 bp, Homo sapiens; identical to SEQ ID NO: 57469

SEQ ID NO: 62899 - DNA, 36 bp, Homo sapiens
gcagtccgcccggaggattcaacccggcggcgggtc

SEQ ID NO: 62900 - DNA, 34 bp, Homo sapiens; identical to SEQ ID NO: 57470

SEQ ID NO: 62901 - DNA, 33 bp, Homo sapiens
agtccgcccggaggattcaacccggcggcgggt

SEQ ID NO: 62902 - DNA, 43 bp, Homo sapiens
gtccggccgtgtcggcggcccggcggatctttcccgccccccg

SEQ ID NO: 62903 - DNA, 42 bp, Homo sapiens
tccggccgtgtcggcggcccggcggatctttcccgccccccg

SEQ ID NO: 62904 - DNA, 34 bp, Homo sapiens
gtcggcggcccggcggatctttcccgccccccgt

SEQ ID NO: 62905 - DNA, 28 bp, Homo sapiens
ggcccggcggatctttcccgccccccgt

SEQ ID NO: 62906 - DNA, 25 bp, Homo sapiens
cccggcggatctttcccgccccccg

SEQ ID NO: 62907 - DNA, 26 bp, Homo sapiens
cccggcggatctttcccgccccccgt

SEQ ID NO: 62908 - DNA, 24 bp, Homo sapiens
ccggcggatctttcccgccccccg

SEQ ID NO: 62909 - DNA, 25 bp, Homo sapiens
ccggcggatctttcccgccccccgt

SEQ ID NO: 62910 - DNA, 43 bp, Homo sapiens
ggcagcagcactcgccgaatcccggggccgagggagcgagacc

SEQ ID NO: 62911 - DNA, 31 bp, Homo sapiens; identical to SEQ ID NO: 19740

SEQ ID NO: 62912 - DNA, 32 bp, Homo sapiens; identical to SEQ ID NO: 19741

SEQ ID NO: 62913 - DNA, 33 bp, Homo sapiens
agcactcgccgaatcccggggccgagggagcga

SEQ ID NO: 62914 - DNA, 35 bp, Homo sapiens; identical to SEQ ID NO: 61998

SEQ ID NO: 62915 - DNA, 36 bp, Homo sapiens; identical to SEQ ID NO: 57624

SEQ ID NO: 62916 - DNA, 37 bp, Homo sapiens; identical to SEQ ID NO: 59878

SEQ ID NO: 62917 - DNA, 36 bp, Homo sapiens
gcactcgccgaatcccggggccgagggagcgagacc

SEQ ID NO: 62918 - DNA, 20 bp, Homo sapiens
gcacggggtcggcggcgacg

SEQ ID NO: 62919 - DNA, 29 bp, Homo sapiens
caggatagctggcgctctcgcagacccga

SEQ ID NO: 62920 - DNA, 32 bp, Homo sapiens
cccccgccacgcagttttatccggtaaagcga

SEQ ID NO: 62921 - DNA, 45 bp, Homo sapiens; identical to SEQ ID NO: 62048

SEQ ID NO: 62922 - DNA, 46 bp, Homo sapiens
cccccgccacgcagttttatccggtaaagcgaatgattagaggtct

SEQ ID NO: 62923 - DNA, 31 bp, Homo sapiens
ccccgccacgcagttttatccggtaaagcga

SEQ ID NO: 62924 - DNA, 44 bp, Homo sapiens; identical to SEQ ID NO: 62053

SEQ ID NO: 62925 - DNA, 45 bp, Homo sapiens
ccccgccacgcagttttatccggtaaagcgaatgattagaggtct

SEQ ID NO: 62926 - DNA, 43 bp, Homo sapiens; identical to SEQ ID NO: 57761

SEQ ID NO: 62927 - DNA, 44 bp, Homo sapiens
cccgccacgcagttttatccggtaaagcgaatgattagaggtct

SEQ ID NO: 62928 - DNA, 43 bp, Homo sapiens
ctcggccgatcgaaagggagtcgggttcagatccccgaatccg

SEQ ID NO: 62929 - DNA, 23 bp, Homo sapiens
tcccccctccccgggggagcgcc

SEQ ID NO: 62930 - DNA, 19 bp, Homo sapiens
cccccctccccgggggagc

SEQ ID NO: 62931 - DNA, 17 bp, Homo sapiens
cccctccccgggggagc

SEQ ID NO: 62932 - DNA, 19 bp, Homo sapiens
cccctccccgggggagcgc

SEQ ID NO: 62933 - DNA, 23 bp, Homo sapiens
cccctccccgggggagcgccgcg

SEQ ID NO: 62934 - DNA, 16 bp, Homo sapiens
ccctccccgggggagc

SEQ ID NO: 62935 - DNA, 17 bp, Homo sapiens
ccctccccgggggagcg

SEQ ID NO: 62936 - DNA, 18 bp, Homo sapiens
ccctccccgggggagcgc

SEQ ID NO: 62937 - DNA, 19 bp, Homo sapiens
ccctccccgggggagcgcc

SEQ ID NO: 62938 - DNA, 22 bp, Homo sapiens
ccctccccgggggagcgccgcg

SEQ ID NO: 62939 - DNA, 16 bp, Homo sapiens
cctccccgggggagcg

SEQ ID NO: 62940 - DNA, 17 bp, Homo sapiens
cctccccgggggagcgc

SEQ ID NO: 62941 - DNA, 18 bp, Homo sapiens
cctccccgggggagcgcc

SEQ ID NO: 62942 - DNA, 21 bp, Homo sapiens
cctccccgggggagcgccgcg

SEQ ID NO: 62943 - DNA, 16 bp, Homo sapiens
ctccccgggggagcgc

SEQ ID NO: 62944 - DNA, 17 bp, Homo sapiens
ctccccgggggagcgcc

SEQ ID NO: 62945 - DNA, 16 bp, Homo sapiens
tccccgggggagcgcc

SEQ ID NO: 62946 - DNA, 25 bp, Homo sapiens
gggccgccggtgaaataccactact

SEQ ID NO: 62947 - DNA, 29 bp, Homo sapiens
gggccgccggtgaaataccactactctga

SEQ ID NO: 62948 - DNA, 30 bp, Homo sapiens; identical to SEQ ID NO: 5852

SEQ ID NO: 62949 - DNA, 31 bp, Homo sapiens; identical to SEQ ID NO: 26227

SEQ ID NO: 62950 - DNA, 24 bp, Homo sapiens
ggccgccggtgaaataccactact

SEQ ID NO: 62951 - DNA, 28 bp, Homo sapiens
ggccgccggtgaaataccactactctga

SEQ ID NO: 62952 - DNA, 29 bp, Homo sapiens
ggccgccggtgaaataccactactctgat

SEQ ID NO: 62953 - DNA, 30 bp, Homo sapiens; identical to SEQ ID NO: 5857

SEQ ID NO: 62954 - DNA, 23 bp, Homo sapiens
gccgccggtgaaataccactact

SEQ ID NO: 62955 - DNA, 24 bp, Homo sapiens
cgcttctggcgccaagcgcccggc

SEQ ID NO: 62956 - DNA, 25 bp, Homo sapiens
cgcttctggcgccaagcgcccggcc

SEQ ID NO: 62957 - DNA, 26 bp, Homo sapiens
cgcttctggcgccaagcgcccggccg

SEQ ID NO: 62958 - DNA, 27 bp, Homo sapiens
cgcttctggcgccaagcgcccggccgc

SEQ ID NO: 62959 - DNA, 25 bp, Homo sapiens
gcttctggcgccaagcgcccggccg

SEQ ID NO: 62960 - DNA, 40 bp, Homo sapiens; identical to SEQ ID NO: 27768

SEQ ID NO: 62961 - DNA, 41 bp, Homo sapiens; identical to SEQ ID NO: 58141

SEQ ID NO: 62962 - DNA, 42 bp, Homo sapiens; identical to SEQ ID NO: 58142

SEQ ID NO: 62963 - DNA, 43 bp, Homo sapiens; identical to SEQ ID NO: 61281

SEQ ID NO: 62964 - DNA, 44 bp, Homo sapiens; identical to SEQ ID NO: 58143

SEQ ID NO: 62965 - DNA, 45 bp, Homo sapiens
gcagcgccgcggagcctcggttggcctcggatagccggtcccccg

SEQ ID NO: 62966 - DNA, 46 bp, Homo sapiens; identical to SEQ ID NO: 58144

SEQ ID NO: 62967 - DNA, 39 bp, Homo sapiens; identical to SEQ ID NO: 27772

SEQ ID NO: 62968 - DNA, 40 bp, Homo sapiens; identical to SEQ ID NO: 58147

SEQ ID NO: 62969 - DNA, 42 bp, Homo sapiens; identical to SEQ ID NO: 58149

SEQ ID NO: 62970 - DNA, 43 bp, Homo sapiens; identical to SEQ ID NO: 58150

SEQ ID NO: 62971 - DNA, 44 bp, Homo sapiens; identical to SEQ ID NO: 58151

SEQ ID NO: 62972 - DNA, 46 bp, Homo sapiens; identical to SEQ ID NO: 58153

SEQ ID NO: 62973 - DNA, 39 bp, Homo sapiens; identical to SEQ ID NO: 62652

SEQ ID NO: 62974 - DNA, 41 bp, Homo sapiens
agcgccgcggagcctcggttggcctcggatagccggtcccc

SEQ ID NO: 62975 - DNA, 42 bp, Homo sapiens; identical to SEQ ID NO: 58154

SEQ ID NO: 62976 - DNA, 43 bp, Homo sapiens; identical to SEQ ID NO: 62654

SEQ ID NO: 62977 - DNA, 45 bp, Homo sapiens
agcgccgcggagcctcggttggcctcggatagccggtcccccgcc

SEQ ID NO: 62978 - DNA, 36 bp, Homo sapiens; identical to SEQ ID NO: 27809

SEQ ID NO: 62979 - DNA, 33 bp, Homo sapiens; identical to SEQ ID NO: 62658

SEQ ID NO: 62980 - DNA, 34 bp, Homo sapiens; identical to SEQ ID NO: 62659

SEQ ID NO: 62981 - DNA, 35 bp, Homo sapiens; identical to SEQ ID NO: 58157

SEQ ID NO: 62982 - DNA, 36 bp, Homo sapiens; identical to SEQ ID NO: 58158

SEQ ID NO: 62983 - DNA, 37 bp, Homo sapiens; identical to SEQ ID NO: 58159

SEQ ID NO: 62984 - DNA, 32 bp, Homo sapiens; identical to SEQ ID NO: 58162

SEQ ID NO: 62985 - DNA, 33 bp, Homo sapiens; identical to SEQ ID NO: 58163

SEQ ID NO: 62986 - DNA, 34 bp, Homo sapiens; identical to SEQ ID NO: 27825

SEQ ID NO: 62987 - DNA, 35 bp, Homo sapiens; identical to SEQ ID NO: 58165

SEQ ID NO: 62988 - DNA, 36 bp, Homo sapiens; identical to SEQ ID NO: 58166

SEQ ID NO: 62989 - DNA, 30 bp, Homo sapiens; identical to SEQ ID NO: 27830

SEQ ID NO: 62990 - DNA, 31 bp, Homo sapiens; identical to SEQ ID NO: 58168

SEQ ID NO: 62991 - DNA, 32 bp, Homo sapiens; identical to SEQ ID NO: 58169

SEQ ID NO: 62992 - DNA, 33 bp, Homo sapiens; identical to SEQ ID NO: 6337

SEQ ID NO: 62993 - DNA, 34 bp, Homo sapiens; identical to SEQ ID NO: 58171

SEQ ID NO: 62994 - DNA, 35 bp, Homo sapiens; identical to SEQ ID NO: 58172

SEQ ID NO: 62995 - DNA, 38 bp, Homo sapiens
gaccggggtccggtgcggagtgcccttcgtcctgggaa

SEQ ID NO: 62996 - DNA, 31 bp, Homo sapiens; identical to SEQ ID NO: 28119

SEQ ID NO: 62997 - DNA, 29 bp, Homo sapiens
cgctaaaccattcgtagacgacctgcttc

SEQ ID NO: 62998 - DNA, 28 bp, Homo sapiens
gctaaaccattcgtagacgacctgcttc

SEQ ID NO: 62999 - DNA, 24 bp, Homo sapiens
taaaccattcgtagacgacctgct

SEQ ID NO: 63000 - DNA, 24 bp, Homo sapiens
aaaccattcgtagacgacctgctt

SEQ ID NO: 63001 - DNA, 25 bp, Homo sapiens
aaaccattcgtagacgacctgcttc

SEQ ID NO: 63002 - DNA, 24 bp, Homo sapiens
aaccattcgtagacgacctgcttc

SEQ ID NO: 63003 - DNA, 23 bp, Homo sapiens
accattcgtagacgacctgcttc

SEQ ID NO: 63004 - DNA, 38 bp, Homo sapiens; identical to SEQ ID NO: 61401

SEQ ID NO: 63005 - DNA, 37 bp, Homo sapiens; identical to SEQ ID NO: 62687

SEQ ID NO: 63006 - DNA, 46 bp, Homo sapiens; identical to SEQ ID NO: 28404

SEQ ID NO: 63007 - DNA, 36 bp, Homo sapiens; identical to SEQ ID NO: 28409

SEQ ID NO: 63008 - DNA, 37 bp, Homo sapiens; identical to SEQ ID NO: 62691

SEQ ID NO: 63009 - DNA, 38 bp, Homo sapiens
ctcgctgcgatctattgaaagtcagccctcgacacaag

SEQ ID NO: 63010 - DNA, 44 bp, Homo sapiens; identical to SEQ ID NO: 28412

SEQ ID NO: 63011 - DNA, 45 bp, Homo sapiens; identical to SEQ ID NO: 28413

SEQ ID NO: 63012 - DNA, 35 bp, Homo sapiens; identical to SEQ ID NO: 58227

SEQ ID NO: 63013 - DNA, 36 bp, Homo sapiens
tcgctgcgatctattgaaagtcagccctcgacacaa

SEQ ID NO: 63014 - DNA, 43 bp, Homo sapiens; identical to SEQ ID NO: 28424

SEQ ID NO: 63015 - DNA, 44 bp, Homo sapiens; identical to SEQ ID NO: 28425

SEQ ID NO: 63016 - DNA, 34 bp, Homo sapiens; identical to SEQ ID NO: 58230

SEQ ID NO: 63017 - DNA, 35 bp, Homo sapiens; identical to SEQ ID NO: 61411

SEQ ID NO: 63018 - DNA, 42 bp, Homo sapiens; identical to SEQ ID NO: 28436

SEQ ID NO: 63019 - DNA, 43 bp, Homo sapiens; identical to SEQ ID NO: 28437

SEQ ID NO: 63020 - DNA, 33 bp, Homo sapiens; identical to SEQ ID NO: 58233

SEQ ID NO: 63021 - DNA, 34 bp, Homo sapiens
gctgcgatctattgaaagtcagccctcgacacaa

SEQ ID NO: 63022 - DNA, 39 bp, Homo sapiens
gctgcgatctattgaaagtcagccctcgacacaagggtt

SEQ ID NO: 63023 - DNA, 41 bp, Homo sapiens; identical to SEQ ID NO: 28443

SEQ ID NO: 63024 - DNA, 42 bp, Homo sapiens; identical to SEQ ID NO: 28444

SEQ ID NO: 63025 - DNA, 43 bp, Homo sapiens; identical to SEQ ID NO: 62707

SEQ ID NO: 63026 - DNA, 41 bp, Homo sapiens; identical to SEQ ID NO: 61419

SEQ ID NO: 63027 - DNA, 39 bp, Homo sapiens; identical to SEQ ID NO: 58236

SEQ ID NO: 63028 - DNA, 37 bp, Homo sapiens
gatctattgaaagtcagccctcgacacaagggtttgt

SEQ ID NO: 63029 - DNA, 36 bp, Homo sapiens; identical to SEQ ID NO: 28453

SEQ ID NO: 63030 - DNA, 34 bp, Homo sapiens; identical to SEQ ID NO: 58238

SEQ ID NO: 63031 - DNA, 33 bp, Homo sapiens; identical to SEQ ID NO: 6508

SEQ ID NO: 63032 - DNA, 29 bp, Homo sapiens
gaaagtcagccctcgacacaagggtttgt

SEQ ID NO: 63033 - DNA, 19 bp, Homo sapiens
cctcgacacaagggtttgt

SEQ ID NO: 63034 - DNA, 16 bp, Homo sapiens
tcgacacaagggtttg

SEQ ID NO: 63035 - DNA, 17 bp, Homo sapiens
tcgacacaagggtttgt

SEQ ID NO: 63036 - DNA, 16 bp, Homo sapiens
cgacacaagggtttgt

SEQ ID NO: 63037 - DNA, 19 bp, Homo sapiens
gtctacggccataccaccc

SEQ ID NO: 63038 - DNA, 33 bp, Homo sapiens; identical to SEQ ID NO: 11

SEQ ID NO: 63039 - DNA, 35 bp, Homo sapiens; identical to SEQ ID NO: 56898

SEQ ID NO: 63040 - DNA, 32 bp, Homo sapiens; identical to SEQ ID NO: 215

SEQ ID NO: 63041 - DNA, 19 bp, Homo sapiens
gctaaacctagccccaaac

SEQ ID NO: 63042 - DNA, 20 bp, Homo sapiens
gctaaacctagccccaaacc

SEQ ID NO: 63043 - DNA, 21 bp, Homo sapiens
gctaaacctagccccaaaccc

SEQ ID NO: 63044 - DNA, 22 bp, Homo sapiens
gctaaacctagccccaaaccca

SEQ ID NO: 63045 - DNA, 23 bp, Homo sapiens
gctaaacctagccccaaacccac

SEQ ID NO: 63046 - DNA, 24 bp, Homo sapiens
gctaaacctagccccaaacccact

SEQ ID NO: 63047 - DNA, 25 bp, Homo sapiens
gctaaacctagccccaaacccactc

SEQ ID NO: 63048 - DNA, 26 bp, Homo sapiens
gctaaacctagccccaaacccactcc

SEQ ID NO: 63049 - DNA, 27 bp, Homo sapiens
gctaaacctagccccaaacccactcca

SEQ ID NO: 63050 - DNA, 29 bp, Homo sapiens
gctaaacctagccccaaacccactccacc

SEQ ID NO: 63051 - DNA, 30 bp, Homo sapiens; identical to SEQ ID NO: 832

SEQ ID NO: 63052 - DNA, 31 bp, Homo sapiens; identical to SEQ ID NO: 833

SEQ ID NO: 63053 - DNA, 32 bp, Homo sapiens; identical to SEQ ID NO: 834

SEQ ID NO: 63054 - DNA, 34 bp, Homo sapiens; identical to SEQ ID NO: 8827

SEQ ID NO: 63055 - DNA, 35 bp, Homo sapiens; identical to SEQ ID NO: 8828

SEQ ID NO: 63056 - DNA, 36 bp, Homo sapiens; identical to SEQ ID NO: 8829

SEQ ID NO: 63057 - DNA, 37 bp, Homo sapiens; identical to SEQ ID NO: 8830

SEQ ID NO: 63058 - DNA, 38 bp, Homo sapiens; identical to SEQ ID NO: 8831

SEQ ID NO: 63059 - DNA, 39 bp, Homo sapiens; identical to SEQ ID NO: 8832

SEQ ID NO: 63060 - DNA, 40 bp, Homo sapiens; identical to SEQ ID NO: 8833

SEQ ID NO: 63061 - DNA, 41 bp, Homo sapiens; identical to SEQ ID NO: 8834

SEQ ID NO: 63062 - DNA, 42 bp, Homo sapiens; identical to SEQ ID NO: 8835

SEQ ID NO: 63063 - DNA, 43 bp, Homo sapiens; identical to SEQ ID NO: 8836

SEQ ID NO: 63064 - DNA, 44 bp, Homo sapiens; identical to SEQ ID NO: 8837

SEQ ID NO: 63065 - DNA, 45 bp, Homo sapiens; identical to SEQ ID NO: 8838

SEQ ID NO: 63066 - DNA, 46 bp, Homo sapiens; identical to SEQ ID NO: 8839

SEQ ID NO: 63067 - DNA, 36 bp, Homo sapiens; identical to SEQ ID NO: 61531

SEQ ID NO: 63068 - DNA, 35 bp, Homo sapiens; identical to SEQ ID NO: 61533

SEQ ID NO: 63069 - DNA, 33 bp, Homo sapiens
acatgctaagacttcaccagtcaaagcgaacta

SEQ ID NO: 63070 - DNA, 33 bp, Homo sapiens; identical to SEQ ID NO: 11848

SEQ ID NO: 63071 - DNA, 24 bp, Homo sapiens
tacctggttgatcctgccagtagc

SEQ ID NO: 63072 - DNA, 38 bp, Homo sapiens
ccgtccccgccccttgcctctcggcgccccctcgatgc

SEQ ID NO: 63073 - DNA, 36 bp, Homo sapiens
cgtccccgccccttgcctctcggcgccccctcgatg

SEQ ID NO: 63074 - DNA, 37 bp, Homo sapiens
cgtccccgccccttgcctctcggcgccccctcgatgc

SEQ ID NO: 63075 - DNA, 38 bp, Homo sapiens; identical to SEQ ID NO: 58743

SEQ ID NO: 63076 - DNA, 36 bp, Homo sapiens
gtccccgccccttgcctctcggcgccccctcgatgc

SEQ ID NO: 63077 - DNA, 45 bp, Homo sapiens
cccgaagcgtttactttgaaaaaattagagtgttcaaagcaggcc

SEQ ID NO: 63078 - DNA, 44 bp, Homo sapiens
ccgaagcgtttactttgaaaaaattagagtgttcaaagcaggcc

SEQ ID NO: 63079 - DNA, 46 bp, Homo sapiens
ccgaagcgtttactttgaaaaaattagagtgttcaaagcaggcccg

SEQ ID NO: 63080 - DNA, 45 bp, Homo sapiens; identical to SEQ ID NO: 58747

SEQ ID NO: 63081 - DNA, 46 bp, Homo sapiens
cgaagcgtttactttgaaaaaattagagtgttcaaagcaggcccga

SEQ ID NO: 63082 - DNA, 42 bp, Homo sapiens
gaagcgtttactttgaaaaaattagagtgttcaaagcaggcc

SEQ ID NO: 63083 - DNA, 44 bp, Homo sapiens; identical to SEQ ID NO: 57068

SEQ ID NO: 63084 - DNA, 45 bp, Homo sapiens; identical to SEQ ID NO: 62797

SEQ ID NO: 63085 - DNA, 43 bp, Homo sapiens; identical to SEQ ID NO: 58749

SEQ ID NO: 63086 - DNA, 44 bp, Homo sapiens; identical to SEQ ID NO: 62799

SEQ ID NO: 63087 - DNA, 40 bp, Homo sapiens
agcgtttactttgaaaaaattagagtgttcaaagcaggcc

SEQ ID NO: 63088 - DNA, 42 bp, Homo sapiens; identical to SEQ ID NO: 58750

SEQ ID NO: 63089 - DNA, 43 bp, Homo sapiens; identical to SEQ ID NO: 62801

SEQ ID NO: 63090 - DNA, 29 bp, Homo sapiens
gagcgctgagaagacggtcgaacttgact

SEQ ID NO: 63091 - DNA, 28 bp, Homo sapiens
agcgctgagaagacggtcgaacttgact

SEQ ID NO: 63092 - DNA, 29 bp, Homo sapiens
agcgctgagaagacggtcgaacttgacta

SEQ ID NO: 63093 - DNA, 39 bp, Homo sapiens; identical to SEQ ID NO: 17400

SEQ ID NO: 63094 - DNA, 21 bp, Homo sapiens
tacgcctgtctgagcgtcgct

SEQ ID NO: 63095 - DNA, 22 bp, Homo sapiens
tacgcctgtctgagcgtcgctt

SEQ ID NO: 63096 - DNA, 17 bp, Homo sapiens
cgcgacctcagatcaga

SEQ ID NO: 63097 - DNA, 19 bp, Homo sapiens
cgcgacctcagatcagacg

SEQ ID NO: 63098 - DNA, 20 bp, Homo sapiens
cgcgacctcagatcagacgt

SEQ ID NO: 63099 - DNA, 34 bp, Homo sapiens; identical to SEQ ID NO: 18258

SEQ ID NO: 63100 - DNA, 19 bp, Homo sapiens
gagcccagcgccgaatccc

SEQ ID NO: 63101 - DNA, 21 bp, Homo sapiens
gagcccagcgccgaatccccg

SEQ ID NO: 63102 - DNA, 22 bp, Homo sapiens
gagcccagcgccgaatccccgc

SEQ ID NO: 63103 - DNA, 23 bp, Homo sapiens
gagcccagcgccgaatccccgcc

SEQ ID NO: 63104 - DNA, 24 bp, Homo sapiens
gagcccagcgccgaatccccgccc

SEQ ID NO: 63105 - DNA, 36 bp, Homo sapiens
gggccccgtccgtccgtccgtccgtcctcctcctcc

SEQ ID NO: 63106 - DNA, 18 bp, Homo sapiens
cgcgcgtcccccgaagag

SEQ ID NO: 63107 - DNA, 26 bp, Homo sapiens
cgggccgccggtgaaataccactact

SEQ ID NO: 63108 - DNA, 25 bp, Homo sapiens
gggccgccggtgaaataccactact

SEQ ID NO: 63109 - DNA, 24 bp, Homo sapiens
ggccgccggtgaaataccactact

SEQ ID NO: 63110 - DNA, 23 bp, Homo sapiens
gccgccggtgaaataccactact

SEQ ID NO: 63111 - DNA, 30 bp, Homo sapiens; identical to SEQ ID NO: 56331

SEQ ID NO: 63112 - DNA, 29 bp, Homo sapiens
cgctaaaccattcgtagacgacctgcttc

SEQ ID NO: 63113 - DNA, 24 bp, Homo sapiens
aaccattcgtagacgacctgcttc

SEQ ID NO: 63114 - DNA, 23 bp, Homo sapiens
accattcgtagacgacctgcttc

SEQ ID NO: 63115 - DNA, 42 bp, Homo sapiens; identical to SEQ ID NO: 28444

SEQ ID NO: 63116 - DNA, 25 bp, Homo sapiens
gtctacggccataccaccctgaacg

SEQ ID NO: 63117 - DNA, 32 bp, Homo sapiens; identical to SEQ ID NO: 10

SEQ ID NO: 63118 - DNA, 39 bp, Homo sapiens; identical to SEQ ID NO: 6547

SEQ ID NO: 63119 - DNA, 32 bp, Homo sapiens; identical to SEQ ID NO: 215

SEQ ID NO: 63120 - DNA, 32 bp, Homo sapiens; identical to SEQ ID NO: 61475

SEQ ID NO: 63121 - DNA, 43 bp, Homo sapiens
gaacacacaatagctaagacccaaactgggattagatacccca

SEQ ID NO: 63122 - DNA, 39 bp, Homo sapiens
acacaatagctaagacccaaactgggattagatacccca

SEQ ID NO: 63123 - DNA, 18 bp, Homo sapiens
gacatttaactaaaaccc

SEQ ID NO: 63124 - DNA, 19 bp, Homo sapiens
gacatttaactaaaacccc

SEQ ID NO: 63125 - DNA, 20 bp, Homo sapiens
gacatttaactaaaacccct

SEQ ID NO: 63126 - DNA, 21 bp, Homo sapiens
gacatttaactaaaaccccta

SEQ ID NO: 63127 - DNA, 39 bp, Homo sapiens; identical to SEQ ID NO: 62730

SEQ ID NO: 63128 - DNA, 36 bp, Homo sapiens; identical to SEQ ID NO: 62732

SEQ ID NO: 63129 - DNA, 35 bp, Homo sapiens
acatggtaagtgtactggaaagtgcacttggacga

SEQ ID NO: 63130 - DNA, 33 bp, Homo sapiens; identical to SEQ ID NO: 815

SEQ ID NO: 63131 - DNA, 34 bp, Homo sapiens
catggtaagtgtactggaaagtgcacttggacga

SEQ ID NO: 63132 - DNA, 20 bp, Homo sapiens
gctaaacctagccccaaacc

SEQ ID NO: 63133 - DNA, 21 bp, Homo sapiens
gctaaacctagccccaaaccc

SEQ ID NO: 63134 - DNA, 22 bp, Homo sapiens
gctaaacctagccccaaaccca

SEQ ID NO: 63135 - DNA, 23 bp, Homo sapiens
gctaaacctagccccaaacccac

SEQ ID NO: 63136 - DNA, 24 bp, Homo sapiens
gctaaacctagccccaaacccact

SEQ ID NO: 63137 - DNA, 27 bp, Homo sapiens
gctaaacctagccccaaacccactcca

SEQ ID NO: 63138 - DNA, 29 bp, Homo sapiens
gctaaacctagccccaaacccactccacc

SEQ ID NO: 63139 - DNA, 30 bp, Homo sapiens; identical to SEQ ID NO: 832

SEQ ID NO: 63140 - DNA, 32 bp, Homo sapiens; identical to SEQ ID NO: 834

SEQ ID NO: 63141 - DNA, 34 bp, Homo sapiens; identical to SEQ ID NO: 8827

SEQ ID NO: 63142 - DNA, 35 bp, Homo sapiens; identical to SEQ ID NO: 8828

SEQ ID NO: 63143 - DNA, 37 bp, Homo sapiens; identical to SEQ ID NO: 8830

SEQ ID NO: 63144 - DNA, 38 bp, Homo sapiens; identical to SEQ ID NO: 8831

SEQ ID NO: 63145 - DNA, 39 bp, Homo sapiens; identical to SEQ ID NO: 8832

SEQ ID NO: 63146 - DNA, 40 bp, Homo sapiens; identical to SEQ ID NO: 8833

SEQ ID NO: 63147 - DNA, 41 bp, Homo sapiens; identical to SEQ ID NO: 8834

SEQ ID NO: 63148 - DNA, 42 bp, Homo sapiens; identical to SEQ ID NO: 8835

SEQ ID NO: 63149 - DNA, 43 bp, Homo sapiens; identical to SEQ ID NO: 8836

SEQ ID NO: 63150 - DNA, 44 bp, Homo sapiens; identical to SEQ ID NO: 8837

SEQ ID NO: 63151 - DNA, 45 bp, Homo sapiens; identical to SEQ ID NO: 8838

SEQ ID NO: 63152 - DNA, 46 bp, Homo sapiens; identical to SEQ ID NO: 8839

SEQ ID NO: 63153 - DNA, 42 bp, Homo sapiens; identical to SEQ ID NO: 9032

SEQ ID NO: 63154 - DNA, 41 bp, Homo sapiens; identical to SEQ ID NO: 9041

SEQ ID NO: 63155 - DNA, 29 bp, Homo sapiens
gacacatgtttaacggccgcggtacccta

SEQ ID NO: 63156 - DNA, 34 bp, Homo sapiens; identical to SEQ ID NO: 61532

SEQ ID NO: 63157 - DNA, 35 bp, Homo sapiens; identical to SEQ ID NO: 61533

SEQ ID NO: 63158 - DNA, 33 bp, Homo sapiens
aacggaacaagttaccctagggataacagcgca

SEQ ID NO: 63159 - DNA, 32 bp, Homo sapiens
acggaacaagttaccctagggataacagcgca

SEQ ID NO: 63160 - DNA, 30 bp, Homo sapiens
ggaacaagttaccctagggataacagcgca

SEQ ID NO: 63161 - DNA, 29 bp, Homo sapiens
gaacaagttaccctagggataacagcgca

SEQ ID NO: 63162 - DNA, 36 bp, Homo sapiens
gacctcgatgttggatcaggacatcccgatggtgca

SEQ ID NO: 63163 - DNA, 38 bp, Homo sapiens; identical to SEQ ID NO: 62760

SEQ ID NO: 63164 - DNA, 18 bp, Homo sapiens
tacctggttgatcctgcc

SEQ ID NO: 63165 - DNA, 44 bp, Homo sapiens; identical to SEQ ID NO: 12079

SEQ ID NO: 63166 - DNA, 46 bp, Homo sapiens
ctcctacttggataactgtggtaattctagagctaatacatgccga

SEQ ID NO: 63167 - DNA, 44 bp, Homo sapiens; identical to SEQ ID NO: 58568

SEQ ID NO: 63168 - DNA, 45 bp, Homo sapiens; identical to SEQ ID NO: 62767

SEQ ID NO: 63169 - DNA, 41 bp, Homo sapiens; identical to SEQ ID NO: 61621

SEQ ID NO: 63170 - DNA, 42 bp, Homo sapiens; identical to SEQ ID NO: 12493

SEQ ID NO: 63171 - DNA, 43 bp, Homo sapiens; identical to SEQ ID NO: 57022

SEQ ID NO: 63172 - DNA, 44 bp, Homo sapiens; identical to SEQ ID NO: 57023

SEQ ID NO: 63173 - DNA, 46 bp, Homo sapiens
cctacttggataactgtggtaattctagagctaatacatgccgacg

SEQ ID NO: 63174 - DNA, 42 bp, Homo sapiens; identical to SEQ ID NO: 57025

SEQ ID NO: 63175 - DNA, 43 bp, Homo sapiens; identical to SEQ ID NO: 57026

SEQ ID NO: 63176 - DNA, 28 bp, Homo sapiens
gcgtgcatttatcagatcaaaaccaacc

SEQ ID NO: 63177 - DNA, 30 bp, Homo sapiens; identical to SEQ ID NO: 34661

SEQ ID NO: 63178 - DNA, 40 bp, Homo sapiens
ccggcggctttggtgactctagataacctcgggccgatcg

SEQ ID NO: 63179 - DNA, 37 bp, Homo sapiens; identical to SEQ ID NO: 61637

SEQ ID NO: 63180 - DNA, 38 bp, Homo sapiens; identical to SEQ ID NO: 12749

SEQ ID NO: 63181 - DNA, 39 bp, Homo sapiens; identical to SEQ ID NO: 12750

SEQ ID NO: 63182 - DNA, 42 bp, Homo sapiens; identical to SEQ ID NO: 57042

SEQ ID NO: 63183 - DNA, 36 bp, Homo sapiens; identical to SEQ ID NO: 61641

SEQ ID NO: 63184 - DNA, 37 bp, Homo sapiens; identical to SEQ ID NO: 12768

SEQ ID NO: 63185 - DNA, 23 bp, Homo sapiens
accacgggtgacggggaatcagg

SEQ ID NO: 63186 - DNA, 19 bp, Homo sapiens
cggcgccccctcgatgctc

SEQ ID NO: 63187 - DNA, 30 bp, Homo sapiens
ccctcgatgctcttagctgagtgtcccgcg

SEQ ID NO: 63188 - DNA, 24 bp, Homo sapiens
gagtgtcccgcggggcccgaagcg

SEQ ID NO: 63189 - DNA, 44 bp, Homo sapiens; identical to SEQ ID NO: 57068

SEQ ID NO: 63190 - DNA, 43 bp, Homo sapiens; identical to SEQ ID NO: 58749

SEQ ID NO: 63191 - DNA, 42 bp, Homo sapiens; identical to SEQ ID NO: 58750

SEQ ID NO: 63192 - DNA, 35 bp, Homo sapiens; identical to SEQ ID NO: 61662

SEQ ID NO: 63193 - DNA, 36 bp, Homo sapiens; identical to SEQ ID NO: 61663

SEQ ID NO: 63194 - DNA, 34 bp, Homo sapiens; identical to SEQ ID NO: 61665

SEQ ID NO: 63195 - DNA, 35 bp, Homo sapiens; identical to SEQ ID NO: 61666

SEQ ID NO: 63196 - DNA, 36 bp, Homo sapiens; identical to SEQ ID NO: 62810

SEQ ID NO: 63197 - DNA, 18 bp, Homo sapiens
gcttccgggaaaccaaag

SEQ ID NO: 63198 - DNA, 32 bp, Homo sapiens; identical to SEQ ID NO: 2797

SEQ ID NO: 63199 - DNA, 34 bp, Homo sapiens; identical to SEQ ID NO: 57102

SEQ ID NO: 63200 - DNA, 29 bp, Homo sapiens
tctggcatgctaactagttacgcgacccc

SEQ ID NO: 63201 - DNA, 28 bp, Homo sapiens
ctggcatgctaactagttacgcgacccc

SEQ ID NO: 63202 - DNA, 27 bp, Homo sapiens
tggcatgctaactagttacgcgacccc

SEQ ID NO: 63203 - DNA, 26 bp, Homo sapiens
ggcatgctaactagttacgcgacccc

SEQ ID NO: 63204 - DNA, 24 bp, Homo sapiens
catgctaactagttacgcgacccc

SEQ ID NO: 63205 - DNA, 18 bp, Homo sapiens
cctgcggaaggatcatta

SEQ ID NO: 63206 - DNA, 17 bp, Homo sapiens
ctgcggaaggatcatta

SEQ ID NO: 63207 - DNA, 17 bp, Homo sapiens
tctctctctctctctcc

SEQ ID NO: 63208 - DNA, 35 bp, Homo sapiens; identical to SEQ ID NO: 17346

SEQ ID NO: 63209 - DNA, 37 bp, Homo sapiens; identical to SEQ ID NO: 17348

SEQ ID NO: 63210 - DNA, 34 bp, Homo sapiens; identical to SEQ ID NO: 59173

SEQ ID NO: 63211 - DNA, 36 bp, Homo sapiens; identical to SEQ ID NO: 57213

SEQ ID NO: 63212 - DNA, 32 bp, Homo sapiens; identical to SEQ ID NO: 17375

SEQ ID NO: 63213 - DNA, 34 bp, Homo sapiens; identical to SEQ ID NO: 59178

SEQ ID NO: 63214 - DNA, 16 bp, Homo sapiens
cgactcttagcggtgg

SEQ ID NO: 63215 - DNA, 17 bp, Homo sapiens
cgactcttagcggtgga

SEQ ID NO: 63216 - DNA, 18 bp, Homo sapiens
cgactcttagcggtggat

SEQ ID NO: 63217 - DNA, 19 bp, Homo sapiens
cgactcttagcggtggatc

SEQ ID NO: 63218 - DNA, 20 bp, Homo sapiens
cgactcttagcggtggatca

SEQ ID NO: 63219 - DNA, 25 bp, Homo sapiens
cgactcttagcggtggatcactcgg

SEQ ID NO: 63220 - DNA, 26 bp, Homo sapiens
cgactcttagcggtggatcactcggc

SEQ ID NO: 63221 - DNA, 27 bp, Homo sapiens
cgactcttagcggtggatcactcggct

SEQ ID NO: 63222 - DNA, 28 bp, Homo sapiens
cgactcttagcggtggatcactcggctc

SEQ ID NO: 63223 - DNA, 29 bp, Homo sapiens
cgactcttagcggtggatcactcggctcg

SEQ ID NO: 63224 - DNA, 30 bp, Homo sapiens; identical to SEQ ID NO: 3579

SEQ ID NO: 63225 - DNA, 31 bp, Homo sapiens; identical to SEQ ID NO: 3580

SEQ ID NO: 63226 - DNA, 33 bp, Homo sapiens; identical to SEQ ID NO: 3582

SEQ ID NO: 63227 - DNA, 34 bp, Homo sapiens; identical to SEQ ID NO: 17395

SEQ ID NO: 63228 - DNA, 36 bp, Homo sapiens; identical to SEQ ID NO: 17397

SEQ ID NO: 63229 - DNA, 37 bp, Homo sapiens; identical to SEQ ID NO: 17398

SEQ ID NO: 63230 - DNA, 38 bp, Homo sapiens; identical to SEQ ID NO: 17399

SEQ ID NO: 63231 - DNA, 39 bp, Homo sapiens; identical to SEQ ID NO: 17400

SEQ ID NO: 63232 - DNA, 40 bp, Homo sapiens; identical to SEQ ID NO: 61756

SEQ ID NO: 63233 - DNA, 42 bp, Homo sapiens; identical to SEQ ID NO: 17401

SEQ ID NO: 63234 - DNA, 16 bp, Homo sapiens
gactcttagcggtgga

SEQ ID NO: 63235 - DNA, 17 bp, Homo sapiens
gactcttagcggtggat

SEQ ID NO: 63236 - DNA, 18 bp, Homo sapiens
gactcttagcggtggatc

SEQ ID NO: 63237 - DNA, 21 bp, Homo sapiens
gactcttagcggtggatcact

SEQ ID NO: 63238 - DNA, 22 bp, Homo sapiens
gactcttagcggtggatcactc

SEQ ID NO: 63239 - DNA, 23 bp, Homo sapiens
gactcttagcggtggatcactcg

SEQ ID NO: 63240 - DNA, 24 bp, Homo sapiens
gactcttagcggtggatcactcgg

SEQ ID NO: 63241 - DNA, 25 bp, Homo sapiens
gactcttagcggtggatcactcggc

SEQ ID NO: 63242 - DNA, 26 bp, Homo sapiens
gactcttagcggtggatcactcggct

SEQ ID NO: 63243 - DNA, 28 bp, Homo sapiens
gactcttagcggtggatcactcggctcg

SEQ ID NO: 63244 - DNA, 29 bp, Homo sapiens
gactcttagcggtggatcactcggctcgt

SEQ ID NO: 63245 - DNA, 30 bp, Homo sapiens; identical to SEQ ID NO: 3590

SEQ ID NO: 63246 - DNA, 32 bp, Homo sapiens; identical to SEQ ID NO: 3591

SEQ ID NO: 63247 - DNA, 33 bp, Homo sapiens; identical to SEQ ID NO: 17420

SEQ ID NO: 63248 - DNA, 36 bp, Homo sapiens; identical to SEQ ID NO: 17422

SEQ ID NO: 63249 - DNA, 31 bp, Homo sapiens; identical to SEQ ID NO: 17434

SEQ ID NO: 63250 - DNA, 23 bp, Homo sapiens
cggtggatcactcggctcgtgcg

SEQ ID NO: 63251 - DNA, 42 bp, Homo sapiens; identical to SEQ ID NO: 17761

SEQ ID NO: 63252 - DNA, 43 bp, Homo sapiens; identical to SEQ ID NO: 17762

SEQ ID NO: 63253 - DNA, 29 bp, Homo sapiens
tcctcccggggctacgcctgtctgagcgt

SEQ ID NO: 63254 - DNA, 33 bp, Homo sapiens; identical to SEQ ID NO: 3741

SEQ ID NO: 63255 - DNA, 34 bp, Homo sapiens; identical to SEQ ID NO: 18002

SEQ ID NO: 63256 - DNA, 27 bp, Homo sapiens
cctcccggggctacgcctgtctgagcg

SEQ ID NO: 63257 - DNA, 32 bp, Homo sapiens; identical to SEQ ID NO: 3743

SEQ ID NO: 63258 - DNA, 23 bp, Homo sapiens
tcccggggctacgcctgtctgag

SEQ ID NO: 63259 - DNA, 21 bp, Homo sapiens
cccggggctacgcctgtctga

SEQ ID NO: 63260 - DNA, 22 bp, Homo sapiens
cccggggctacgcctgtctgag

SEQ ID NO: 63261 - DNA, 24 bp, Homo sapiens
cccggggctacgcctgtctgagcg

SEQ ID NO: 63262 - DNA, 27 bp, Homo sapiens
cggggctacgcctgtctgagcgtcgct

SEQ ID NO: 63263 - DNA, 26 bp, Homo sapiens
ggggctacgcctgtctgagcgtcgct

SEQ ID NO: 63264 - DNA, 25 bp, Homo sapiens
gggctacgcctgtctgagcgtcgct

SEQ ID NO: 63265 - DNA, 22 bp, Homo sapiens
ctacgcctgtctgagcgtcgct

SEQ ID NO: 63266 - DNA, 21 bp, Homo sapiens
tacgcctgtctgagcgtcgct

SEQ ID NO: 63267 - DNA, 16 bp, Homo sapiens
acgcctgtctgagcgt

SEQ ID NO: 63268 - DNA, 19 bp, Homo sapiens
acgcctgtctgagcgtcgc

SEQ ID NO: 63269 - DNA, 20 bp, Homo sapiens
acgcctgtctgagcgtcgct

SEQ ID NO: 63270 - DNA, 17 bp, Homo sapiens
cgcctgtctgagcgtcg

SEQ ID NO: 63271 - DNA, 18 bp, Homo sapiens
cgcctgtctgagcgtcgc

SEQ ID NO: 63272 - DNA, 19 bp, Homo sapiens
cgcctgtctgagcgtcgct

SEQ ID NO: 63273 - DNA, 18 bp, Homo sapiens
gcctgtctgagcgtcgct

SEQ ID NO: 63274 - DNA, 21 bp, Homo sapiens
gacgcgacctcagatcagacg

SEQ ID NO: 63275 - DNA, 22 bp, Homo sapiens
gacgcgacctcagatcagacgt

SEQ ID NO: 63276 - DNA, 33 bp, Homo sapiens; identical to SEQ ID NO: 3835

SEQ ID NO: 63277 - DNA, 18 bp, Homo sapiens
acgcgacctcagatcaga

SEQ ID NO: 63278 - DNA, 19 bp, Homo sapiens
acgcgacctcagatcagac

SEQ ID NO: 63279 - DNA, 20 bp, Homo sapiens
acgcgacctcagatcagacg

SEQ ID NO: 63280 - DNA, 21 bp, Homo sapiens
acgcgacctcagatcagacgt

SEQ ID NO: 63281 - DNA, 22 bp, Homo sapiens
acgcgacctcagatcagacgtg

SEQ ID NO: 63282 - DNA, 25 bp, Homo sapiens
acgcgacctcagatcagacgtggcg

SEQ ID NO: 63283 - DNA, 28 bp, Homo sapiens
acgcgacctcagatcagacgtggcgacc

SEQ ID NO: 63284 - DNA, 29 bp, Homo sapiens
acgcgacctcagatcagacgtggcgaccc

SEQ ID NO: 63285 - DNA, 30 bp, Homo sapiens; identical to SEQ ID NO: 3848

SEQ ID NO: 63286 - DNA, 32 bp, Homo sapiens; identical to SEQ ID NO: 3850

SEQ ID NO: 63287 - DNA, 34 bp, Homo sapiens; identical to SEQ ID NO: 18226

SEQ ID NO: 63288 - DNA, 35 bp, Homo sapiens; identical to SEQ ID NO: 18227

SEQ ID NO: 63289 - DNA, 36 bp, Homo sapiens; identical to SEQ ID NO: 18228

SEQ ID NO: 63290 - DNA, 37 bp, Homo sapiens; identical to SEQ ID NO: 18229

SEQ ID NO: 63291 - DNA, 38 bp, Homo sapiens; identical to SEQ ID NO: 18230

SEQ ID NO: 63292 - DNA, 43 bp, Homo sapiens; identical to SEQ ID NO: 18235

SEQ ID NO: 63293 - DNA, 45 bp, Homo sapiens; identical to SEQ ID NO: 18237

SEQ ID NO: 63294 - DNA, 17 bp, Homo sapiens
cgcgacctcagatcaga

SEQ ID NO: 63295 - DNA, 18 bp, Homo sapiens
cgcgacctcagatcagac

SEQ ID NO: 63296 - DNA, 19 bp, Homo sapiens
cgcgacctcagatcagacg

SEQ ID NO: 63297 - DNA, 20 bp, Homo sapiens
cgcgacctcagatcagacgt

SEQ ID NO: 63298 - DNA, 21 bp, Homo sapiens
cgcgacctcagatcagacgtg

SEQ ID NO: 63299 - DNA, 22 bp, Homo sapiens
cgcgacctcagatcagacgtgg

SEQ ID NO: 63300 - DNA, 23 bp, Homo sapiens
cgcgacctcagatcagacgtggc

SEQ ID NO: 63301 - DNA, 24 bp, Homo sapiens
cgcgacctcagatcagacgtggcg

SEQ ID NO: 63302 - DNA, 25 bp, Homo sapiens
cgcgacctcagatcagacgtggcga

SEQ ID NO: 63303 - DNA, 26 bp, Homo sapiens
cgcgacctcagatcagacgtggcgac

SEQ ID NO: 63304 - DNA, 27 bp, Homo sapiens
cgcgacctcagatcagacgtggcgacc

SEQ ID NO: 63305 - DNA, 28 bp, Homo sapiens
cgcgacctcagatcagacgtggcgaccc

SEQ ID NO: 63306 - DNA, 29 bp, Homo sapiens
cgcgacctcagatcagacgtggcgacccg

SEQ ID NO: 63307 - DNA, 30 bp, Homo sapiens; identical to SEQ ID NO: 3865

SEQ ID NO: 63308 - DNA, 31 bp, Homo sapiens; identical to SEQ ID NO: 3866

SEQ ID NO: 63309 - DNA, 32 bp, Homo sapiens; identical to SEQ ID NO: 3867

SEQ ID NO: 63310 - DNA, 33 bp, Homo sapiens; identical to SEQ ID NO: 3868

SEQ ID NO: 63311 - DNA, 34 bp, Homo sapiens; identical to SEQ ID NO: 18258

SEQ ID NO: 63312 - DNA, 35 bp, Homo sapiens; identical to SEQ ID NO: 18259

SEQ ID NO: 63313 - DNA, 36 bp, Homo sapiens; identical to SEQ ID NO: 18260

SEQ ID NO: 63314 - DNA, 37 bp, Homo sapiens; identical to SEQ ID NO: 18261

SEQ ID NO: 63315 - DNA, 41 bp, Homo sapiens; identical to SEQ ID NO: 18265

SEQ ID NO: 63316 - DNA, 42 bp, Homo sapiens; identical to SEQ ID NO: 18266

SEQ ID NO: 63317 - DNA, 44 bp, Homo sapiens; identical to SEQ ID NO: 18268

SEQ ID NO: 63318 - DNA, 18 bp, Homo sapiens
gcgacctcagatcagacg

SEQ ID NO: 63319 - DNA, 19 bp, Homo sapiens
gcgacctcagatcagacgt

SEQ ID NO: 63320 - DNA, 20 bp, Homo sapiens
gcgacctcagatcagacgtg

SEQ ID NO: 63321 - DNA, 21 bp, Homo sapiens
gcgacctcagatcagacgtgg

SEQ ID NO: 63322 - DNA, 22 bp, Homo sapiens
gcgacctcagatcagacgtggc

SEQ ID NO: 63323 - DNA, 23 bp, Homo sapiens
gcgacctcagatcagacgtggcg

SEQ ID NO: 63324 - DNA, 24 bp, Homo sapiens
gcgacctcagatcagacgtggcga

SEQ ID NO: 63325 - DNA, 26 bp, Homo sapiens
gcgacctcagatcagacgtggcgacc

SEQ ID NO: 63326 - DNA, 27 bp, Homo sapiens
gcgacctcagatcagacgtggcgaccc

SEQ ID NO: 63327 - DNA, 28 bp, Homo sapiens
gcgacctcagatcagacgtggcgacccg

SEQ ID NO: 63328 - DNA, 19 bp, Homo sapiens
cgacctcagatcagacgtg

SEQ ID NO: 63329 - DNA, 20 bp, Homo sapiens
cgacctcagatcagacgtgg

SEQ ID NO: 63330 - DNA, 22 bp, Homo sapiens
cgacctcagatcagacgtggcg

SEQ ID NO: 63331 - DNA, 23 bp, Homo sapiens
cgacctcagatcagacgtggcga

SEQ ID NO: 63332 - DNA, 19 bp, Homo sapiens
gacctcagatcagacgtgg

SEQ ID NO: 63333 - DNA, 21 bp, Homo sapiens
gacctcagatcagacgtggcg

SEQ ID NO: 63334 - DNA, 22 bp, Homo sapiens
gacctcagatcagacgtggcga

SEQ ID NO: 63335 - DNA, 20 bp, Homo sapiens
acctcagatcagacgtggcg

SEQ ID NO: 63336 - DNA, 17 bp, Homo sapiens
cctcagatcagacgtgg

SEQ ID NO: 63337 - DNA, 18 bp, Homo sapiens
cctcagatcagacgtggc

SEQ ID NO: 63338 - DNA, 19 bp, Homo sapiens
cctcagatcagacgtggcg

SEQ ID NO: 63339 - DNA, 20 bp, Homo sapiens
cctcagatcagacgtggcga

SEQ ID NO: 63340 - DNA, 18 bp, Homo sapiens
ctcagatcagacgtggcg

SEQ ID NO: 63341 - DNA, 19 bp, Homo sapiens
cggaagacccgctccccgg

SEQ ID NO: 63342 - DNA, 22 bp, Homo sapiens
cggaagacccgctccccggcgc

SEQ ID NO: 63343 - DNA, 26 bp, Homo sapiens
cggaagacccgctccccggcgccgct

SEQ ID NO: 63344 - DNA, 32 bp, Homo sapiens; identical to SEQ ID NO: 62894

SEQ ID NO: 63345 - DNA, 25 bp, Homo sapiens
gcccaagtccttctgatcgaggccc

SEQ ID NO: 63346 - DNA, 24 bp, Homo sapiens
cccaagtccttctgatcgaggccc

SEQ ID NO: 63347 - DNA, 28 bp, Homo sapiens
agcccgtggacggtgtgaggccggtagc

SEQ ID NO: 63348 - DNA, 27 bp, Homo sapiens
gcccgtggacggtgtgaggccggtagc

SEQ ID NO: 63349 - DNA, 25 bp, Homo sapiens
ccatctaaggctaaataccggcacg

SEQ ID NO: 63350 - DNA, 26 bp, Homo sapiens
ccatctaaggctaaataccggcacga

SEQ ID NO: 63351 - DNA, 36 bp, Homo sapiens; identical to SEQ ID NO: 57468

SEQ ID NO: 63352 - DNA, 35 bp, Homo sapiens; identical to SEQ ID NO: 57469

SEQ ID NO: 63353 - DNA, 34 bp, Homo sapiens; identical to SEQ ID NO: 57470

SEQ ID NO: 63354 - DNA, 26 bp, Homo sapiens
gcccggcggatctttcccgccccccg

SEQ ID NO: 63355 - DNA, 26 bp, Homo sapiens
cccggcggatctttcccgccccccgt

SEQ ID NO: 63356 - DNA, 42 bp, Homo sapiens
cccggcggatctttcccgccccccgttcctcccgacccctcc

SEQ ID NO: 63357 - DNA, 43 bp, Homo sapiens
cccggcggatctttcccgccccccgttcctcccgacccctcca

SEQ ID NO: 63358 - DNA, 44 bp, Homo sapiens
cccggcggatctttcccgccccccgttcctcccgacccctccac

SEQ ID NO: 63359 - DNA, 45 bp, Homo sapiens
cccggcggatctttcccgccccccgttcctcccgacccctccacc

SEQ ID NO: 63360 - DNA, 46 bp, Homo sapiens
cccggcggatctttcccgccccccgttcctcccgacccctccaccc

SEQ ID NO: 63361 - DNA, 38 bp, Homo sapiens
cggatctttcccgccccccgttcctcccgacccctcca

SEQ ID NO: 63362 - DNA, 41 bp, Homo sapiens
cggatctttcccgccccccgttcctcccgacccctccaccc

SEQ ID NO: 63363 - DNA, 26 bp, Homo sapiens
ccccgttcctcccgacccctccaccc

SEQ ID NO: 63364 - DNA, 17 bp, Homo sapiens
cccgccctcccttcccc

SEQ ID NO: 63365 - DNA, 19 bp, Homo sapiens
cccgccctcccttcccccg

SEQ ID NO: 63366 - DNA, 17 bp, Homo sapiens
cgccctcccttcccccg

SEQ ID NO: 63367 - DNA, 21 bp, Homo sapiens
cccgaccggcgaccggccgcc

SEQ ID NO: 63368 - DNA, 18 bp, Homo sapiens
cgccgcgaccggctccgg

SEQ ID NO: 63369 - DNA, 19 bp, Homo sapiens
cgccgcgaccggctccggg

SEQ ID NO: 63370 - DNA, 32 bp, Homo sapiens
gggggccccgtccgtccgtccgtccgtcctcc

SEQ ID NO: 63371 - DNA, 35 bp, Homo sapiens
gggggccccgtccgtccgtccgtccgtcctcctcc

SEQ ID NO: 63372 - DNA, 38 bp, Homo sapiens
gggggccccgtccgtccgtccgtccgtcctcctcctcc

SEQ ID NO: 63373 - DNA, 30 bp, Homo sapiens
gggccccgtccgtccgtccgtccgtcctcc

SEQ ID NO: 63374 - DNA, 33 bp, Homo sapiens
gggccccgtccgtccgtccgtccgtcctcctcc

SEQ ID NO: 63375 - DNA, 36 bp, Homo sapiens; identical to SEQ ID NO: 63105

SEQ ID NO: 63376 - DNA, 33 bp, Homo sapiens
ccccgtccgtccgtccgtccgtcctcctcctcc

SEQ ID NO: 63377 - DNA, 21 bp, Homo sapiens
cccgtctccgccccccggccc

SEQ ID NO: 63378 - DNA, 18 bp, Homo sapiens
ccggccccgcgtcctccc

SEQ ID NO: 63379 - DNA, 17 bp, Homo sapiens
cggccccgcgtcctccc

SEQ ID NO: 63380 - DNA, 38 bp, Homo sapiens
ggcagcagcactcgccgaatcccggggccgagggagcg

SEQ ID NO: 63381 - DNA, 42 bp, Homo sapiens
ggcagcagcactcgccgaatcccggggccgagggagcgagac

SEQ ID NO: 63382 - DNA, 32 bp, Homo sapiens; identical to SEQ ID NO: 19741

SEQ ID NO: 63383 - DNA, 35 bp, Homo sapiens; identical to SEQ ID NO: 61998

SEQ ID NO: 63384 - DNA, 36 bp, Homo sapiens; identical to SEQ ID NO: 57624

SEQ ID NO: 63385 - DNA, 37 bp, Homo sapiens; identical to SEQ ID NO: 59878

SEQ ID NO: 63386 - DNA, 19 bp, Homo sapiens
cgccgaatcccggggccga

SEQ ID NO: 63387 - DNA, 19 bp, Homo sapiens
cccctcccacggcgcgacc

SEQ ID NO: 63388 - DNA, 18 bp, Homo sapiens
ccctcccacggcgcgacc

SEQ ID NO: 63389 - DNA, 25 bp, Homo sapiens
cggcgcgaccgctctcccacccctc

SEQ ID NO: 63390 - DNA, 23 bp, Homo sapiens
ggcgcgaccgctctcccacccct

SEQ ID NO: 63391 - DNA, 24 bp, Homo sapiens
ggcgcgaccgctctcccacccctc

SEQ ID NO: 63392 - DNA, 29 bp, Homo sapiens
ggcgcgaccgctctcccacccctcctccc

SEQ ID NO: 63393 - DNA, 16 bp, Homo sapiens
cccctcctccccgcgc

SEQ ID NO: 63394 - DNA, 18 bp, Homo sapiens
ggactgtccccagtgcgc

SEQ ID NO: 63395 - DNA, 24 bp, Homo sapiens
ccccgggcgggtcgcgccgtcggg

SEQ ID NO: 63396 - DNA, 23 bp, Homo sapiens
cccgggcgggtcgcgccgtcggg

SEQ ID NO: 63397 - DNA, 27 bp, Homo sapiens
cgggcgggtcgcgccgtcgggcccggg

SEQ ID NO: 63398 - DNA, 18 bp, Homo sapiens
cgcgcgtcccccgaagag

SEQ ID NO: 63399 - DNA, 21 bp, Homo sapiens
cgcacggggtcggcggcgacg

SEQ ID NO: 63400 - DNA, 37 bp, Homo sapiens
cgcacggggtcggcggcgacgtcggctacccacccga

SEQ ID NO: 63401 - DNA, 20 bp, Homo sapiens
gcacggggtcggcggcgacg

SEQ ID NO: 63402 - DNA, 16 bp, Homo sapiens
aggagtctaacacgtg

SEQ ID NO: 63403 - DNA, 17 bp, Homo sapiens
aggagtctaacacgtgc

SEQ ID NO: 63404 - DNA, 18 bp, Homo sapiens
aggagtctaacacgtgcg

SEQ ID NO: 63405 - DNA, 19 bp, Homo sapiens
aggagtctaacacgtgcgc

SEQ ID NO: 63406 - DNA, 20 bp, Homo sapiens
aggagtctaacacgtgcgcg

SEQ ID NO: 63407 - DNA, 21 bp, Homo sapiens
aggagtctaacacgtgcgcga

SEQ ID NO: 63408 - DNA, 16 bp, Homo sapiens
ggagtctaacacgtgc

SEQ ID NO: 63409 - DNA, 17 bp, Homo sapiens
ggagtctaacacgtgcg

SEQ ID NO: 63410 - DNA, 18 bp, Homo sapiens
ggagtctaacacgtgcgc

SEQ ID NO: 63411 - DNA, 19 bp, Homo sapiens
ggagtctaacacgtgcgcg

SEQ ID NO: 63412 - DNA, 16 bp, Homo sapiens
gagtctaacacgtgcg

SEQ ID NO: 63413 - DNA, 17 bp, Homo sapiens
gagtctaacacgtgcgc

SEQ ID NO: 63414 - DNA, 16 bp, Homo sapiens
agtctaacacgtgcgc

SEQ ID NO: 63415 - DNA, 28 bp, Homo sapiens
acgagcgcacgtgttaggacccgaaaga

SEQ ID NO: 63416 - DNA, 21 bp, Homo sapiens
agcgcacgtgttaggacccga

SEQ ID NO: 63417 - DNA, 20 bp, Homo sapiens
gcgcacgtgttaggacccga

SEQ ID NO: 63418 - DNA, 19 bp, Homo sapiens
cgcacgtgttaggacccga

SEQ ID NO: 63419 - DNA, 18 bp, Homo sapiens
gcacgtgttaggacccga

SEQ ID NO: 63420 - DNA, 30 bp, Homo sapiens
gggcgaagccagaggaaactctggtggagg

SEQ ID NO: 63421 - DNA, 29 bp, Homo sapiens
ggcgaagccagaggaaactctggtggagg

SEQ ID NO: 63422 - DNA, 18 bp, Homo sapiens
cgtccgacctgggtatag

SEQ ID NO: 63423 - DNA, 36 bp, Homo sapiens
agactaatcgaaccatctagtagctggttccctccg

SEQ ID NO: 63424 - DNA, 45 bp, Homo sapiens
cctccgaagtttccctcaggatagctggcgctctcgcagacccga

SEQ ID NO: 63425 - DNA, 42 bp, Homo sapiens
ccgaagtttccctcaggatagctggcgctctcgcagacccga

SEQ ID NO: 63426 - DNA, 34 bp, Homo sapiens
tccctcaggatagctggcgctctcgcagacccga

SEQ ID NO: 63427 - DNA, 31 bp, Homo sapiens; identical to SEQ ID NO: 4474

SEQ ID NO: 63428 - DNA, 33 bp, Homo sapiens; identical to SEQ ID NO: 4476

SEQ ID NO: 63429 - DNA, 32 bp, Homo sapiens; identical to SEQ ID NO: 20996

SEQ ID NO: 63430 - DNA, 31 bp, Homo sapiens; identical to SEQ ID NO: 4479

SEQ ID NO: 63431 - DNA, 30 bp, Homo sapiens; identical to SEQ ID NO: 21011

SEQ ID NO: 63432 - DNA, 28 bp, Homo sapiens
caggatagctggcgctctcgcagacccg

SEQ ID NO: 63433 - DNA, 29 bp, Homo sapiens
caggatagctggcgctctcgcagacccga

SEQ ID NO: 63434 - DNA, 28 bp, Homo sapiens
aggatagctggcgctctcgcagacccga

SEQ ID NO: 63435 - DNA, 25 bp, Homo sapiens
atagctggcgctctcgcagacccga

SEQ ID NO: 63436 - DNA, 23 bp, Homo sapiens
agctggcgctctcgcagacccga

SEQ ID NO: 63437 - DNA, 22 bp, Homo sapiens
gctggcgctctcgcagacccga

SEQ ID NO: 63438 - DNA, 21 bp, Homo sapiens
ctggcgctctcgcagacccga

SEQ ID NO: 63439 - DNA, 20 bp, Homo sapiens
tggcgctctcgcagacccga

SEQ ID NO: 63440 - DNA, 19 bp, Homo sapiens
ggcgctctcgcagacccga

SEQ ID NO: 63441 - DNA, 18 bp, Homo sapiens
gcgctctcgcagacccga

SEQ ID NO: 63442 - DNA, 32 bp, Homo sapiens; identical to SEQ ID NO: 62920

SEQ ID NO: 63443 - DNA, 45 bp, Homo sapiens; identical to SEQ ID NO: 62048

SEQ ID NO: 63444 - DNA, 46 bp, Homo sapiens; identical to SEQ ID NO: 62922

SEQ ID NO: 63445 - DNA, 31 bp, Homo sapiens; identical to SEQ ID NO: 62923

SEQ ID NO: 63446 - DNA, 44 bp, Homo sapiens; identical to SEQ ID NO: 62053

SEQ ID NO: 63447 - DNA, 43 bp, Homo sapiens; identical to SEQ ID NO: 57761

SEQ ID NO: 63448 - DNA, 16 bp, Homo sapiens
aggcgcccgatgccga

SEQ ID NO: 63449 - DNA, 19 bp, Homo sapiens
aggcgcccgatgccgacgc

SEQ ID NO: 63450 - DNA, 18 bp, Homo sapiens
cgaatcaactagccctga

SEQ ID NO: 63451 - DNA, 26 bp, Homo sapiens
cccccccacgcctcctcccctcctcc

SEQ ID NO: 63452 - DNA, 25 bp, Homo sapiens
ccccccacgcctcctcccctcctcc

SEQ ID NO: 63453 - DNA, 24 bp, Homo sapiens
cccccacgcctcctcccctcctcc

SEQ ID NO: 63454 - DNA, 23 bp, Homo sapiens
ccccacgcctcctcccctcctcc

SEQ ID NO: 63455 - DNA, 22 bp, Homo sapiens
cccacgcctcctcccctcctcc

SEQ ID NO: 63456 - DNA, 20 bp, Homo sapiens
cacgcctcctcccctcctcc

SEQ ID NO: 63457 - DNA, 25 bp, Homo sapiens
cgcccacgccccgctccccgccccc

SEQ ID NO: 63458 - DNA, 17 bp, Homo sapiens
gagaactttgaaggccg

SEQ ID NO: 63459 - DNA, 16 bp, Homo sapiens
agaactttgaaggccg

SEQ ID NO: 63460 - DNA, 17 bp, Homo sapiens
agaactttgaaggccga

SEQ ID NO: 63461 - DNA, 23 bp, Homo sapiens
agcgccgttccgaagggacgggc

SEQ ID NO: 63462 - DNA, 43 bp, Homo sapiens; identical to SEQ ID NO: 62928

SEQ ID NO: 63463 - DNA, 20 bp, Homo sapiens
gccgatcgaaagggagtcgg

SEQ ID NO: 63464 - DNA, 21 bp, Homo sapiens
gccgatcgaaagggagtcggg

SEQ ID NO: 63465 - DNA, 22 bp, Homo sapiens
gccgatcgaaagggagtcgggt

SEQ ID NO: 63466 - DNA, 18 bp, Homo sapiens
agaagccggcgggagccc

SEQ ID NO: 63467 - DNA, 20 bp, Homo sapiens
agaagccggcgggagccccg

SEQ ID NO: 63468 - DNA, 20 bp, Homo sapiens
gaagccggcgggagccccgg

SEQ ID NO: 63469 - DNA, 20 bp, Homo sapiens
catatccgcagcaggtctcc

SEQ ID NO: 63470 - DNA, 21 bp, Homo sapiens
catatccgcagcaggtctcca

SEQ ID NO: 63471 - DNA, 16 bp, Homo sapiens
atgtaggtaagggaag

SEQ ID NO: 63472 - DNA, 24 bp, Homo sapiens
ccccccacgcccggggcacccccc

SEQ ID NO: 63473 - DNA, 22 bp, Homo sapiens
ccccgcgcgcgccgctcgctcc

SEQ ID NO: 63474 - DNA, 20 bp, Homo sapiens
cccgcgcgcgccgctcgctc

SEQ ID NO: 63475 - DNA, 21 bp, Homo sapiens
cccgcgcgcgccgctcgctcc

SEQ ID NO: 63476 - DNA, 32 bp, Homo sapiens
cgcgccgctcgctccctccccgccccgcgccc

SEQ ID NO: 63477 - DNA, 19 bp, Homo sapiens
cctctctctctctctctcc

SEQ ID NO: 63478 - DNA, 17 bp, Homo sapiens
tctctctctctctctcc

SEQ ID NO: 63479 - DNA, 43 bp, Homo sapiens
cccgctccccgtcctcccccctccccgggggagcgccgcgtgg

SEQ ID NO: 63480 - DNA, 19 bp, Homo sapiens
cccgcgaggggggcccggg

SEQ ID NO: 63481 - DNA, 18 bp, Homo sapiens
ccgcgaggggggcccggg

SEQ ID NO: 63482 - DNA, 17 bp, Homo sapiens
cgcgaggggggcccggg

SEQ ID NO: 63483 - DNA, 27 bp, Homo sapiens
cggcggcggcggcgactctggacgcga

SEQ ID NO: 63484 - DNA, 28 bp, Homo sapiens
cggcggcggcggcgactctggacgcgag

SEQ ID NO: 63485 - DNA, 26 bp, Homo sapiens
ggcggcggcggcgactctggacgcga

SEQ ID NO: 63486 - DNA, 28 bp, Homo sapiens
gcggcgactctggacgcgagccgggccc

SEQ ID NO: 63487 - DNA, 29 bp, Homo sapiens
gcggcgactctggacgcgagccgggccct

SEQ ID NO: 63488 - DNA, 45 bp, Homo sapiens
gcggcgactctggacgcgagccgggcccttcccgtggatcgcccc

SEQ ID NO: 63489 - DNA, 27 bp, Homo sapiens
cggcgactctggacgcgagccgggccc

SEQ ID NO: 63490 - DNA, 26 bp, Homo sapiens
ggcgactctggacgcgagccgggccc

SEQ ID NO: 63491 - DNA, 18 bp, Homo sapiens
cccgtggatcgccccagc

SEQ ID NO: 63492 - DNA, 19 bp, Homo sapiens
cccgtggatcgccccagct

SEQ ID NO: 63493 - DNA, 17 bp, Homo sapiens
ccgtggatcgccccagc

SEQ ID NO: 63494 - DNA, 16 bp, Homo sapiens
cgtggatcgccccagc

SEQ ID NO: 63495 - DNA, 23 bp, Homo sapiens
cccaccccacgtctcgtcgcgcg

SEQ ID NO: 63496 - DNA, 22 bp, Homo sapiens
ccaccccacgtctcgtcgcgcg

SEQ ID NO: 63497 - DNA, 20 bp, Homo sapiens
accccacgtctcgtcgcgcg

SEQ ID NO: 63498 - DNA, 18 bp, Homo sapiens
cgcgtccgctgggggcgg

SEQ ID NO: 63499 - DNA, 18 bp, Homo sapiens
ggagcggtcgggcggcgg

SEQ ID NO: 63500 - DNA, 21 bp, Homo sapiens
gatgtgatttctgcccagtgc

SEQ ID NO: 63501 - DNA, 38 bp, Homo sapiens
cgcatgaatggatgaacgagattcccactgtccctacc

SEQ ID NO: 63502 - DNA, 37 bp, Homo sapiens
agaccctgttgagcttgactctagtctggcacggtga

SEQ ID NO: 63503 - DNA, 44 bp, Homo sapiens
agaccctgttgagcttgactctagtctggcacggtgaagagaca

SEQ ID NO: 63504 - DNA, 35 bp, Homo sapiens
gaccctgttgagcttgactctagtctggcacggtg

SEQ ID NO: 63505 - DNA, 36 bp, Homo sapiens
gaccctgttgagcttgactctagtctggcacggtga

SEQ ID NO: 63506 - DNA, 35 bp, Homo sapiens
accctgttgagcttgactctagtctggcacggtga

SEQ ID NO: 63507 - DNA, 33 bp, Homo sapiens
ccctgttgagcttgactctagtctggcacggtg

SEQ ID NO: 63508 - DNA, 22 bp, Homo sapiens
cccggcgcccccccggtgtccc

SEQ ID NO: 63509 - DNA, 27 bp, Homo sapiens
gcgggccgccggtgaaataccactact

SEQ ID NO: 63510 - DNA, 26 bp, Homo sapiens
cgggccgccggtgaaataccactact

SEQ ID NO: 63511 - DNA, 25 bp, Homo sapiens
gggccgccggtgaaataccactact

SEQ ID NO: 63512 - DNA, 29 bp, Homo sapiens
gggccgccggtgaaataccactactctga

SEQ ID NO: 63513 - DNA, 30 bp, Homo sapiens; identical to SEQ ID NO: 5852

SEQ ID NO: 63514 - DNA, 31 bp, Homo sapiens; identical to SEQ ID NO: 26227

SEQ ID NO: 63515 - DNA, 24 bp, Homo sapiens
ggccgccggtgaaataccactact

SEQ ID NO: 63516 - DNA, 30 bp, Homo sapiens; identical to SEQ ID NO: 5857

SEQ ID NO: 63517 - DNA, 23 bp, Homo sapiens
gccgccggtgaaataccactact

SEQ ID NO: 63518 - DNA, 46 bp, Homo sapiens; identical to SEQ ID NO: 61161

SEQ ID NO: 63519 - DNA, 28 bp, Homo sapiens
ctcgcttctggcgccaagcgcccggccg

SEQ ID NO: 63520 - DNA, 26 bp, Homo sapiens
cgcttctggcgccaagcgcccggccg

SEQ ID NO: 63521 - DNA, 24 bp, Homo sapiens
cgcgacccgctccggggacagtgc

SEQ ID NO: 63522 - DNA, 37 bp, Homo sapiens
cgcgacccgctccggggacagtgccaggtggggagtt

SEQ ID NO: 63523 - DNA, 39 bp, Homo sapiens
cgcgacccgctccggggacagtgccaggtggggagtttg

SEQ ID NO: 63524 - DNA, 41 bp, Homo sapiens
cgcgacccgctccggggacagtgccaggtggggagtttgac

SEQ ID NO: 63525 - DNA, 42 bp, Homo sapiens
cgcgacccgctccggggacagtgccaggtggggagtttgact

SEQ ID NO: 63526 - DNA, 33 bp, Homo sapiens
aggtggggagtttgactggggcggtacacctgt

SEQ ID NO: 63527 - DNA, 19 bp, Homo sapiens
aggtgtcagaaaagttacc

SEQ ID NO: 63528 - DNA, 21 bp, Homo sapiens
acagggataactggcttgtgg

SEQ ID NO: 63529 - DNA, 31 bp, Homo sapiens
cctatcattgtgaagcagaattcaccaagcg

SEQ ID NO: 63530 - DNA, 23 bp, Homo sapiens
aagcgttggattgttcacccact

SEQ ID NO: 63531 - DNA, 26 bp, Homo sapiens
cgaagctaccatctgtgggattatga

SEQ ID NO: 63532 - DNA, 25 bp, Homo sapiens
gaagctaccatctgtgggattatga

SEQ ID NO: 63533 - DNA, 16 bp, Homo sapiens
gtgggattatgactga

SEQ ID NO: 63534 - DNA, 17 bp, Homo sapiens
gtgggattatgactgaa

SEQ ID NO: 63535 - DNA, 25 bp, Homo sapiens
gattatgactgaacgcctctaagtc

SEQ ID NO: 63536 - DNA, 35 bp, Homo sapiens; identical to SEQ ID NO: 62646

SEQ ID NO: 63537 - DNA, 44 bp, Homo sapiens
ggcagcgccgcggagcctcggttggcctcggatagccggtcccc

SEQ ID NO: 63538 - DNA, 32 bp, Homo sapiens; identical to SEQ ID NO: 27767

SEQ ID NO: 63539 - DNA, 34 bp, Homo sapiens; identical to SEQ ID NO: 62647

SEQ ID NO: 63540 - DNA, 40 bp, Homo sapiens; identical to SEQ ID NO: 27768

SEQ ID NO: 63541 - DNA, 41 bp, Homo sapiens; identical to SEQ ID NO: 58141

SEQ ID NO: 63542 - DNA, 42 bp, Homo sapiens; identical to SEQ ID NO: 58142

SEQ ID NO: 63543 - DNA, 43 bp, Homo sapiens; identical to SEQ ID NO: 61281

SEQ ID NO: 63544 - DNA, 44 bp, Homo sapiens; identical to SEQ ID NO: 58143

SEQ ID NO: 63545 - DNA, 46 bp, Homo sapiens; identical to SEQ ID NO: 58144

SEQ ID NO: 63546 - DNA, 33 bp, Homo sapiens
cagcgccgcggagcctcggttggcctcggatag

SEQ ID NO: 63547 - DNA, 42 bp, Homo sapiens; identical to SEQ ID NO: 58149

SEQ ID NO: 63548 - DNA, 43 bp, Homo sapiens; identical to SEQ ID NO: 58150

SEQ ID NO: 63549 - DNA, 30 bp, Homo sapiens; identical to SEQ ID NO: 27776

SEQ ID NO: 63550 - DNA, 41 bp, Homo sapiens; identical to SEQ ID NO: 62974

SEQ ID NO: 63551 - DNA, 42 bp, Homo sapiens; identical to SEQ ID NO: 58154

SEQ ID NO: 63552 - DNA, 22 bp, Homo sapiens
ggagcctcggttggcctcggat

SEQ ID NO: 63553 - DNA, 32 bp, Homo sapiens; identical to SEQ ID NO: 6335

SEQ ID NO: 63554 - DNA, 33 bp, Homo sapiens; identical to SEQ ID NO: 62658

SEQ ID NO: 63555 - DNA, 34 bp, Homo sapiens; identical to SEQ ID NO: 62659

SEQ ID NO: 63556 - DNA, 35 bp, Homo sapiens; identical to SEQ ID NO: 58157

SEQ ID NO: 63557 - DNA, 36 bp, Homo sapiens; identical to SEQ ID NO: 58158

SEQ ID NO: 63558 - DNA, 37 bp, Homo sapiens; identical to SEQ ID NO: 58159

SEQ ID NO: 63559 - DNA, 31 bp, Homo sapiens; identical to SEQ ID NO: 27824

SEQ ID NO: 63560 - DNA, 32 bp, Homo sapiens; identical to SEQ ID NO: 58162

SEQ ID NO: 63561 - DNA, 33 bp, Homo sapiens; identical to SEQ ID NO: 58163

SEQ ID NO: 63562 - DNA, 34 bp, Homo sapiens; identical to SEQ ID NO: 27825

SEQ ID NO: 63563 - DNA, 35 bp, Homo sapiens; identical to SEQ ID NO: 58165

SEQ ID NO: 63564 - DNA, 36 bp, Homo sapiens; identical to SEQ ID NO: 58166

SEQ ID NO: 63565 - DNA, 30 bp, Homo sapiens; identical to SEQ ID NO: 27830

SEQ ID NO: 63566 - DNA, 31 bp, Homo sapiens; identical to SEQ ID NO: 58168

SEQ ID NO: 63567 - DNA, 32 bp, Homo sapiens; identical to SEQ ID NO: 58169

SEQ ID NO: 63568 - DNA, 33 bp, Homo sapiens; identical to SEQ ID NO: 6337

SEQ ID NO: 63569 - DNA, 34 bp, Homo sapiens; identical to SEQ ID NO: 58171

SEQ ID NO: 63570 - DNA, 35 bp, Homo sapiens; identical to SEQ ID NO: 58172

SEQ ID NO: 63571 - DNA, 38 bp, Homo sapiens; identical to SEQ ID NO: 62995

SEQ ID NO: 63572 - DNA, 22 bp, Homo sapiens
cccgtcacgcaccgcacgttcg

SEQ ID NO: 63573 - DNA, 29 bp, Homo sapiens
cgctaaaccattcgtagacgacctgcttc

SEQ ID NO: 63574 - DNA, 28 bp, Homo sapiens
gctaaaccattcgtagacgacctgcttc

SEQ ID NO: 63575 - DNA, 44 bp, Homo sapiens
gggtttcgtacgtagcagagcagctccctcgctgcgatctattg

SEQ ID NO: 63576 - DNA, 42 bp, Homo sapiens
agctccctcgctgcgatctattgaaagtcagccctcgacaca

SEQ ID NO: 63577 - DNA, 41 bp, Homo sapiens
gctccctcgctgcgatctattgaaagtcagccctcgacaca

SEQ ID NO: 63578 - DNA, 40 bp, Homo sapiens
ctccctcgctgcgatctattgaaagtcagccctcgacaca

SEQ ID NO: 63579 - DNA, 39 bp, Homo sapiens
tccctcgctgcgatctattgaaagtcagccctcgacaca

SEQ ID NO: 63580 - DNA, 38 bp, Homo sapiens; identical to SEQ ID NO: 61401

SEQ ID NO: 63581 - DNA, 39 bp, Homo sapiens
ccctcgctgcgatctattgaaagtcagccctcgacacaa

SEQ ID NO: 63582 - DNA, 46 bp, Homo sapiens
ccctcgctgcgatctattgaaagtcagccctcgacacaagggtttg

SEQ ID NO: 63583 - DNA, 37 bp, Homo sapiens; identical to SEQ ID NO: 62687

SEQ ID NO: 63584 - DNA, 38 bp, Homo sapiens
cctcgctgcgatctattgaaagtcagccctcgacacaa

SEQ ID NO: 63585 - DNA, 46 bp, Homo sapiens; identical to SEQ ID NO: 28404

SEQ ID NO: 63586 - DNA, 36 bp, Homo sapiens; identical to SEQ ID NO: 28409

SEQ ID NO: 63587 - DNA, 37 bp, Homo sapiens; identical to SEQ ID NO: 62691

SEQ ID NO: 63588 - DNA, 38 bp, Homo sapiens; identical to SEQ ID NO: 63009

SEQ ID NO: 63589 - DNA, 44 bp, Homo sapiens; identical to SEQ ID NO: 28412

SEQ ID NO: 63590 - DNA, 45 bp, Homo sapiens; identical to SEQ ID NO: 28413

SEQ ID NO: 63591 - DNA, 35 bp, Homo sapiens; identical to SEQ ID NO: 58227

SEQ ID NO: 63592 - DNA, 36 bp, Homo sapiens; identical to SEQ ID NO: 63013

SEQ ID NO: 63593 - DNA, 43 bp, Homo sapiens; identical to SEQ ID NO: 28424

SEQ ID NO: 63594 - DNA, 44 bp, Homo sapiens; identical to SEQ ID NO: 28425

SEQ ID NO: 63595 - DNA, 34 bp, Homo sapiens; identical to SEQ ID NO: 58230

SEQ ID NO: 63596 - DNA, 35 bp, Homo sapiens; identical to SEQ ID NO: 61411

SEQ ID NO: 63597 - DNA, 43 bp, Homo sapiens; identical to SEQ ID NO: 28437

SEQ ID NO: 63598 - DNA, 33 bp, Homo sapiens; identical to SEQ ID NO: 58233

SEQ ID NO: 63599 - DNA, 34 bp, Homo sapiens; identical to SEQ ID NO: 63021

SEQ ID NO: 63600 - DNA, 41 bp, Homo sapiens; identical to SEQ ID NO: 28443

SEQ ID NO: 63601 - DNA, 42 bp, Homo sapiens; identical to SEQ ID NO: 28444

SEQ ID NO: 63602 - DNA, 31 bp, Homo sapiens
tgcgatctattgaaagtcagccctcgacaca

SEQ ID NO: 63603 - DNA, 30 bp, Homo sapiens
gcgatctattgaaagtcagccctcgacaca

SEQ ID NO: 63604 - DNA, 29 bp, Homo sapiens
cgatctattgaaagtcagccctcgacaca

SEQ ID NO: 63605 - DNA, 29 bp, Homo sapiens
gaaagtcagccctcgacacaagggtttgt

SEQ ID NO: 63606 - DNA, 19 bp, Homo sapiens
cctcgacacaagggtttgt

SEQ ID NO: 63607 - DNA, 18 bp, Homo sapiens
ctcgacacaagggtttgt

SEQ ID NO: 63608 - DNA, 17 bp, Homo sapiens
tcgacacaagggtttgt

SEQ ID NO: 63609 - DNA, 16 bp, Homo sapiens
cgacacaagggtttgt

SEQ ID NO: 63610 - DNA, 17 bp, Homo sapiens
tctctctctctctctcc

SEQ ID NO: 63611 - DNA, 17 bp, Homo sapiens
tctctctctctctctcc

SEQ ID NO: 63612 - DNA, 17 bp, Homo sapiens
tctctctctctctctcc

SEQ ID NO: 63613 - DNA, 17 bp, Homo sapiens
tctctctctctctctcc

SEQ ID NO: 63614 - DNA, 17 bp, Homo sapiens
tctctctctctctctcc

SEQ ID NO: 63615 - DNA, 25 bp, Homo sapiens
gtctacggccataccaccctgaacg

SEQ ID NO: 63616 - DNA, 23 bp, Homo sapiens
gtctacggccataccaccctgaa

SEQ ID NO: 63617 - DNA, 37 bp, Homo sapiens; identical to SEQ ID NO: 6545

SEQ ID NO: 63618 - DNA, 38 bp, Homo sapiens; identical to SEQ ID NO: 6546

SEQ ID NO: 63619 - DNA, 32 bp, Homo sapiens; identical to SEQ ID NO: 10

SEQ ID NO: 63620 - DNA, 33 bp, Homo sapiens; identical to SEQ ID NO: 11

SEQ ID NO: 63621 - DNA, 34 bp, Homo sapiens; identical to SEQ ID NO: 6542

SEQ ID NO: 63622 - DNA, 35 bp, Homo sapiens; identical to SEQ ID NO: 6543

SEQ ID NO: 63623 - DNA, 39 bp, Homo sapiens; identical to SEQ ID NO: 6547

SEQ ID NO: 63624 - DNA, 42 bp, Homo sapiens
ccctgaacgcgcccgatctcgtctgatctcggaagctaagca

SEQ ID NO: 63625 - DNA, 41 bp, Homo sapiens
cctgaacgcgcccgatctcgtctgatctcggaagctaagca

SEQ ID NO: 63626 - DNA, 40 bp, Homo sapiens; identical to SEQ ID NO: 61465

SEQ ID NO: 63627 - DNA, 40 bp, Homo sapiens
gaacgcgcccgatctcgtctgatctcggaagctaagcagg

SEQ ID NO: 63628 - DNA, 16 bp, Homo sapiens
tggatgggagaccgcc

SEQ ID NO: 63629 - DNA, 18 bp, Homo sapiens
ataggtttggtcctagcc

SEQ ID NO: 63630 - DNA, 41 bp, Homo sapiens
agcatccccgttccagtgagttcaccctctaaatcaccacg

SEQ ID NO: 63631 - DNA, 26 bp, Homo sapiens
agcatccccgttccagtgagttcacc

SEQ ID NO: 63632 - DNA, 34 bp, Homo sapiens
tccccgttccagtgagttcaccctctaaatcacc

SEQ ID NO: 63633 - DNA, 35 bp, Homo sapiens
tccccgttccagtgagttcaccctctaaatcacca

SEQ ID NO: 63634 - DNA, 37 bp, Homo sapiens
tccccgttccagtgagttcaccctctaaatcaccacg

SEQ ID NO: 63635 - DNA, 20 bp, Homo sapiens
ccgttccagtgagttcaccc

SEQ ID NO: 63636 - DNA, 33 bp, Homo sapiens
cgttccagtgagttcaccctctaaatcaccacg

SEQ ID NO: 63637 - DNA, 32 bp, Homo sapiens
gttccagtgagttcaccctctaaatcaccacg

SEQ ID NO: 63638 - DNA, 18 bp, Homo sapiens
gttccagtgagttcaccc

SEQ ID NO: 63639 - DNA, 25 bp, Homo sapiens
cagtgagttcaccctctaaatcacc

SEQ ID NO: 63640 - DNA, 28 bp, Homo sapiens
cagtgagttcaccctctaaatcaccacg

SEQ ID NO: 63641 - DNA, 24 bp, Homo sapiens
agtgagttcaccctctaaatcacc

SEQ ID NO: 63642 - DNA, 18 bp, Homo sapiens
agcatcaagcacgcagca

SEQ ID NO: 63643 - DNA, 33 bp, Homo sapiens
agcatcaagcacgcagcaatgcagctcaaaacg

SEQ ID NO: 63644 - DNA, 40 bp, Homo sapiens
agcatcaagcacgcagcaatgcagctcaaaacgcttagcc

SEQ ID NO: 63645 - DNA, 45 bp, Homo sapiens
agcatcaagcacgcagcaatgcagctcaaaacgcttagcctagcc

SEQ ID NO: 63646 - DNA, 39 bp, Homo sapiens
aagcacgcagcaatgcagctcaaaacgcttagcctagcc

SEQ ID NO: 63647 - DNA, 41 bp, Homo sapiens
agcacgcagcaatgcagctcaaaacgcttagcctagccaca

SEQ ID NO: 63648 - DNA, 46 bp, Homo sapiens
agcacgcagcaatgcagctcaaaacgcttagcctagccacaccccc

SEQ ID NO: 63649 - DNA, 45 bp, Homo sapiens
agcacgcagcaatgcagctcaaaacgcttagcctagccacacccc

SEQ ID NO: 63650 - DNA, 44 bp, Homo sapiens; identical to SEQ ID NO: 7149

SEQ ID NO: 63651 - DNA, 38 bp, Homo sapiens
agcacgcagcaatgcagctcaaaacgcttagcctagcc

SEQ ID NO: 63652 - DNA, 43 bp, Homo sapiens
agcacgcagcaatgcagctcaaaacgcttagcctagccacacc

SEQ ID NO: 63653 - DNA, 21 bp, Homo sapiens
agcacgcagcaatgcagctca

SEQ ID NO: 63654 - DNA, 33 bp, Homo sapiens; identical to SEQ ID NO: 217

SEQ ID NO: 63655 - DNA, 33 bp, Homo sapiens; identical to SEQ ID NO: 218

SEQ ID NO: 63656 - DNA, 34 bp, Homo sapiens
gcacgcagcaatgcagctcaaaacgcttagccta

SEQ ID NO: 63657 - DNA, 38 bp, Homo sapiens
gcacgcagcaatgcagctcaaaacgcttagcctagcca

SEQ ID NO: 63658 - DNA, 40 bp, Homo sapiens
gcacgcagcaatgcagctcaaaacgcttagcctagccaca

SEQ ID NO: 63659 - DNA, 44 bp, Homo sapiens
gcacgcagcaatgcagctcaaaacgcttagcctagccacacccc

SEQ ID NO: 63660 - DNA, 45 bp, Homo sapiens
gcacgcagcaatgcagctcaaaacgcttagcctagccacaccccc

SEQ ID NO: 63661 - DNA, 46 bp, Homo sapiens
gcacgcagcaatgcagctcaaaacgcttagcctagccacaccccca

SEQ ID NO: 63662 - DNA, 43 bp, Homo sapiens
gcacgcagcaatgcagctcaaaacgcttagcctagccacaccc

SEQ ID NO: 63663 - DNA, 42 bp, Homo sapiens
gcacgcagcaatgcagctcaaaacgcttagcctagccacacc

SEQ ID NO: 63664 - DNA, 32 bp, Homo sapiens; identical to SEQ ID NO: 7150

SEQ ID NO: 63665 - DNA, 20 bp, Homo sapiens
gcacgcagcaatgcagctca

SEQ ID NO: 63666 - DNA, 37 bp, Homo sapiens
gcacgcagcaatgcagctcaaaacgcttagcctagcc

SEQ ID NO: 63667 - DNA, 37 bp, Homo sapiens
cgcagcaatgcagctcaaaacgcttagcctagccaca

SEQ ID NO: 63668 - DNA, 39 bp, Homo sapiens
cgcagcaatgcagctcaaaacgcttagcctagccacacc

SEQ ID NO: 63669 - DNA, 41 bp, Homo sapiens
cgcagcaatgcagctcaaaacgcttagcctagccacacccc

SEQ ID NO: 63670 - DNA, 34 bp, Homo sapiens
cgcagcaatgcagctcaaaacgcttagcctagcc

SEQ ID NO: 63671 - DNA, 40 bp, Homo sapiens
gcagcaatgcagctcaaaacgcttagcctagccacacccc

SEQ ID NO: 63672 - DNA, 35 bp, Homo sapiens
cagcaatgcagctcaaaacgcttagcctagccaca

SEQ ID NO: 63673 - DNA, 38 bp, Homo sapiens
cagcaatgcagctcaaaacgcttagcctagccacaccc

SEQ ID NO: 63674 - DNA, 32 bp, Homo sapiens
cagcaatgcagctcaaaacgcttagcctagcc

SEQ ID NO: 63675 - DNA, 22 bp, Homo sapiens
atgcagctcaaaacgcttagcc

SEQ ID NO: 63676 - DNA, 27 bp, Homo sapiens
atgcagctcaaaacgcttagcctagcc

SEQ ID NO: 63677 - DNA, 28 bp, Homo sapiens
atgcagctcaaaacgcttagcctagcca

SEQ ID NO: 63678 - DNA, 33 bp, Homo sapiens
atgcagctcaaaacgcttagcctagccacaccc

SEQ ID NO: 63679 - DNA, 34 bp, Homo sapiens
atgcagctcaaaacgcttagcctagccacacccc

SEQ ID NO: 63680 - DNA, 35 bp, Homo sapiens
atgcagctcaaaacgcttagcctagccacaccccc

SEQ ID NO: 63681 - DNA, 21 bp, Homo sapiens
tgcagctcaaaacgcttagcc

SEQ ID NO: 63682 - DNA, 26 bp, Homo sapiens
tgcagctcaaaacgcttagcctagcc

SEQ ID NO: 63683 - DNA, 27 bp, Homo sapiens
tgcagctcaaaacgcttagcctagcca

SEQ ID NO: 63684 - DNA, 31 bp, Homo sapiens
tgcagctcaaaacgcttagcctagccacacc

SEQ ID NO: 63685 - DNA, 32 bp, Homo sapiens
tgcagctcaaaacgcttagcctagccacaccc

SEQ ID NO: 63686 - DNA, 33 bp, Homo sapiens
tgcagctcaaaacgcttagcctagccacacccc

SEQ ID NO: 63687 - DNA, 34 bp, Homo sapiens
tgcagctcaaaacgcttagcctagccacaccccc

SEQ ID NO: 63688 - DNA, 20 bp, Homo sapiens
gcagctcaaaacgcttagcc

SEQ ID NO: 63689 - DNA, 21 bp, Homo sapiens
gcagctcaaaacgcttagcct

SEQ ID NO: 63690 - DNA, 26 bp, Homo sapiens
gcagctcaaaacgcttagcctagcca

SEQ ID NO: 63691 - DNA, 28 bp, Homo sapiens
gcagctcaaaacgcttagcctagccaca

SEQ ID NO: 63692 - DNA, 32 bp, Homo sapiens
gcagctcaaaacgcttagcctagccacacccc

SEQ ID NO: 63693 - DNA, 33 bp, Homo sapiens
gcagctcaaaacgcttagcctagccacaccccc

SEQ ID NO: 63694 - DNA, 34 bp, Homo sapiens
gcagctcaaaacgcttagcctagccacaccccca

SEQ ID NO: 63695 - DNA, 25 bp, Homo sapiens
gcagctcaaaacgcttagcctagcc

SEQ ID NO: 63696 - DNA, 30 bp, Homo sapiens
gcagctcaaaacgcttagcctagccacacc

SEQ ID NO: 63697 - DNA, 31 bp, Homo sapiens
gcagctcaaaacgcttagcctagccacaccc

SEQ ID NO: 63698 - DNA, 19 bp, Homo sapiens
cagctcaaaacgcttagcc

SEQ ID NO: 63699 - DNA, 25 bp, Homo sapiens
cagctcaaaacgcttagcctagcca

SEQ ID NO: 63700 - DNA, 29 bp, Homo sapiens
cagctcaaaacgcttagcctagccacacc

SEQ ID NO: 63701 - DNA, 30 bp, Homo sapiens; identical to SEQ ID NO: 7157

SEQ ID NO: 63702 - DNA, 32 bp, Homo sapiens; identical to SEQ ID NO: 7159

SEQ ID NO: 63703 - DNA, 33 bp, Homo sapiens
cagctcaaaacgcttagcctagccacaccccca

SEQ ID NO: 63704 - DNA, 24 bp, Homo sapiens
cagctcaaaacgcttagcctagcc

SEQ ID NO: 63705 - DNA, 31 bp, Homo sapiens; identical to SEQ ID NO: 7158

SEQ ID NO: 63706 - DNA, 23 bp, Homo sapiens
agctcaaaacgcttagcctagcc

SEQ ID NO: 63707 - DNA, 28 bp, Homo sapiens
agctcaaaacgcttagcctagccacacc

SEQ ID NO: 63708 - DNA, 31 bp, Homo sapiens
agctcaaaacgcttagcctagccacaccccc

SEQ ID NO: 63709 - DNA, 29 bp, Homo sapiens
agctcaaaacgcttagcctagccacaccc

SEQ ID NO: 63710 - DNA, 30 bp, Homo sapiens; identical to SEQ ID NO: 7161

SEQ ID NO: 63711 - DNA, 17 bp, Homo sapiens
gctcaaaacgcttagcc

SEQ ID NO: 63712 - DNA, 18 bp, Homo sapiens
gctcaaaacgcttagcct

SEQ ID NO: 63713 - DNA, 22 bp, Homo sapiens
gctcaaaacgcttagcctagcc

SEQ ID NO: 63714 - DNA, 27 bp, Homo sapiens
gctcaaaacgcttagcctagccacacc

SEQ ID NO: 63715 - DNA, 30 bp, Homo sapiens; identical to SEQ ID NO: 222

SEQ ID NO: 63716 - DNA, 28 bp, Homo sapiens
gctcaaaacgcttagcctagccacaccc

SEQ ID NO: 63717 - DNA, 29 bp, Homo sapiens
gctcaaaacgcttagcctagccacacccc

SEQ ID NO: 63718 - DNA, 17 bp, Homo sapiens
aaacgcttagcctagcc

SEQ ID NO: 63719 - DNA, 23 bp, Homo sapiens
aaacgcttagcctagccacaccc

SEQ ID NO: 63720 - DNA, 16 bp, Homo sapiens
aacgcttagcctagcc

SEQ ID NO: 63721 - DNA, 19 bp, Homo sapiens
aacgcttagcctagccaca

SEQ ID NO: 63722 - DNA, 23 bp, Homo sapiens
aacgcttagcctagccacacccc

SEQ ID NO: 63723 - DNA, 22 bp, Homo sapiens
aacgcttagcctagccacaccc

SEQ ID NO: 63724 - DNA, 17 bp, Homo sapiens
cttagcctagccacacc

SEQ ID NO: 63725 - DNA, 18 bp, Homo sapiens
cttagcctagccacaccc

SEQ ID NO: 63726 - DNA, 19 bp, Homo sapiens
cttagcctagccacacccc

SEQ ID NO: 63727 - DNA, 23 bp, Homo sapiens
tagccacacccccacgggaaaca

SEQ ID NO: 63728 - DNA, 26 bp, Homo sapiens
tagccacacccccacgggaaacagca

SEQ ID NO: 63729 - DNA, 29 bp, Homo sapiens
tagccacacccccacgggaaacagcagtg

SEQ ID NO: 63730 - DNA, 36 bp, Homo sapiens
tagccacacccccacgggaaacagcagtgattaacc

SEQ ID NO: 63731 - DNA, 42 bp, Homo sapiens
agccacacccccacgggaaacagcagtgattaacctttagca

SEQ ID NO: 63732 - DNA, 25 bp, Homo sapiens
agccacacccccacgggaaacagca

SEQ ID NO: 63733 - DNA, 28 bp, Homo sapiens
agccacacccccacgggaaacagcagtg

SEQ ID NO: 63734 - DNA, 21 bp, Homo sapiens
acacccccacgggaaacagca

SEQ ID NO: 63735 - DNA, 24 bp, Homo sapiens
acacccccacgggaaacagcagtg

SEQ ID NO: 63736 - DNA, 18 bp, Homo sapiens
acacccccacgggaaaca

SEQ ID NO: 63737 - DNA, 38 bp, Homo sapiens
acacccccacgggaaacagcagtgattaacctttagca

SEQ ID NO: 63738 - DNA, 36 bp, Homo sapiens
acccccacgggaaacagcagtgattaacctttagca

SEQ ID NO: 63739 - DNA, 18 bp, Homo sapiens
cccccacgggaaacagca

SEQ ID NO: 63740 - DNA, 35 bp, Homo sapiens
cccccacgggaaacagcagtgattaacctttagca

SEQ ID NO: 63741 - DNA, 34 bp, Homo sapiens
ccccacgggaaacagcagtgattaacctttagca

SEQ ID NO: 63742 - DNA, 20 bp, Homo sapiens
cccacgggaaacagcagtga

SEQ ID NO: 63743 - DNA, 19 bp, Homo sapiens
cccacgggaaacagcagtg

SEQ ID NO: 63744 - DNA, 36 bp, Homo sapiens
cccacgggaaacagcagtgattaacctttagcaata

SEQ ID NO: 63745 - DNA, 16 bp, Homo sapiens
cccacgggaaacagca

SEQ ID NO: 63746 - DNA, 33 bp, Homo sapiens
cccacgggaaacagcagtgattaacctttagca

SEQ ID NO: 63747 - DNA, 18 bp, Homo sapiens
ccacgggaaacagcagtg

SEQ ID NO: 63748 - DNA, 32 bp, Homo sapiens
ccacgggaaacagcagtgattaacctttagca

SEQ ID NO: 63749 - DNA, 31 bp, Homo sapiens
cacgggaaacagcagtgattaacctttagca

SEQ ID NO: 63750 - DNA, 33 bp, Homo sapiens
acgggaaacagcagtgattaacctttagcaata

SEQ ID NO: 63751 - DNA, 30 bp, Homo sapiens
acgggaaacagcagtgattaacctttagca

SEQ ID NO: 63752 - DNA, 27 bp, Homo sapiens
ggaaacagcagtgattaacctttagca

SEQ ID NO: 63753 - DNA, 20 bp, Homo sapiens
gcagtgattaacctttagca

SEQ ID NO: 63754 - DNA, 23 bp, Homo sapiens
gcagtgattaacctttagcaata

SEQ ID NO: 63755 - DNA, 42 bp, Homo sapiens
acctttagcaataaacgaaagtttaactaagctatactaacc

SEQ ID NO: 63756 - DNA, 44 bp, Homo sapiens
acctttagcaataaacgaaagtttaactaagctatactaacccc

SEQ ID NO: 63757 - DNA, 43 bp, Homo sapiens
acctttagcaataaacgaaagtttaactaagctatactaaccc

SEQ ID NO: 63758 - DNA, 45 bp, Homo sapiens
acctttagcaataaacgaaagtttaactaagctatactaacccca

SEQ ID NO: 63759 - DNA, 35 bp, Homo sapiens
taaccccagggttggtcaatttcgtgccagccacc

SEQ ID NO: 63760 - DNA, 38 bp, Homo sapiens
taaccccagggttggtcaatttcgtgccagccaccgcg

SEQ ID NO: 63761 - DNA, 36 bp, Homo sapiens
aaccccagggttggtcaatttcgtgccagccaccgc

SEQ ID NO: 63762 - DNA, 40 bp, Homo sapiens
aaccccagggttggtcaatttcgtgccagccaccgcggtc

SEQ ID NO: 63763 - DNA, 43 bp, Homo sapiens
aaccccagggttggtcaatttcgtgccagccaccgcggtcaca

SEQ ID NO: 63764 - DNA, 34 bp, Homo sapiens
aaccccagggttggtcaatttcgtgccagccacc

SEQ ID NO: 63765 - DNA, 35 bp, Homo sapiens
aaccccagggttggtcaatttcgtgccagccaccg

SEQ ID NO: 63766 - DNA, 39 bp, Homo sapiens
aaccccagggttggtcaatttcgtgccagccaccgcggt

SEQ ID NO: 63767 - DNA, 37 bp, Homo sapiens
aaccccagggttggtcaatttcgtgccagccaccgcg

SEQ ID NO: 63768 - DNA, 35 bp, Homo sapiens
accccagggttggtcaatttcgtgccagccaccgc

SEQ ID NO: 63769 - DNA, 36 bp, Homo sapiens
accccagggttggtcaatttcgtgccagccaccgcg

SEQ ID NO: 63770 - DNA, 39 bp, Homo sapiens
ccccagggttggtcaatttcgtgccagccaccgcggtca

SEQ ID NO: 63771 - DNA, 34 bp, Homo sapiens
cccagggttggtcaatttcgtgccagccaccgcg

SEQ ID NO: 63772 - DNA, 36 bp, Homo sapiens; identical to SEQ ID NO: 7244

SEQ ID NO: 63773 - DNA, 30 bp, Homo sapiens
ccagggttggtcaatttcgtgccagccacc

SEQ ID NO: 63774 - DNA, 37 bp, Homo sapiens
ccagggttggtcaatttcgtgccagccaccgcggtca

SEQ ID NO: 63775 - DNA, 39 bp, Homo sapiens
ccagggttggtcaatttcgtgccagccaccgcggtcaca

SEQ ID NO: 63776 - DNA, 33 bp, Homo sapiens
ccagggttggtcaatttcgtgccagccaccgcg

SEQ ID NO: 63777 - DNA, 31 bp, Homo sapiens
ccagggttggtcaatttcgtgccagccaccg

SEQ ID NO: 63778 - DNA, 29 bp, Homo sapiens
cagggttggtcaatttcgtgccagccacc

SEQ ID NO: 63779 - DNA, 30 bp, Homo sapiens
cagggttggtcaatttcgtgccagccaccg

SEQ ID NO: 63780 - DNA, 32 bp, Homo sapiens
cagggttggtcaatttcgtgccagccaccgcg

SEQ ID NO: 63781 - DNA, 36 bp, Homo sapiens; identical to SEQ ID NO: 7252

SEQ ID NO: 63782 - DNA, 38 bp, Homo sapiens
cagggttggtcaatttcgtgccagccaccgcggtcaca

SEQ ID NO: 63783 - DNA, 19 bp, Homo sapiens
cgtgccagccaccgcggtc

SEQ ID NO: 63784 - DNA, 20 bp, Homo sapiens
cgtgccagccaccgcggtca

SEQ ID NO: 63785 - DNA, 16 bp, Homo sapiens
agccaccgcggtcaca

SEQ ID NO: 63786 - DNA, 26 bp, Homo sapiens
agccaccgcggtcacacgattaaccc

SEQ ID NO: 63787 - DNA, 27 bp, Homo sapiens
agccaccgcggtcacacgattaaccca

SEQ ID NO: 63788 - DNA, 32 bp, Homo sapiens; identical to SEQ ID NO: 7276

SEQ ID NO: 63789 - DNA, 31 bp, Homo sapiens; identical to SEQ ID NO: 257

SEQ ID NO: 63790 - DNA, 30 bp, Homo sapiens; identical to SEQ ID NO: 7279

SEQ ID NO: 63791 - DNA, 31 bp, Homo sapiens
gccaccgcggtcacacgattaacccaagtca

SEQ ID NO: 63792 - DNA, 22 bp, Homo sapiens
accgcggtcacacgattaaccc

SEQ ID NO: 63793 - DNA, 19 bp, Homo sapiens
gcggtcacacgattaaccc

SEQ ID NO: 63794 - DNA, 20 bp, Homo sapiens
gcggtcacacgattaaccca

SEQ ID NO: 63795 - DNA, 18 bp, Homo sapiens
gcggtcacacgattaacc

SEQ ID NO: 63796 - DNA, 25 bp, Homo sapiens
gcggtcacacgattaacccaagtca

SEQ ID NO: 63797 - DNA, 35 bp, Homo sapiens; identical to SEQ ID NO: 7287

SEQ ID NO: 63798 - DNA, 34 bp, Homo sapiens; identical to SEQ ID NO: 7286

SEQ ID NO: 63799 - DNA, 17 bp, Homo sapiens
cggtcacacgattaacc

SEQ ID NO: 63800 - DNA, 18 bp, Homo sapiens
cggtcacacgattaaccc

SEQ ID NO: 63801 - DNA, 33 bp, Homo sapiens; identical to SEQ ID NO: 258

SEQ ID NO: 63802 - DNA, 34 bp, Homo sapiens
cggtcacacgattaacccaagtcaatagaagccg

SEQ ID NO: 63803 - DNA, 17 bp, Homo sapiens
gtcacacgattaaccca

SEQ ID NO: 63804 - DNA, 31 bp, Homo sapiens; identical to SEQ ID NO: 7291

SEQ ID NO: 63805 - DNA, 32 bp, Homo sapiens; identical to SEQ ID NO: 7292

SEQ ID NO: 63806 - DNA, 18 bp, Homo sapiens
acacgattaacccaagtc

SEQ ID NO: 63807 - DNA, 19 bp, Homo sapiens
acacgattaacccaagtca

SEQ ID NO: 63808 - DNA, 28 bp, Homo sapiens
acacgattaacccaagtcaatagaagcc

SEQ ID NO: 63809 - DNA, 29 bp, Homo sapiens
acacgattaacccaagtcaatagaagccg

SEQ ID NO: 63810 - DNA, 42 bp, Homo sapiens; identical to SEQ ID NO: 7323

SEQ ID NO: 63811 - DNA, 44 bp, Homo sapiens; identical to SEQ ID NO: 7325

SEQ ID NO: 63812 - DNA, 43 bp, Homo sapiens; identical to SEQ ID NO: 7324

SEQ ID NO: 63813 - DNA, 41 bp, Homo sapiens; identical to SEQ ID NO: 7330

SEQ ID NO: 63814 - DNA, 32 bp, Homo sapiens; identical to SEQ ID NO: 279

SEQ ID NO: 63815 - DNA, 33 bp, Homo sapiens; identical to SEQ ID NO: 280

SEQ ID NO: 63816 - DNA, 31 bp, Homo sapiens; identical to SEQ ID NO: 7412

SEQ ID NO: 63817 - DNA, 30 bp, Homo sapiens
ggcgtaaagagtgttttagatcaccccctc

SEQ ID NO: 63818 - DNA, 33 bp, Homo sapiens
ggcgtaaagagtgttttagatcaccccctcccc

SEQ ID NO: 63819 - DNA, 29 bp, Homo sapiens
ggcgtaaagagtgttttagatcaccccct

SEQ ID NO: 63820 - DNA, 26 bp, Homo sapiens
ggcgtaaagagtgttttagatcaccc

SEQ ID NO: 63821 - DNA, 31 bp, Homo sapiens
ggcgtaaagagtgttttagatcaccccctcc

SEQ ID NO: 63822 - DNA, 32 bp, Homo sapiens
ggcgtaaagagtgttttagatcaccccctccc

SEQ ID NO: 63823 - DNA, 34 bp, Homo sapiens
ggcgtaaagagtgttttagatcaccccctcccca

SEQ ID NO: 63824 - DNA, 27 bp, Homo sapiens
ggcgtaaagagtgttttagatcacccc

SEQ ID NO: 63825 - DNA, 28 bp, Homo sapiens
ggcgtaaagagtgttttagatcaccccc

SEQ ID NO: 63826 - DNA, 25 bp, Homo sapiens
gcgtaaagagtgttttagatcaccc

SEQ ID NO: 63827 - DNA, 33 bp, Homo sapiens
gcgtaaagagtgttttagatcaccccctcccca

SEQ ID NO: 63828 - DNA, 30 bp, Homo sapiens
gcgtaaagagtgttttagatcaccccctcc

SEQ ID NO: 63829 - DNA, 32 bp, Homo sapiens; identical to SEQ ID NO: 7425

SEQ ID NO: 63830 - DNA, 26 bp, Homo sapiens
gcgtaaagagtgttttagatcacccc

SEQ ID NO: 63831 - DNA, 31 bp, Homo sapiens
gcgtaaagagtgttttagatcaccccctccc

SEQ ID NO: 63832 - DNA, 27 bp, Homo sapiens
gcgtaaagagtgttttagatcaccccc

SEQ ID NO: 63833 - DNA, 21 bp, Homo sapiens
agagtgttttagatcaccccc

SEQ ID NO: 63834 - DNA, 19 bp, Homo sapiens
gagtgttttagatcacccc

SEQ ID NO: 63835 - DNA, 20 bp, Homo sapiens
gagtgttttagatcaccccc

SEQ ID NO: 63836 - DNA, 16 bp, Homo sapiens
cctccccaataaagct

SEQ ID NO: 63837 - DNA, 26 bp, Homo sapiens
ctccccaataaagctaaaactcacct

SEQ ID NO: 63838 - DNA, 25 bp, Homo sapiens
ctccccaataaagctaaaactcacc

SEQ ID NO: 63839 - DNA, 25 bp, Homo sapiens
tccccaataaagctaaaactcacct

SEQ ID NO: 63840 - DNA, 35 bp, Homo sapiens; identical to SEQ ID NO: 61474

SEQ ID NO: 63841 - DNA, 46 bp, Homo sapiens
aaagctaaaactcacctgagttgtaaaaaactccagttgacacaaa

SEQ ID NO: 63842 - DNA, 44 bp, Homo sapiens
aaagctaaaactcacctgagttgtaaaaaactccagttgacaca

SEQ ID NO: 63843 - DNA, 43 bp, Homo sapiens
aagctaaaactcacctgagttgtaaaaaactccagttgacaca

SEQ ID NO: 63844 - DNA, 42 bp, Homo sapiens
agctaaaactcacctgagttgtaaaaaactccagttgacaca

SEQ ID NO: 63845 - DNA, 41 bp, Homo sapiens
gctaaaactcacctgagttgtaaaaaactccagttgacaca

SEQ ID NO: 63846 - DNA, 37 bp, Homo sapiens
aaactcacctgagttgtaaaaaactccagttgacaca

SEQ ID NO: 63847 - DNA, 35 bp, Homo sapiens
actcacctgagttgtaaaaaactccagttgacaca

SEQ ID NO: 63848 - DNA, 29 bp, Homo sapiens
ctcacctgagttgtaaaaaactccagttg

SEQ ID NO: 63849 - DNA, 32 bp, Homo sapiens; identical to SEQ ID NO: 61475

SEQ ID NO: 63850 - DNA, 16 bp, Homo sapiens
aactccagttgacaca

SEQ ID NO: 63851 - DNA, 16 bp, Homo sapiens
actccagttgacacaa

SEQ ID NO: 63852 - DNA, 43 bp, Homo sapiens
gacacaaaatagactacgaaagtggctttaacatatctgaaca

SEQ ID NO: 63853 - DNA, 33 bp, Homo sapiens; identical to SEQ ID NO: 313

SEQ ID NO: 63854 - DNA, 46 bp, Homo sapiens; identical to SEQ ID NO: 7506

SEQ ID NO: 63855 - DNA, 30 bp, Homo sapiens; identical to SEQ ID NO: 316

SEQ ID NO: 63856 - DNA, 46 bp, Homo sapiens; identical to SEQ ID NO: 7519

SEQ ID NO: 63857 - DNA, 32 bp, Homo sapiens; identical to SEQ ID NO: 318

SEQ ID NO: 63858 - DNA, 44 bp, Homo sapiens; identical to SEQ ID NO: 7525

SEQ ID NO: 63859 - DNA, 27 bp, Homo sapiens
agtggctttaacatatctgaacacaca

SEQ ID NO: 63860 - DNA, 40 bp, Homo sapiens; identical to SEQ ID NO: 7556

SEQ ID NO: 63861 - DNA, 30 bp, Homo sapiens; identical to SEQ ID NO: 347

SEQ ID NO: 63862 - DNA, 29 bp, Homo sapiens
catatctgaacacacaatagctaagaccc

SEQ ID NO: 63863 - DNA, 24 bp, Homo sapiens
ctgaacacacaatagctaagaccc

SEQ ID NO: 63864 - DNA, 25 bp, Homo sapiens
ctgaacacacaatagctaagaccca

SEQ ID NO: 63865 - DNA, 24 bp, Homo sapiens
tgaacacacaatagctaagaccca

SEQ ID NO: 63866 - DNA, 32 bp, Homo sapiens
gaacacacaatagctaagacccaaactgggat

SEQ ID NO: 63867 - DNA, 40 bp, Homo sapiens
gaacacacaatagctaagacccaaactgggattagatacc

SEQ ID NO: 63868 - DNA, 21 bp, Homo sapiens
gaacacacaatagctaagacc

SEQ ID NO: 63869 - DNA, 27 bp, Homo sapiens
gaacacacaatagctaagacccaaact

SEQ ID NO: 63870 - DNA, 45 bp, Homo sapiens
gaacacacaatagctaagacccaaactgggattagataccccact

SEQ ID NO: 63871 - DNA, 31 bp, Homo sapiens
gaacacacaatagctaagacccaaactggga

SEQ ID NO: 63872 - DNA, 22 bp, Homo sapiens
gaacacacaatagctaagaccc

SEQ ID NO: 63873 - DNA, 23 bp, Homo sapiens
gaacacacaatagctaagaccca

SEQ ID NO: 63874 - DNA, 42 bp, Homo sapiens
gaacacacaatagctaagacccaaactgggattagatacccc

SEQ ID NO: 63875 - DNA, 43 bp, Homo sapiens; identical to SEQ ID NO: 63121

SEQ ID NO: 63876 - DNA, 41 bp, Homo sapiens
gaacacacaatagctaagacccaaactgggattagataccc

SEQ ID NO: 63877 - DNA, 42 bp, Homo sapiens
aacacacaatagctaagacccaaactgggattagatacccca

SEQ ID NO: 63878 - DNA, 20 bp, Homo sapiens
aacacacaatagctaagacc

SEQ ID NO: 63879 - DNA, 22 bp, Homo sapiens
aacacacaatagctaagaccca

SEQ ID NO: 63880 - DNA, 41 bp, Homo sapiens
aacacacaatagctaagacccaaactgggattagatacccc

SEQ ID NO: 63881 - DNA, 40 bp, Homo sapiens
aacacacaatagctaagacccaaactgggattagataccc

SEQ ID NO: 63882 - DNA, 21 bp, Homo sapiens
aacacacaatagctaagaccc

SEQ ID NO: 63883 - DNA, 38 bp, Homo sapiens
acacaatagctaagacccaaactgggattagatacccc

SEQ ID NO: 63884 - DNA, 18 bp, Homo sapiens
acacaatagctaagaccc

SEQ ID NO: 63885 - DNA, 19 bp, Homo sapiens
acacaatagctaagaccca

SEQ ID NO: 63886 - DNA, 37 bp, Homo sapiens
acacaatagctaagacccaaactgggattagataccc

SEQ ID NO: 63887 - DNA, 39 bp, Homo sapiens; identical to SEQ ID NO: 63122

SEQ ID NO: 63888 - DNA, 18 bp, Homo sapiens
cacaatagctaagaccca

SEQ ID NO: 63889 - DNA, 17 bp, Homo sapiens
cacaatagctaagaccc

SEQ ID NO: 63890 - DNA, 37 bp, Homo sapiens; identical to SEQ ID NO: 61477

SEQ ID NO: 63891 - DNA, 16 bp, Homo sapiens
caatagctaagaccca

SEQ ID NO: 63892 - DNA, 34 bp, Homo sapiens
caatagctaagacccaaactgggattagataccc

SEQ ID NO: 63893 - DNA, 18 bp, Homo sapiens
atagctaagacccaaact

SEQ ID NO: 63894 - DNA, 39 bp, Homo sapiens
agacccaaactgggattagataccccactatgcttagcc

SEQ ID NO: 63895 - DNA, 32 bp, Homo sapiens
gacccaaactgggattagataccccactatgc

SEQ ID NO: 63896 - DNA, 39 bp, Homo sapiens
gacccaaactgggattagataccccactatgcttagccc

SEQ ID NO: 63897 - DNA, 40 bp, Homo sapiens
gacccaaactgggattagataccccactatgcttagccct

SEQ ID NO: 63898 - DNA, 41 bp, Homo sapiens
gacccaaactgggattagataccccactatgcttagcccta

SEQ ID NO: 63899 - DNA, 45 bp, Homo sapiens
gacccaaactgggattagataccccactatgcttagccctaaacc

SEQ ID NO: 63900 - DNA, 46 bp, Homo sapiens
gacccaaactgggattagataccccactatgcttagccctaaacct

SEQ ID NO: 63901 - DNA, 33 bp, Homo sapiens
gacccaaactgggattagataccccactatgct

SEQ ID NO: 63902 - DNA, 38 bp, Homo sapiens
gacccaaactgggattagataccccactatgcttagcc

SEQ ID NO: 63903 - DNA, 36 bp, Homo sapiens
caaactgggattagataccccactatgcttagccct

SEQ ID NO: 63904 - DNA, 25 bp, Homo sapiens
accccactatgcttagccctaaacc

SEQ ID NO: 63905 - DNA, 32 bp, Homo sapiens
cccactatgcttagccctaaacctcaacagtt

SEQ ID NO: 63906 - DNA, 41 bp, Homo sapiens
cccactatgcttagccctaaacctcaacagttaaatcaaca

SEQ ID NO: 63907 - DNA, 18 bp, Homo sapiens
cccactatgcttagccct

SEQ ID NO: 63908 - DNA, 17 bp, Homo sapiens
ccactatgcttagccct

SEQ ID NO: 63909 - DNA, 18 bp, Homo sapiens
ccactatgcttagcccta

SEQ ID NO: 63910 - DNA, 28 bp, Homo sapiens
ccactatgcttagccctaaacctcaaca

SEQ ID NO: 63911 - DNA, 31 bp, Homo sapiens; identical to SEQ ID NO: 7698

SEQ ID NO: 63912 - DNA, 22 bp, Homo sapiens
ccactatgcttagccctaaacc

SEQ ID NO: 63913 - DNA, 40 bp, Homo sapiens
ccactatgcttagccctaaacctcaacagttaaatcaaca

SEQ ID NO: 63914 - DNA, 17 bp, Homo sapiens
atgcttagccctaaacc

SEQ ID NO: 63915 - DNA, 18 bp, Homo sapiens
atgcttagccctaaacct

SEQ ID NO: 63916 - DNA, 20 bp, Homo sapiens
atgcttagccctaaacctca

SEQ ID NO: 63917 - DNA, 29 bp, Homo sapiens
agccctaaacctcaacagttaaatcaaca

SEQ ID NO: 63918 - DNA, 28 bp, Homo sapiens
gccctaaacctcaacagttaaatcaaca

SEQ ID NO: 63919 - DNA, 36 bp, Homo sapiens
aaacctcaacagttaaatcaacaaaactgctcgcca

SEQ ID NO: 63920 - DNA, 35 bp, Homo sapiens
aaacctcaacagttaaatcaacaaaactgctcgcc

SEQ ID NO: 63921 - DNA, 41 bp, Homo sapiens
aaacctcaacagttaaatcaacaaaactgctcgccagaaca

SEQ ID NO: 63922 - DNA, 41 bp, Homo sapiens
aacctcaacagttaaatcaacaaaactgctcgccagaacac

SEQ ID NO: 63923 - DNA, 22 bp, Homo sapiens
aacctcaacagttaaatcaaca

SEQ ID NO: 63924 - DNA, 30 bp, Homo sapiens
aacctcaacagttaaatcaacaaaactgct

SEQ ID NO: 63925 - DNA, 45 bp, Homo sapiens
aacctcaacagttaaatcaacaaaactgctcgccagaacactacg

SEQ ID NO: 63926 - DNA, 35 bp, Homo sapiens
aacctcaacagttaaatcaacaaaactgctcgcca

SEQ ID NO: 63927 - DNA, 42 bp, Homo sapiens
aacctcaacagttaaatcaacaaaactgctcgccagaacact

SEQ ID NO: 63928 - DNA, 43 bp, Homo sapiens
aacctcaacagttaaatcaacaaaactgctcgccagaacacta

SEQ ID NO: 63929 - DNA, 40 bp, Homo sapiens
aacctcaacagttaaatcaacaaaactgctcgccagaaca

SEQ ID NO: 63930 - DNA, 34 bp, Homo sapiens
aacctcaacagttaaatcaacaaaactgctcgcc

SEQ ID NO: 63931 - DNA, 39 bp, Homo sapiens
acctcaacagttaaatcaacaaaactgctcgccagaaca

SEQ ID NO: 63932 - DNA, 33 bp, Homo sapiens
acctcaacagttaaatcaacaaaactgctcgcc

SEQ ID NO: 63933 - DNA, 31 bp, Homo sapiens
ctcaacagttaaatcaacaaaactgctcgcc

SEQ ID NO: 63934 - DNA, 36 bp, Homo sapiens
tcaacagttaaatcaacaaaactgctcgccagaaca

SEQ ID NO: 63935 - DNA, 17 bp, Homo sapiens
caacagttaaatcaaca

SEQ ID NO: 63936 - DNA, 35 bp, Homo sapiens
caacagttaaatcaacaaaactgctcgccagaaca

SEQ ID NO: 63937 - DNA, 46 bp, Homo sapiens
aacagttaaatcaacaaaactgctcgccagaacactacgagccaca

SEQ ID NO: 63938 - DNA, 45 bp, Homo sapiens
acagttaaatcaacaaaactgctcgccagaacactacgagccaca

SEQ ID NO: 63939 - DNA, 37 bp, Homo sapiens
atcaacaaaactgctcgccagaacactacgagccaca

SEQ ID NO: 63940 - DNA, 40 bp, Homo sapiens
atcaacaaaactgctcgccagaacactacgagccacagct

SEQ ID NO: 63941 - DNA, 23 bp, Homo sapiens
caacaaaactgctcgccagaaca

SEQ ID NO: 63942 - DNA, 35 bp, Homo sapiens
caacaaaactgctcgccagaacactacgagccaca

SEQ ID NO: 63943 - DNA, 22 bp, Homo sapiens
aacaaaactgctcgccagaaca

SEQ ID NO: 63944 - DNA, 34 bp, Homo sapiens
aacaaaactgctcgccagaacactacgagccaca

SEQ ID NO: 63945 - DNA, 37 bp, Homo sapiens
aacaaaactgctcgccagaacactacgagccacagct

SEQ ID NO: 63946 - DNA, 35 bp, Homo sapiens
acaaaactgctcgccagaacactacgagccacagc

SEQ ID NO: 63947 - DNA, 21 bp, Homo sapiens
acaaaactgctcgccagaaca

SEQ ID NO: 63948 - DNA, 23 bp, Homo sapiens
acaaaactgctcgccagaacact

SEQ ID NO: 63949 - DNA, 33 bp, Homo sapiens
acaaaactgctcgccagaacactacgagccaca

SEQ ID NO: 63950 - DNA, 36 bp, Homo sapiens
acaaaactgctcgccagaacactacgagccacagct

SEQ ID NO: 63951 - DNA, 18 bp, Homo sapiens
aaactgctcgccagaaca

SEQ ID NO: 63952 - DNA, 33 bp, Homo sapiens; identical to SEQ ID NO: 411

SEQ ID NO: 63953 - DNA, 30 bp, Homo sapiens
aaactgctcgccagaacactacgagccaca

SEQ ID NO: 63954 - DNA, 17 bp, Homo sapiens
aactgctcgccagaaca

SEQ ID NO: 63955 - DNA, 29 bp, Homo sapiens
aactgctcgccagaacactacgagccaca

SEQ ID NO: 63956 - DNA, 32 bp, Homo sapiens; identical to SEQ ID NO: 7746

SEQ ID NO: 63957 - DNA, 18 bp, Homo sapiens
gctcgccagaacactacg

SEQ ID NO: 63958 - DNA, 27 bp, Homo sapiens
cgccagaacactacgagccacagctta

SEQ ID NO: 63959 - DNA, 22 bp, Homo sapiens
cgccagaacactacgagccaca

SEQ ID NO: 63960 - DNA, 18 bp, Homo sapiens
agaacactacgagccaca

SEQ ID NO: 63961 - DNA, 17 bp, Homo sapiens
gaacactacgagccaca

SEQ ID NO: 63962 - DNA, 40 bp, Homo sapiens
gagccacagcttaaaactcaaaggacctggcggtgcttca

SEQ ID NO: 63963 - DNA, 39 bp, Homo sapiens
agccacagcttaaaactcaaaggacctggcggtgcttca

SEQ ID NO: 63964 - DNA, 46 bp, Homo sapiens
caaaggacctggcggtgcttcatatccctctagaggagcctgttct

SEQ ID NO: 63965 - DNA, 18 bp, Homo sapiens
ctgtaatcgataaacccc

SEQ ID NO: 63966 - DNA, 26 bp, Homo sapiens
ctgtaatcgataaaccccgatcaacc

SEQ ID NO: 63967 - DNA, 27 bp, Homo sapiens
ctgtaatcgataaaccccgatcaacct

SEQ ID NO: 63968 - DNA, 24 bp, Homo sapiens
gtaatcgataaaccccgatcaacc

SEQ ID NO: 63969 - DNA, 44 bp, Homo sapiens
gtaatcgataaaccccgatcaacctcaccacctcttgctcagcc

SEQ ID NO: 63970 - DNA, 16 bp, Homo sapiens
gtaatcgataaacccc

SEQ ID NO: 63971 - DNA, 46 bp, Homo sapiens; identical to SEQ ID NO: 8142

SEQ ID NO: 63972 - DNA, 17 bp, Homo sapiens
ataaaccccgatcaacc

SEQ ID NO: 63973 - DNA, 34 bp, Homo sapiens
ccgatcaacctcaccacctcttgctcagcctata

SEQ ID NO: 63974 - DNA, 25 bp, Homo sapiens
ccgatcaacctcaccacctcttgct

SEQ ID NO: 63975 - DNA, 27 bp, Homo sapiens
ccgatcaacctcaccacctcttgctca

SEQ ID NO: 63976 - DNA, 18 bp, Homo sapiens
ccgatcaacctcaccacc

SEQ ID NO: 63977 - DNA, 39 bp, Homo sapiens; identical to SEQ ID NO: 8154

SEQ ID NO: 63978 - DNA, 30 bp, Homo sapiens; identical to SEQ ID NO: 567

SEQ ID NO: 63979 - DNA, 38 bp, Homo sapiens; identical to SEQ ID NO: 8153

SEQ ID NO: 63980 - DNA, 30 bp, Homo sapiens; identical to SEQ ID NO: 573

SEQ ID NO: 63981 - DNA, 17 bp, Homo sapiens
cgatcaacctcaccacc

SEQ ID NO: 63982 - DNA, 18 bp, Homo sapiens
cgatcaacctcaccacct

SEQ ID NO: 63983 - DNA, 24 bp, Homo sapiens
cgatcaacctcaccacctcttgct

SEQ ID NO: 63984 - DNA, 33 bp, Homo sapiens; identical to SEQ ID NO: 574

SEQ ID NO: 63985 - DNA, 26 bp, Homo sapiens
cgatcaacctcaccacctcttgctca

SEQ ID NO: 63986 - DNA, 38 bp, Homo sapiens; identical to SEQ ID NO: 8171

SEQ ID NO: 63987 - DNA, 29 bp, Homo sapiens
cgatcaacctcaccacctcttgctcagcc

SEQ ID NO: 63988 - DNA, 37 bp, Homo sapiens; identical to SEQ ID NO: 8170

SEQ ID NO: 63989 - DNA, 36 bp, Homo sapiens; identical to SEQ ID NO: 8181

SEQ ID NO: 63990 - DNA, 37 bp, Homo sapiens; identical to SEQ ID NO: 8182

SEQ ID NO: 63991 - DNA, 28 bp, Homo sapiens
gatcaacctcaccacctcttgctcagcc

SEQ ID NO: 63992 - DNA, 35 bp, Homo sapiens; identical to SEQ ID NO: 8192

SEQ ID NO: 63993 - DNA, 36 bp, Homo sapiens; identical to SEQ ID NO: 8193

SEQ ID NO: 63994 - DNA, 33 bp, Homo sapiens; identical to SEQ ID NO: 582

SEQ ID NO: 63995 - DNA, 33 bp, Homo sapiens; identical to SEQ ID NO: 588

SEQ ID NO: 63996 - DNA, 32 bp, Homo sapiens; identical to SEQ ID NO: 587

SEQ ID NO: 63997 - DNA, 24 bp, Homo sapiens
aacctcaccacctcttgctcagcc

SEQ ID NO: 63998 - DNA, 18 bp, Homo sapiens
acctcaccacctcttgct

SEQ ID NO: 63999 - DNA, 23 bp, Homo sapiens
acctcaccacctcttgctcagcc

SEQ ID NO: 64000 - DNA, 32 bp, Homo sapiens; identical to SEQ ID NO: 591

SEQ ID NO: 64001 - DNA, 31 bp, Homo sapiens; identical to SEQ ID NO: 590

SEQ ID NO: 64002 - DNA, 20 bp, Homo sapiens
tcaccacctcttgctcagcc

SEQ ID NO: 64003 - DNA, 29 bp, Homo sapiens
tcaccacctcttgctcagcctatataccg

SEQ ID NO: 64004 - DNA, 28 bp, Homo sapiens
tcaccacctcttgctcagcctatatacc

SEQ ID NO: 64005 - DNA, 26 bp, Homo sapiens
cagcctatataccgccatcttcagca

SEQ ID NO: 64006 - DNA, 30 bp, Homo sapiens
agcctatataccgccatcttcagcaaaccc

SEQ ID NO: 64007 - DNA, 25 bp, Homo sapiens
agcctatataccgccatcttcagca

SEQ ID NO: 64008 - DNA, 35 bp, Homo sapiens
accgccatcttcagcaaaccctgatgaaggctaca

SEQ ID NO: 64009 - DNA, 19 bp, Homo sapiens
gccatcttcagcaaaccct

SEQ ID NO: 64010 - DNA, 18 bp, Homo sapiens
gccatcttcagcaaaccc

SEQ ID NO: 64011 - DNA, 17 bp, Homo sapiens
gccatcttcagcaaacc

SEQ ID NO: 64012 - DNA, 16 bp, Homo sapiens
ccatcttcagcaaacc

SEQ ID NO: 64013 - DNA, 18 bp, Homo sapiens
ccatcttcagcaaaccct

SEQ ID NO: 64014 - DNA, 28 bp, Homo sapiens
ccatcttcagcaaaccctgatgaaggct

SEQ ID NO: 64015 - DNA, 31 bp, Homo sapiens
ccatcttcagcaaaccctgatgaaggctaca

SEQ ID NO: 64016 - DNA, 17 bp, Homo sapiens
ccatcttcagcaaaccc

SEQ ID NO: 64017 - DNA, 24 bp, Homo sapiens
cagcaaaccctgatgaaggctaca

SEQ ID NO: 64018 - DNA, 23 bp, Homo sapiens
agcaaaccctgatgaaggctaca

SEQ ID NO: 64019 - DNA, 22 bp, Homo sapiens
gcaaaccctgatgaaggctaca

SEQ ID NO: 64020 - DNA, 19 bp, Homo sapiens
aaccctgatgaaggctaca

SEQ ID NO: 64021 - DNA, 36 bp, Homo sapiens
aaccctgatgaaggctacaaagtaagcgcaagtacc

SEQ ID NO: 64022 - DNA, 37 bp, Homo sapiens
aaccctgatgaaggctacaaagtaagcgcaagtaccc

SEQ ID NO: 64023 - DNA, 21 bp, Homo sapiens
gaaggctacaaagtaagcgca

SEQ ID NO: 64024 - DNA, 27 bp, Homo sapiens
gaaggctacaaagtaagcgcaagtacc

SEQ ID NO: 64025 - DNA, 20 bp, Homo sapiens
aaggctacaaagtaagcgca

SEQ ID NO: 64026 - DNA, 26 bp, Homo sapiens
aaggctacaaagtaagcgcaagtacc

SEQ ID NO: 64027 - DNA, 28 bp, Homo sapiens
aaggctacaaagtaagcgcaagtaccca

SEQ ID NO: 64028 - DNA, 19 bp, Homo sapiens
aggctacaaagtaagcgca

SEQ ID NO: 64029 - DNA, 26 bp, Homo sapiens
ggctacaaagtaagcgcaagtaccca

SEQ ID NO: 64030 - DNA, 18 bp, Homo sapiens
ggctacaaagtaagcgca

SEQ ID NO: 64031 - DNA, 24 bp, Homo sapiens
ggctacaaagtaagcgcaagtacc

SEQ ID NO: 64032 - DNA, 25 bp, Homo sapiens
ggctacaaagtaagcgcaagtaccc

SEQ ID NO: 64033 - DNA, 17 bp, Homo sapiens
gctacaaagtaagcgca

SEQ ID NO: 64034 - DNA, 16 bp, Homo sapiens
agcgcaagtacccacg

SEQ ID NO: 64035 - DNA, 19 bp, Homo sapiens
ggctacattttctacccca

SEQ ID NO: 64036 - DNA, 34 bp, Homo sapiens
aactacgatagcccttatgaaacttaagggtcga

SEQ ID NO: 64037 - DNA, 18 bp, Homo sapiens
gatagcccttatgaaact

SEQ ID NO: 64038 - DNA, 17 bp, Homo sapiens
atagcccttatgaaact

SEQ ID NO: 64039 - DNA, 26 bp, Homo sapiens
gagtgcttagttgaacagggccctga

SEQ ID NO: 64040 - DNA, 35 bp, Homo sapiens
gcccgtcaccctcctcaagtatacttcaaaggaca

SEQ ID NO: 64041 - DNA, 32 bp, Homo sapiens; identical to SEQ ID NO: 8531

SEQ ID NO: 64042 - DNA, 45 bp, Homo sapiens
gtcaccctcctcaagtatacttcaaaggacatttaactaaaaccc

SEQ ID NO: 64043 - DNA, 31 bp, Homo sapiens; identical to SEQ ID NO: 8535

SEQ ID NO: 64044 - DNA, 44 bp, Homo sapiens
gtcaccctcctcaagtatacttcaaaggacatttaactaaaacc

SEQ ID NO: 64045 - DNA, 21 bp, Homo sapiens
accctcctcaagtatacttca

SEQ ID NO: 64046 - DNA, 35 bp, Homo sapiens
accctcctcaagtatacttcaaaggacatttaact

SEQ ID NO: 64047 - DNA, 42 bp, Homo sapiens
accctcctcaagtatacttcaaaggacatttaactaaaaccc

SEQ ID NO: 64048 - DNA, 41 bp, Homo sapiens
accctcctcaagtatacttcaaaggacatttaactaaaacc

SEQ ID NO: 64049 - DNA, 28 bp, Homo sapiens
accctcctcaagtatacttcaaaggaca

SEQ ID NO: 64050 - DNA, 27 bp, Homo sapiens
ccctcctcaagtatacttcaaaggaca

SEQ ID NO: 64051 - DNA, 38 bp, Homo sapiens
ctcctcaagtatacttcaaaggacatttaactaaaacc

SEQ ID NO: 64052 - DNA, 39 bp, Homo sapiens; identical to SEQ ID NO: 8548

SEQ ID NO: 64053 - DNA, 18 bp, Homo sapiens
ctcctcaagtatacttca

SEQ ID NO: 64054 - DNA, 25 bp, Homo sapiens
ctcctcaagtatacttcaaaggaca

SEQ ID NO: 64055 - DNA, 23 bp, Homo sapiens
cctcaagtatacttcaaaggaca

SEQ ID NO: 64056 - DNA, 20 bp, Homo sapiens
caagtatacttcaaaggaca

SEQ ID NO: 64057 - DNA, 18 bp, Homo sapiens
agtatacttcaaaggaca

SEQ ID NO: 64058 - DNA, 35 bp, Homo sapiens
tatacttcaaaggacatttaactaaaacccctacg

SEQ ID NO: 64059 - DNA, 37 bp, Homo sapiens
tatacttcaaaggacatttaactaaaacccctacgca

SEQ ID NO: 64060 - DNA, 31 bp, Homo sapiens
atacttcaaaggacatttaactaaaacccct

SEQ ID NO: 64061 - DNA, 32 bp, Homo sapiens
atacttcaaaggacatttaactaaaaccccta

SEQ ID NO: 64062 - DNA, 36 bp, Homo sapiens
atacttcaaaggacatttaactaaaacccctacgca

SEQ ID NO: 64063 - DNA, 34 bp, Homo sapiens
atacttcaaaggacatttaactaaaacccctacg

SEQ ID NO: 64064 - DNA, 31 bp, Homo sapiens
tacttcaaaggacatttaactaaaaccccta

SEQ ID NO: 64065 - DNA, 35 bp, Homo sapiens
tacttcaaaggacatttaactaaaacccctacgca

SEQ ID NO: 64066 - DNA, 33 bp, Homo sapiens
tacttcaaaggacatttaactaaaacccctacg

SEQ ID NO: 64067 - DNA, 30 bp, Homo sapiens
acttcaaaggacatttaactaaaaccccta

SEQ ID NO: 64068 - DNA, 34 bp, Homo sapiens
acttcaaaggacatttaactaaaacccctacgca

SEQ ID NO: 64069 - DNA, 32 bp, Homo sapiens
acttcaaaggacatttaactaaaacccctacg

SEQ ID NO: 64070 - DNA, 31 bp, Homo sapiens
cttcaaaggacatttaactaaaacccctacg

SEQ ID NO: 64071 - DNA, 33 bp, Homo sapiens
cttcaaaggacatttaactaaaacccctacgca

SEQ ID NO: 64072 - DNA, 23 bp, Homo sapiens
caaaggacatttaactaaaaccc

SEQ ID NO: 64073 - DNA, 25 bp, Homo sapiens
caaaggacatttaactaaaacccct

SEQ ID NO: 64074 - DNA, 26 bp, Homo sapiens
caaaggacatttaactaaaaccccta

SEQ ID NO: 64075 - DNA, 28 bp, Homo sapiens
caaaggacatttaactaaaacccctacg

SEQ ID NO: 64076 - DNA, 30 bp, Homo sapiens; identical to SEQ ID NO: 8626

SEQ ID NO: 64077 - DNA, 24 bp, Homo sapiens
caaaggacatttaactaaaacccc

SEQ ID NO: 64078 - DNA, 22 bp, Homo sapiens
aaaggacatttaactaaaaccc

SEQ ID NO: 64079 - DNA, 23 bp, Homo sapiens
aaaggacatttaactaaaacccc

SEQ ID NO: 64080 - DNA, 24 bp, Homo sapiens
aaaggacatttaactaaaacccct

SEQ ID NO: 64081 - DNA, 20 bp, Homo sapiens
aaggacatttaactaaaacc

SEQ ID NO: 64082 - DNA, 26 bp, Homo sapiens
aaggacatttaactaaaacccctacg

SEQ ID NO: 64083 - DNA, 28 bp, Homo sapiens
aaggacatttaactaaaacccctacgca

SEQ ID NO: 64084 - DNA, 23 bp, Homo sapiens
aaggacatttaactaaaacccct

SEQ ID NO: 64085 - DNA, 24 bp, Homo sapiens
aaggacatttaactaaaaccccta

SEQ ID NO: 64086 - DNA, 21 bp, Homo sapiens
aaggacatttaactaaaaccc

SEQ ID NO: 64087 - DNA, 22 bp, Homo sapiens
aaggacatttaactaaaacccc

SEQ ID NO: 64088 - DNA, 19 bp, Homo sapiens
aggacatttaactaaaacc

SEQ ID NO: 64089 - DNA, 27 bp, Homo sapiens
aggacatttaactaaaacccctacgca

SEQ ID NO: 64090 - DNA, 20 bp, Homo sapiens
aggacatttaactaaaaccc

SEQ ID NO: 64091 - DNA, 21 bp, Homo sapiens
aggacatttaactaaaacccc

SEQ ID NO: 64092 - DNA, 22 bp, Homo sapiens
aggacatttaactaaaacccct

SEQ ID NO: 64093 - DNA, 23 bp, Homo sapiens
aggacatttaactaaaaccccta

SEQ ID NO: 64094 - DNA, 25 bp, Homo sapiens
aggacatttaactaaaacccctacg

SEQ ID NO: 64095 - DNA, 23 bp, Homo sapiens
ggacatttaactaaaacccctac

SEQ ID NO: 64096 - DNA, 18 bp, Homo sapiens
ggacatttaactaaaacc

SEQ ID NO: 64097 - DNA, 43 bp, Homo sapiens
ggacatttaactaaaacccctacgcatttatatagaggagaca

SEQ ID NO: 64098 - DNA, 19 bp, Homo sapiens
ggacatttaactaaaaccc

SEQ ID NO: 64099 - DNA, 20 bp, Homo sapiens
ggacatttaactaaaacccc

SEQ ID NO: 64100 - DNA, 26 bp, Homo sapiens
ggacatttaactaaaacccctacgca

SEQ ID NO: 64101 - DNA, 21 bp, Homo sapiens
ggacatttaactaaaacccct

SEQ ID NO: 64102 - DNA, 22 bp, Homo sapiens
ggacatttaactaaaaccccta

SEQ ID NO: 64103 - DNA, 24 bp, Homo sapiens
ggacatttaactaaaacccctacg

SEQ ID NO: 64104 - DNA, 42 bp, Homo sapiens
gacatttaactaaaacccctacgcatttatatagaggagaca

SEQ ID NO: 64105 - DNA, 22 bp, Homo sapiens
gacatttaactaaaacccctac

SEQ ID NO: 64106 - DNA, 46 bp, Homo sapiens
gacatttaactaaaacccctacgcatttatatagaggagacaagtc

SEQ ID NO: 64107 - DNA, 17 bp, Homo sapiens
gacatttaactaaaacc

SEQ ID NO: 64108 - DNA, 23 bp, Homo sapiens
gacatttaactaaaacccctacg

SEQ ID NO: 64109 - DNA, 25 bp, Homo sapiens
gacatttaactaaaacccctacgca

SEQ ID NO: 64110 - DNA, 18 bp, Homo sapiens
gacatttaactaaaaccc

SEQ ID NO: 64111 - DNA, 19 bp, Homo sapiens
gacatttaactaaaacccc

SEQ ID NO: 64112 - DNA, 20 bp, Homo sapiens
gacatttaactaaaacccct

SEQ ID NO: 64113 - DNA, 21 bp, Homo sapiens
gacatttaactaaaaccccta

SEQ ID NO: 64114 - DNA, 17 bp, Homo sapiens
acatttaactaaaaccc

SEQ ID NO: 64115 - DNA, 18 bp, Homo sapiens
acatttaactaaaacccc

SEQ ID NO: 64116 - DNA, 19 bp, Homo sapiens
acatttaactaaaacccct

SEQ ID NO: 64117 - DNA, 18 bp, Homo sapiens
aactaaaacccctacgca

SEQ ID NO: 64118 - DNA, 35 bp, Homo sapiens
aactaaaacccctacgcatttatatagaggagaca

SEQ ID NO: 64119 - DNA, 31 bp, Homo sapiens
aaaacccctacgcatttatatagaggagaca

SEQ ID NO: 64120 - DNA, 30 bp, Homo sapiens
aaacccctacgcatttatatagaggagaca

SEQ ID NO: 64121 - DNA, 34 bp, Homo sapiens
aaacccctacgcatttatatagaggagacaagtc

SEQ ID NO: 64122 - DNA, 29 bp, Homo sapiens
aacccctacgcatttatatagaggagaca

SEQ ID NO: 64123 - DNA, 19 bp, Homo sapiens
cctacgcatttatatagag

SEQ ID NO: 64124 - DNA, 23 bp, Homo sapiens
cctacgcatttatatagaggaga

SEQ ID NO: 64125 - DNA, 29 bp, Homo sapiens
cctacgcatttatatagaggagacaagtc

SEQ ID NO: 64126 - DNA, 30 bp, Homo sapiens; identical to SEQ ID NO: 8658

SEQ ID NO: 64127 - DNA, 24 bp, Homo sapiens
cctacgcatttatatagaggagac

SEQ ID NO: 64128 - DNA, 25 bp, Homo sapiens
cctacgcatttatatagaggagaca

SEQ ID NO: 64129 - DNA, 23 bp, Homo sapiens
ctacgcatttatatagaggagac

SEQ ID NO: 64130 - DNA, 29 bp, Homo sapiens
ctacgcatttatatagaggagacaagtcg

SEQ ID NO: 64131 - DNA, 31 bp, Homo sapiens; identical to SEQ ID NO: 756

SEQ ID NO: 64132 - DNA, 24 bp, Homo sapiens
ctacgcatttatatagaggagaca

SEQ ID NO: 64133 - DNA, 23 bp, Homo sapiens
tacgcatttatatagaggagaca

SEQ ID NO: 64134 - DNA, 27 bp, Homo sapiens
tacgcatttatatagaggagacaagtc

SEQ ID NO: 64135 - DNA, 28 bp, Homo sapiens
tacgcatttatatagaggagacaagtcg

SEQ ID NO: 64136 - DNA, 21 bp, Homo sapiens
acgcatttatatagaggagac

SEQ ID NO: 64137 - DNA, 25 bp, Homo sapiens
acgcatttatatagaggagacaagt

SEQ ID NO: 64138 - DNA, 29 bp, Homo sapiens
acgcatttatatagaggagacaagtcgta

SEQ ID NO: 64139 - DNA, 32 bp, Homo sapiens; identical to SEQ ID NO: 8691

SEQ ID NO: 64140 - DNA, 27 bp, Homo sapiens
acgcatttatatagaggagacaagtcg

SEQ ID NO: 64141 - DNA, 22 bp, Homo sapiens
acgcatttatatagaggagaca

SEQ ID NO: 64142 - DNA, 26 bp, Homo sapiens
acgcatttatatagaggagacaagtc

SEQ ID NO: 64143 - DNA, 21 bp, Homo sapiens
cgcatttatatagaggagaca

SEQ ID NO: 64144 - DNA, 20 bp, Homo sapiens
gcatttatatagaggagaca

SEQ ID NO: 64145 - DNA, 19 bp, Homo sapiens
catttatatagaggagaca

SEQ ID NO: 64146 - DNA, 43 bp, Homo sapiens
agtcgtaacatggtaagtgtactggaaagtgcacttggacgaa

SEQ ID NO: 64147 - DNA, 41 bp, Homo sapiens
agtcgtaacatggtaagtgtactggaaagtgcacttggacg

SEQ ID NO: 64148 - DNA, 42 bp, Homo sapiens
agtcgtaacatggtaagtgtactggaaagtgcacttggacga

SEQ ID NO: 64149 - DNA, 41 bp, Homo sapiens
gtcgtaacatggtaagtgtactggaaagtgcacttggacga

SEQ ID NO: 64150 - DNA, 40 bp, Homo sapiens
gtcgtaacatggtaagtgtactggaaagtgcacttggacg

SEQ ID NO: 64151 - DNA, 39 bp, Homo sapiens; identical to SEQ ID NO: 62730

SEQ ID NO: 64152 - DNA, 38 bp, Homo sapiens
cgtaacatggtaagtgtactggaaagtgcacttggacg

SEQ ID NO: 64153 - DNA, 39 bp, Homo sapiens
gtaacatggtaagtgtactggaaagtgcacttggacgaa

SEQ ID NO: 64154 - DNA, 37 bp, Homo sapiens; identical to SEQ ID NO: 8780

SEQ ID NO: 64155 - DNA, 38 bp, Homo sapiens; identical to SEQ ID NO: 62731

SEQ ID NO: 64156 - DNA, 35 bp, Homo sapiens; identical to SEQ ID NO: 8782

SEQ ID NO: 64157 - DNA, 36 bp, Homo sapiens
acatggtaagtgtactggaaagtgcacttggacgaa

SEQ ID NO: 64158 - DNA, 34 bp, Homo sapiens; identical to SEQ ID NO: 8784

SEQ ID NO: 64159 - DNA, 35 bp, Homo sapiens; identical to SEQ ID NO: 63129

SEQ ID NO: 64160 - DNA, 31 bp, Homo sapiens
catggtaagtgtactggaaagtgcacttgga

SEQ ID NO: 64161 - DNA, 32 bp, Homo sapiens; identical to SEQ ID NO: 8785

SEQ ID NO: 64162 - DNA, 35 bp, Homo sapiens
catggtaagtgtactggaaagtgcacttggacgaa

SEQ ID NO: 64163 - DNA, 34 bp, Homo sapiens; identical to SEQ ID NO: 63131

SEQ ID NO: 64164 - DNA, 33 bp, Homo sapiens; identical to SEQ ID NO: 815

SEQ ID NO: 64165 - DNA, 31 bp, Homo sapiens; identical to SEQ ID NO: 8787

SEQ ID NO: 64166 - DNA, 34 bp, Homo sapiens
atggtaagtgtactggaaagtgcacttggacgaa

SEQ ID NO: 64167 - DNA, 32 bp, Homo sapiens; identical to SEQ ID NO: 8788

SEQ ID NO: 64168 - DNA, 33 bp, Homo sapiens; identical to SEQ ID NO: 62733

SEQ ID NO: 64169 - DNA, 33 bp, Homo sapiens
tggtaagtgtactggaaagtgcacttggacgaa

SEQ ID NO: 64170 - DNA, 32 bp, Homo sapiens
tggtaagtgtactggaaagtgcacttggacga

SEQ ID NO: 64171 - DNA, 31 bp, Homo sapiens; identical to SEQ ID NO: 8790

SEQ ID NO: 64172 - DNA, 30 bp, Homo sapiens; identical to SEQ ID NO: 8792

SEQ ID NO: 64173 - DNA, 31 bp, Homo sapiens; identical to SEQ ID NO: 61483

SEQ ID NO: 64174 - DNA, 18 bp, Homo sapiens
gctaaacctagccccaaa

SEQ ID NO: 64175 - DNA, 17 bp, Homo sapiens
gctaaacctagccccaa

SEQ ID NO: 64176 - DNA, 28 bp, Homo sapiens
gctaaacctagccccaaacccactccac

SEQ ID NO: 64177 - DNA, 16 bp, Homo sapiens
gctaaacctagcccca

SEQ ID NO: 64178 - DNA, 19 bp, Homo sapiens
gctaaacctagccccaaac

SEQ ID NO: 64179 - DNA, 20 bp, Homo sapiens
gctaaacctagccccaaacc

SEQ ID NO: 64180 - DNA, 21 bp, Homo sapiens
gctaaacctagccccaaaccc

SEQ ID NO: 64181 - DNA, 22 bp, Homo sapiens
gctaaacctagccccaaaccca

SEQ ID NO: 64182 - DNA, 23 bp, Homo sapiens
gctaaacctagccccaaacccac

SEQ ID NO: 64183 - DNA, 24 bp, Homo sapiens
gctaaacctagccccaaacccact

SEQ ID NO: 64184 - DNA, 25 bp, Homo sapiens
gctaaacctagccccaaacccactc

SEQ ID NO: 64185 - DNA, 26 bp, Homo sapiens
gctaaacctagccccaaacccactcc

SEQ ID NO: 64186 - DNA, 27 bp, Homo sapiens
gctaaacctagccccaaacccactcca

SEQ ID NO: 64187 - DNA, 29 bp, Homo sapiens
gctaaacctagccccaaacccactccacc

SEQ ID NO: 64188 - DNA, 30 bp, Homo sapiens; identical to SEQ ID NO: 832

SEQ ID NO: 64189 - DNA, 31 bp, Homo sapiens; identical to SEQ ID NO: 833

SEQ ID NO: 64190 - DNA, 32 bp, Homo sapiens; identical to SEQ ID NO: 834

SEQ ID NO: 64191 - DNA, 33 bp, Homo sapiens; identical to SEQ ID NO: 835

SEQ ID NO: 64192 - DNA, 34 bp, Homo sapiens; identical to SEQ ID NO: 8827

SEQ ID NO: 64193 - DNA, 35 bp, Homo sapiens; identical to SEQ ID NO: 8828

SEQ ID NO: 64194 - DNA, 36 bp, Homo sapiens; identical to SEQ ID NO: 8829

SEQ ID NO: 64195 - DNA, 37 bp, Homo sapiens; identical to SEQ ID NO: 8830

SEQ ID NO: 64196 - DNA, 38 bp, Homo sapiens; identical to SEQ ID NO: 8831

SEQ ID NO: 64197 - DNA, 39 bp, Homo sapiens; identical to SEQ ID NO: 8832

SEQ ID NO: 64198 - DNA, 40 bp, Homo sapiens; identical to SEQ ID NO: 8833

SEQ ID NO: 64199 - DNA, 41 bp, Homo sapiens; identical to SEQ ID NO: 8834

SEQ ID NO: 64200 - DNA, 42 bp, Homo sapiens; identical to SEQ ID NO: 8835

SEQ ID NO: 64201 - DNA, 43 bp, Homo sapiens; identical to SEQ ID NO: 8836

SEQ ID NO: 64202 - DNA, 44 bp, Homo sapiens; identical to SEQ ID NO: 8837

SEQ ID NO: 64203 - DNA, 45 bp, Homo sapiens; identical to SEQ ID NO: 8838

SEQ ID NO: 64204 - DNA, 46 bp, Homo sapiens; identical to SEQ ID NO: 8839

SEQ ID NO: 64205 - DNA, 18 bp, Homo sapiens
aaacctagccccaaaccc

SEQ ID NO: 64206 - DNA, 42 bp, Homo sapiens
aaacctagccccaaacccactccaccttactaccagacaacc

SEQ ID NO: 64207 - DNA, 28 bp, Homo sapiens
agccccaaacccactccaccttactacc

SEQ ID NO: 64208 - DNA, 33 bp, Homo sapiens; identical to SEQ ID NO: 8864

SEQ ID NO: 64209 - DNA, 36 bp, Homo sapiens; identical to SEQ ID NO: 8865

SEQ ID NO: 64210 - DNA, 23 bp, Homo sapiens
aaacccactccaccttactacca

SEQ ID NO: 64211 - DNA, 27 bp, Homo sapiens
aaacccactccaccttactaccagaca

SEQ ID NO: 64212 - DNA, 36 bp, Homo sapiens; identical to SEQ ID NO: 8887

SEQ ID NO: 64213 - DNA, 22 bp, Homo sapiens
aaacccactccaccttactacc

SEQ ID NO: 64214 - DNA, 42 bp, Homo sapiens; identical to SEQ ID NO: 8890

SEQ ID NO: 64215 - DNA, 41 bp, Homo sapiens; identical to SEQ ID NO: 8889

SEQ ID NO: 64216 - DNA, 30 bp, Homo sapiens; identical to SEQ ID NO: 845

SEQ ID NO: 64217 - DNA, 40 bp, Homo sapiens; identical to SEQ ID NO: 8901

SEQ ID NO: 64218 - DNA, 29 bp, Homo sapiens
aacccactccaccttactaccagacaacc

SEQ ID NO: 64219 - DNA, 17 bp, Homo sapiens
cactccaccttactacc

SEQ ID NO: 64220 - DNA, 18 bp, Homo sapiens
cactccaccttactacca

SEQ ID NO: 64221 - DNA, 36 bp, Homo sapiens; identical to SEQ ID NO: 8912

SEQ ID NO: 64222 - DNA, 37 bp, Homo sapiens
cactccaccttactaccagacaaccttagccaaacca

SEQ ID NO: 64223 - DNA, 25 bp, Homo sapiens
cactccaccttactaccagacaacc

SEQ ID NO: 64224 - DNA, 19 bp, Homo sapiens
actccaccttactaccaga

SEQ ID NO: 64225 - DNA, 21 bp, Homo sapiens
actccaccttactaccagaca

SEQ ID NO: 64226 - DNA, 25 bp, Homo sapiens
actccaccttactaccagacaacct

SEQ ID NO: 64227 - DNA, 42 bp, Homo sapiens
actccaccttactaccagacaaccttagccaaaccatttacc

SEQ ID NO: 64228 - DNA, 30 bp, Homo sapiens; identical to SEQ ID NO: 856

SEQ ID NO: 64229 - DNA, 43 bp, Homo sapiens
actccaccttactaccagacaaccttagccaaaccatttaccc

SEQ ID NO: 64230 - DNA, 44 bp, Homo sapiens
actccaccttactaccagacaaccttagccaaaccatttaccca

SEQ ID NO: 64231 - DNA, 16 bp, Homo sapiens
actccaccttactacc

SEQ ID NO: 64232 - DNA, 17 bp, Homo sapiens
actccaccttactacca

SEQ ID NO: 64233 - DNA, 36 bp, Homo sapiens
actccaccttactaccagacaaccttagccaaacca

SEQ ID NO: 64234 - DNA, 35 bp, Homo sapiens; identical to SEQ ID NO: 8922

SEQ ID NO: 64235 - DNA, 24 bp, Homo sapiens
actccaccttactaccagacaacc

SEQ ID NO: 64236 - DNA, 42 bp, Homo sapiens
ctccaccttactaccagacaaccttagccaaaccatttaccc

SEQ ID NO: 64237 - DNA, 20 bp, Homo sapiens
ctccaccttactaccagaca

SEQ ID NO: 64238 - DNA, 23 bp, Homo sapiens
ctccaccttactaccagacaacc

SEQ ID NO: 64239 - DNA, 34 bp, Homo sapiens
ctccaccttactaccagacaaccttagccaaacc

SEQ ID NO: 64240 - DNA, 35 bp, Homo sapiens
ctccaccttactaccagacaaccttagccaaacca

SEQ ID NO: 64241 - DNA, 32 bp, Homo sapiens; identical to SEQ ID NO: 8926

SEQ ID NO: 64242 - DNA, 33 bp, Homo sapiens
ccaccttactaccagacaaccttagccaaacca

SEQ ID NO: 64243 - DNA, 19 bp, Homo sapiens
accttactaccagacaacc

SEQ ID NO: 64244 - DNA, 30 bp, Homo sapiens; identical to SEQ ID NO: 860

SEQ ID NO: 64245 - DNA, 31 bp, Homo sapiens; identical to SEQ ID NO: 8938

SEQ ID NO: 64246 - DNA, 38 bp, Homo sapiens; identical to SEQ ID NO: 8941

SEQ ID NO: 64247 - DNA, 39 bp, Homo sapiens; identical to SEQ ID NO: 8942

SEQ ID NO: 64248 - DNA, 30 bp, Homo sapiens
ccttactaccagacaaccttagccaaacca

SEQ ID NO: 64249 - DNA, 17 bp, Homo sapiens
accagacaaccttagcc

SEQ ID NO: 64250 - DNA, 31 bp, Homo sapiens; identical to SEQ ID NO: 8980

SEQ ID NO: 64251 - DNA, 19 bp, Homo sapiens
agacaaccttagccaaacc

SEQ ID NO: 64252 - DNA, 20 bp, Homo sapiens
agacaaccttagccaaacca

SEQ ID NO: 64253 - DNA, 26 bp, Homo sapiens
agacaaccttagccaaaccatttacc

SEQ ID NO: 64254 - DNA, 27 bp, Homo sapiens
agacaaccttagccaaaccatttaccc

SEQ ID NO: 64255 - DNA, 28 bp, Homo sapiens
agacaaccttagccaaaccatttaccca

SEQ ID NO: 64256 - DNA, 18 bp, Homo sapiens
gacaaccttagccaaacc

SEQ ID NO: 64257 - DNA, 19 bp, Homo sapiens
gacaaccttagccaaacca

SEQ ID NO: 64258 - DNA, 26 bp, Homo sapiens
gacaaccttagccaaaccatttaccc

SEQ ID NO: 64259 - DNA, 27 bp, Homo sapiens
gacaaccttagccaaaccatttaccca

SEQ ID NO: 64260 - DNA, 24 bp, Homo sapiens
aaccttagccaaaccatttaccca

SEQ ID NO: 64261 - DNA, 23 bp, Homo sapiens
accttagccaaaccatttaccca

SEQ ID NO: 64262 - DNA, 18 bp, Homo sapiens
ttagccaaaccatttacc

SEQ ID NO: 64263 - DNA, 20 bp, Homo sapiens
ttagccaaaccatttaccca

SEQ ID NO: 64264 - DNA, 19 bp, Homo sapiens
ttagccaaaccatttaccc

SEQ ID NO: 64265 - DNA, 19 bp, Homo sapiens
tagccaaaccatttaccca

SEQ ID NO: 64266 - DNA, 35 bp, Homo sapiens; identical to SEQ ID NO: 9028

SEQ ID NO: 64267 - DNA, 42 bp, Homo sapiens; identical to SEQ ID NO: 9032

SEQ ID NO: 64268 - DNA, 34 bp, Homo sapiens; identical to SEQ ID NO: 9037

SEQ ID NO: 64269 - DNA, 41 bp, Homo sapiens; identical to SEQ ID NO: 9041

SEQ ID NO: 64270 - DNA, 40 bp, Homo sapiens; identical to SEQ ID NO: 9048

SEQ ID NO: 64271 - DNA, 40 bp, Homo sapiens
aagcataatatagcaaggactaacccctataccttctgca

SEQ ID NO: 64272 - DNA, 39 bp, Homo sapiens
agcataatatagcaaggactaacccctataccttctgca

SEQ ID NO: 64273 - DNA, 36 bp, Homo sapiens; identical to SEQ ID NO: 9389

SEQ ID NO: 64274 - DNA, 41 bp, Homo sapiens
actttgcaaggagagccaaagctaagacccccgaaaccaga

SEQ ID NO: 64275 - DNA, 28 bp, Homo sapiens
actttgcaaggagagccaaagctaagac

SEQ ID NO: 64276 - DNA, 33 bp, Homo sapiens; identical to SEQ ID NO: 9386

SEQ ID NO: 64277 - DNA, 34 bp, Homo sapiens; identical to SEQ ID NO: 9387

SEQ ID NO: 64278 - DNA, 29 bp, Homo sapiens
actttgcaaggagagccaaagctaagacc

SEQ ID NO: 64279 - DNA, 35 bp, Homo sapiens; identical to SEQ ID NO: 9388

SEQ ID NO: 64280 - DNA, 44 bp, Homo sapiens; identical to SEQ ID NO: 9436

SEQ ID NO: 64281 - DNA, 43 bp, Homo sapiens
gaaaccagacgagctacctaagaacagctaaaagagcacaccc

SEQ ID NO: 64282 - DNA, 40 bp, Homo sapiens
gaaaccagacgagctacctaagaacagctaaaagagcaca

SEQ ID NO: 64283 - DNA, 42 bp, Homo sapiens; identical to SEQ ID NO: 9449

SEQ ID NO: 64284 - DNA, 20 bp, Homo sapiens
agacgagctacctaagaaca

SEQ ID NO: 64285 - DNA, 32 bp, Homo sapiens
agacgagctacctaagaacagctaaaagagca

SEQ ID NO: 64286 - DNA, 34 bp, Homo sapiens
agacgagctacctaagaacagctaaaagagcaca

SEQ ID NO: 64287 - DNA, 36 bp, Homo sapiens; identical to SEQ ID NO: 9465

SEQ ID NO: 64288 - DNA, 37 bp, Homo sapiens; identical to SEQ ID NO: 9466

SEQ ID NO: 64289 - DNA, 19 bp, Homo sapiens
gacgagctacctaagaaca

SEQ ID NO: 64290 - DNA, 31 bp, Homo sapiens
gacgagctacctaagaacagctaaaagagca

SEQ ID NO: 64291 - DNA, 33 bp, Homo sapiens
gacgagctacctaagaacagctaaaagagcaca

SEQ ID NO: 64292 - DNA, 35 bp, Homo sapiens; identical to SEQ ID NO: 9473

SEQ ID NO: 64293 - DNA, 36 bp, Homo sapiens; identical to SEQ ID NO: 9474

SEQ ID NO: 64294 - DNA, 16 bp, Homo sapiens
gagctacctaagaaca

SEQ ID NO: 64295 - DNA, 23 bp, Homo sapiens
agaacagctaaaagagcacaccc

SEQ ID NO: 64296 - DNA, 21 bp, Homo sapiens
gaacagctaaaagagcacacc

SEQ ID NO: 64297 - DNA, 22 bp, Homo sapiens
gaacagctaaaagagcacaccc

SEQ ID NO: 64298 - DNA, 18 bp, Homo sapiens
aacagctaaaagagcaca

SEQ ID NO: 64299 - DNA, 20 bp, Homo sapiens
aacagctaaaagagcacacc

SEQ ID NO: 64300 - DNA, 21 bp, Homo sapiens
aacagctaaaagagcacaccc

SEQ ID NO: 64301 - DNA, 22 bp, Homo sapiens
aacagctaaaagagcacacccg

SEQ ID NO: 64302 - DNA, 33 bp, Homo sapiens
aacagctaaaagagcacacccgtctatgtagca

SEQ ID NO: 64303 - DNA, 18 bp, Homo sapiens
cagctaaaagagcacacc

SEQ ID NO: 64304 - DNA, 31 bp, Homo sapiens; identical to SEQ ID NO: 1033

SEQ ID NO: 64305 - DNA, 17 bp, Homo sapiens
agctaaaagagcacacc

SEQ ID NO: 64306 - DNA, 24 bp, Homo sapiens
aagagcacacccgtctatgtagca

SEQ ID NO: 64307 - DNA, 23 bp, Homo sapiens
agagcacacccgtctatgtagca

SEQ ID NO: 64308 - DNA, 22 bp, Homo sapiens
gagcacacccgtctatgtagca

SEQ ID NO: 64309 - DNA, 21 bp, Homo sapiens
agcacacccgtctatgtagca

SEQ ID NO: 64310 - DNA, 20 bp, Homo sapiens
gcacacccgtctatgtagca

SEQ ID NO: 64311 - DNA, 19 bp, Homo sapiens
cacacccgtctatgtagca

SEQ ID NO: 64312 - DNA, 18 bp, Homo sapiens
acacccgtctatgtagca

SEQ ID NO: 64313 - DNA, 17 bp, Homo sapiens
cacccgtctatgtagca

SEQ ID NO: 64314 - DNA, 16 bp, Homo sapiens
acccgtctatgtagca

SEQ ID NO: 64315 - DNA, 35 bp, Homo sapiens
acaaacctaccgagcctggtgatagctggttgtcc

SEQ ID NO: 64316 - DNA, 37 bp, Homo sapiens
acaaacctaccgagcctggtgatagctggttgtccaa

SEQ ID NO: 64317 - DNA, 36 bp, Homo sapiens
acaaacctaccgagcctggtgatagctggttgtcca

SEQ ID NO: 64318 - DNA, 32 bp, Homo sapiens
aacctaccgagcctggtgatagctggttgtcc

SEQ ID NO: 64319 - DNA, 33 bp, Homo sapiens
aacctaccgagcctggtgatagctggttgtcca

SEQ ID NO: 64320 - DNA, 27 bp, Homo sapiens
taccgagcctggtgatagctggttgtc

SEQ ID NO: 64321 - DNA, 28 bp, Homo sapiens
taccgagcctggtgatagctggttgtcc

SEQ ID NO: 64322 - DNA, 28 bp, Homo sapiens
accgagcctggtgatagctggttgtcca

SEQ ID NO: 64323 - DNA, 24 bp, Homo sapiens
cgagcctggtgatagctggttgtc

SEQ ID NO: 64324 - DNA, 25 bp, Homo sapiens
cgagcctggtgatagctggttgtcc

SEQ ID NO: 64325 - DNA, 26 bp, Homo sapiens
cgagcctggtgatagctggttgtcca

SEQ ID NO: 64326 - DNA, 36 bp, Homo sapiens
gagcctggtgatagctggttgtccaagatagaatct

SEQ ID NO: 64327 - DNA, 28 bp, Homo sapiens
gagcctggtgatagctggttgtccaaga

SEQ ID NO: 64328 - DNA, 26 bp, Homo sapiens
gagcctggtgatagctggttgtccaa

SEQ ID NO: 64329 - DNA, 30 bp, Homo sapiens; identical to SEQ ID NO: 1082

SEQ ID NO: 64330 - DNA, 35 bp, Homo sapiens; identical to SEQ ID NO: 9622

SEQ ID NO: 64331 - DNA, 24 bp, Homo sapiens
gagcctggtgatagctggttgtcc

SEQ ID NO: 64332 - DNA, 23 bp, Homo sapiens
gagcctggtgatagctggttgtc

SEQ ID NO: 64333 - DNA, 25 bp, Homo sapiens
gagcctggtgatagctggttgtcca

SEQ ID NO: 64334 - DNA, 25 bp, Homo sapiens
agcctggtgatagctggttgtccaa

SEQ ID NO: 64335 - DNA, 22 bp, Homo sapiens
agcctggtgatagctggttgtc

SEQ ID NO: 64336 - DNA, 24 bp, Homo sapiens
agcctggtgatagctggttgtcca

SEQ ID NO: 64337 - DNA, 32 bp, Homo sapiens; identical to SEQ ID NO: 9662

SEQ ID NO: 64338 - DNA, 31 bp, Homo sapiens; identical to SEQ ID NO: 9664

SEQ ID NO: 64339 - DNA, 19 bp, Homo sapiens
acagaaccctctaaatccc

SEQ ID NO: 64340 - DNA, 17 bp, Homo sapiens
gaaccctctaaatcccc

SEQ ID NO: 64341 - DNA, 19 bp, Homo sapiens
gttagtccaaagaggaaca

SEQ ID NO: 64342 - DNA, 16 bp, Homo sapiens
agtccaaagaggaaca

SEQ ID NO: 64343 - DNA, 22 bp, Homo sapiens
aggaacagctctttggacacta

SEQ ID NO: 64344 - DNA, 16 bp, Homo sapiens
gctctttggacactag

SEQ ID NO: 64345 - DNA, 17 bp, Homo sapiens
gctctttggacactagg

SEQ ID NO: 64346 - DNA, 19 bp, Homo sapiens
gctctttggacactaggaa

SEQ ID NO: 64347 - DNA, 25 bp, Homo sapiens
gctctttggacactaggaaaaaacc

SEQ ID NO: 64348 - DNA, 18 bp, Homo sapiens
gctctttggacactagga

SEQ ID NO: 64349 - DNA, 43 bp, Homo sapiens
gacactaggaaaaaaccttgtagagagagtaaaaaatttaaca

SEQ ID NO: 64350 - DNA, 45 bp, Homo sapiens
gacactaggaaaaaaccttgtagagagagtaaaaaatttaacacc

SEQ ID NO: 64351 - DNA, 32 bp, Homo sapiens
aacacccatagtaggcctaaaagcagccacca

SEQ ID NO: 64352 - DNA, 31 bp, Homo sapiens; identical to SEQ ID NO: 1197

SEQ ID NO: 64353 - DNA, 30 bp, Homo sapiens; identical to SEQ ID NO: 9971

SEQ ID NO: 64354 - DNA, 28 bp, Homo sapiens
cccatagtaggcctaaaagcagccacca

SEQ ID NO: 64355 - DNA, 40 bp, Homo sapiens
cccatagtaggcctaaaagcagccaccaattaagaaagcg

SEQ ID NO: 64356 - DNA, 27 bp, Homo sapiens
cccatagtaggcctaaaagcagccacc

SEQ ID NO: 64357 - DNA, 26 bp, Homo sapiens
ccatagtaggcctaaaagcagccacc

SEQ ID NO: 64358 - DNA, 38 bp, Homo sapiens
catagtaggcctaaaagcagccaccaattaagaaagcg

SEQ ID NO: 64359 - DNA, 26 bp, Homo sapiens
catagtaggcctaaaagcagccacca

SEQ ID NO: 64360 - DNA, 25 bp, Homo sapiens
catagtaggcctaaaagcagccacc

SEQ ID NO: 64361 - DNA, 46 bp, Homo sapiens
ggcctaaaagcagccaccaattaagaaagcgttcaagctcaacacc

SEQ ID NO: 64362 - DNA, 38 bp, Homo sapiens
agcagccaccaattaagaaagcgttcaagctcaacacc

SEQ ID NO: 64363 - DNA, 39 bp, Homo sapiens
agcagccaccaattaagaaagcgttcaagctcaacaccc

SEQ ID NO: 64364 - DNA, 38 bp, Homo sapiens
gcagccaccaattaagaaagcgttcaagctcaacaccc

SEQ ID NO: 64365 - DNA, 37 bp, Homo sapiens
gcagccaccaattaagaaagcgttcaagctcaacacc

SEQ ID NO: 64366 - DNA, 36 bp, Homo sapiens
gccaccaattaagaaagcgttcaagctcaacaccca

SEQ ID NO: 64367 - DNA, 34 bp, Homo sapiens
gccaccaattaagaaagcgttcaagctcaacacc

SEQ ID NO: 64368 - DNA, 35 bp, Homo sapiens
gccaccaattaagaaagcgttcaagctcaacaccc

SEQ ID NO: 64369 - DNA, 33 bp, Homo sapiens
ccaccaattaagaaagcgttcaagctcaacacc

SEQ ID NO: 64370 - DNA, 33 bp, Homo sapiens
accaattaagaaagcgttcaagctcaacaccca

SEQ ID NO: 64371 - DNA, 35 bp, Homo sapiens
accaattaagaaagcgttcaagctcaacacccact

SEQ ID NO: 64372 - DNA, 31 bp, Homo sapiens
accaattaagaaagcgttcaagctcaacacc

SEQ ID NO: 64373 - DNA, 32 bp, Homo sapiens
accaattaagaaagcgttcaagctcaacaccc

SEQ ID NO: 64374 - DNA, 18 bp, Homo sapiens
gcgttcaagctcaacacc

SEQ ID NO: 64375 - DNA, 18 bp, Homo sapiens
cactacctaaaaaatccc

SEQ ID NO: 64376 - DNA, 19 bp, Homo sapiens
cactacctaaaaaatccca

SEQ ID NO: 64377 - DNA, 23 bp, Homo sapiens
cactacctaaaaaatcccaaaca

SEQ ID NO: 64378 - DNA, 22 bp, Homo sapiens
actacctaaaaaatcccaaaca

SEQ ID NO: 64379 - DNA, 17 bp, Homo sapiens
actacctaaaaaatccc

SEQ ID NO: 64380 - DNA, 43 bp, Homo sapiens; identical to SEQ ID NO: 10030

SEQ ID NO: 64381 - DNA, 44 bp, Homo sapiens; identical to SEQ ID NO: 10031

SEQ ID NO: 64382 - DNA, 18 bp, Homo sapiens
actacctaaaaaatccca

SEQ ID NO: 64383 - DNA, 43 bp, Homo sapiens; identical to SEQ ID NO: 10034

SEQ ID NO: 64384 - DNA, 33 bp, Homo sapiens; identical to SEQ ID NO: 1222

SEQ ID NO: 64385 - DNA, 38 bp, Homo sapiens
ccaaacatataactgaactcctcacacccaattggacc

SEQ ID NO: 64386 - DNA, 27 bp, Homo sapiens
caaacatataactgaactcctcacacc

SEQ ID NO: 64387 - DNA, 28 bp, Homo sapiens
caaacatataactgaactcctcacaccc

SEQ ID NO: 64388 - DNA, 26 bp, Homo sapiens
aaacatataactgaactcctcacacc

SEQ ID NO: 64389 - DNA, 27 bp, Homo sapiens
aaacatataactgaactcctcacaccc

SEQ ID NO: 64390 - DNA, 25 bp, Homo sapiens
aacatataactgaactcctcacacc

SEQ ID NO: 64391 - DNA, 26 bp, Homo sapiens
aacatataactgaactcctcacaccc

SEQ ID NO: 64392 - DNA, 18 bp, Homo sapiens
actgaactcctcacaccc

SEQ ID NO: 64393 - DNA, 18 bp, Homo sapiens
ggaccaatctatcaccct

SEQ ID NO: 64394 - DNA, 19 bp, Homo sapiens
ggaccaatctatcacccta

SEQ ID NO: 64395 - DNA, 17 bp, Homo sapiens
gaccaatctatcaccct

SEQ ID NO: 64396 - DNA, 28 bp, Homo sapiens
gaccaatctatcaccctatagaagaact

SEQ ID NO: 64397 - DNA, 18 bp, Homo sapiens
gaccaatctatcacccta

SEQ ID NO: 64398 - DNA, 46 bp, Homo sapiens; identical to SEQ ID NO: 10438

SEQ ID NO: 64399 - DNA, 45 bp, Homo sapiens; identical to SEQ ID NO: 10461

SEQ ID NO: 64400 - DNA, 45 bp, Homo sapiens
aagcctgcgtcagattaaaacactgaactgacaattaacagccca

SEQ ID NO: 64401 - DNA, 44 bp, Homo sapiens; identical to SEQ ID NO: 10473

SEQ ID NO: 64402 - DNA, 43 bp, Homo sapiens
aagcctgcgtcagattaaaacactgaactgacaattaacagcc

SEQ ID NO: 64403 - DNA, 42 bp, Homo sapiens
agcctgcgtcagattaaaacactgaactgacaattaacagcc

SEQ ID NO: 64404 - DNA, 44 bp, Homo sapiens
agcctgcgtcagattaaaacactgaactgacaattaacagccca

SEQ ID NO: 64405 - DNA, 43 bp, Homo sapiens; identical to SEQ ID NO: 10485

SEQ ID NO: 64406 - DNA, 41 bp, Homo sapiens
gcctgcgtcagattaaaacactgaactgacaattaacagcc

SEQ ID NO: 64407 - DNA, 42 bp, Homo sapiens
gcctgcgtcagattaaaacactgaactgacaattaacagccc

SEQ ID NO: 64408 - DNA, 19 bp, Homo sapiens
tgcgtcagattaaaacact

SEQ ID NO: 64409 - DNA, 28 bp, Homo sapiens
tgcgtcagattaaaacactgaactgaca

SEQ ID NO: 64410 - DNA, 17 bp, Homo sapiens
tgcgtcagattaaaaca

SEQ ID NO: 64411 - DNA, 27 bp, Homo sapiens
aaacactgaactgacaattaacagccc

SEQ ID NO: 64412 - DNA, 26 bp, Homo sapiens
aacactgaactgacaattaacagccc

SEQ ID NO: 64413 - DNA, 43 bp, Homo sapiens
aacactgaactgacaattaacagcccaatatctacaatcaacc

SEQ ID NO: 64414 - DNA, 25 bp, Homo sapiens
acactgaactgacaattaacagccc

SEQ ID NO: 64415 - DNA, 35 bp, Homo sapiens
acactgaactgacaattaacagcccaatatctaca

SEQ ID NO: 64416 - DNA, 23 bp, Homo sapiens
ctgaactgacaattaacagccca

SEQ ID NO: 64417 - DNA, 39 bp, Homo sapiens
ctgaactgacaattaacagcccaatatctacaatcaacc

SEQ ID NO: 64418 - DNA, 21 bp, Homo sapiens
ctgaactgacaattaacagcc

SEQ ID NO: 64419 - DNA, 22 bp, Homo sapiens
ctgaactgacaattaacagccc

SEQ ID NO: 64420 - DNA, 21 bp, Homo sapiens
gaactgacaattaacagccca

SEQ ID NO: 64421 - DNA, 30 bp, Homo sapiens
gaactgacaattaacagcccaatatctaca

SEQ ID NO: 64422 - DNA, 38 bp, Homo sapiens
gaactgacaattaacagcccaatatctacaatcaacca

SEQ ID NO: 64423 - DNA, 41 bp, Homo sapiens
gaactgacaattaacagcccaatatctacaatcaaccaaca

SEQ ID NO: 64424 - DNA, 37 bp, Homo sapiens
gaactgacaattaacagcccaatatctacaatcaacc

SEQ ID NO: 64425 - DNA, 19 bp, Homo sapiens
gaactgacaattaacagcc

SEQ ID NO: 64426 - DNA, 20 bp, Homo sapiens
gaactgacaattaacagccc

SEQ ID NO: 64427 - DNA, 41 bp, Homo sapiens
gacaattaacagcccaatatctacaatcaaccaacaagtca

SEQ ID NO: 64428 - DNA, 19 bp, Homo sapiens
gacaattaacagcccaata

SEQ ID NO: 64429 - DNA, 25 bp, Homo sapiens
gacaattaacagcccaatatctaca

SEQ ID NO: 64430 - DNA, 28 bp, Homo sapiens
gacaattaacagcccaatatctacaatc

SEQ ID NO: 64431 - DNA, 33 bp, Homo sapiens
gacaattaacagcccaatatctacaatcaacca

SEQ ID NO: 64432 - DNA, 36 bp, Homo sapiens
gacaattaacagcccaatatctacaatcaaccaaca

SEQ ID NO: 64433 - DNA, 40 bp, Homo sapiens
gacaattaacagcccaatatctacaatcaaccaacaagtc

SEQ ID NO: 64434 - DNA, 32 bp, Homo sapiens; identical to SEQ ID NO: 10536

SEQ ID NO: 64435 - DNA, 25 bp, Homo sapiens
aacagcccaatatctacaatcaacc

SEQ ID NO: 64436 - DNA, 28 bp, Homo sapiens
acagcccaatatctacaatcaaccaaca

SEQ ID NO: 64437 - DNA, 25 bp, Homo sapiens
acagcccaatatctacaatcaacca

SEQ ID NO: 64438 - DNA, 24 bp, Homo sapiens
acagcccaatatctacaatcaacc

SEQ ID NO: 64439 - DNA, 23 bp, Homo sapiens
agcccaatatctacaatcaacca

SEQ ID NO: 64440 - DNA, 26 bp, Homo sapiens
agcccaatatctacaatcaaccaaca

SEQ ID NO: 64441 - DNA, 22 bp, Homo sapiens
agcccaatatctacaatcaacc

SEQ ID NO: 64442 - DNA, 44 bp, Homo sapiens
gcccaatatctacaatcaaccaacaagtcattattaccctcact

SEQ ID NO: 64443 - DNA, 38 bp, Homo sapiens
gcccaatatctacaatcaaccaacaagtcattattacc

SEQ ID NO: 64444 - DNA, 39 bp, Homo sapiens
gcccaatatctacaatcaaccaacaagtcattattaccc

SEQ ID NO: 64445 - DNA, 25 bp, Homo sapiens
gcccaatatctacaatcaaccaaca

SEQ ID NO: 64446 - DNA, 29 bp, Homo sapiens
gcccaatatctacaatcaaccaacaagtc

SEQ ID NO: 64447 - DNA, 30 bp, Homo sapiens
gcccaatatctacaatcaaccaacaagtca

SEQ ID NO: 64448 - DNA, 21 bp, Homo sapiens
gcccaatatctacaatcaacc

SEQ ID NO: 64449 - DNA, 22 bp, Homo sapiens
gcccaatatctacaatcaacca

SEQ ID NO: 64450 - DNA, 35 bp, Homo sapiens; identical to SEQ ID NO: 10556

SEQ ID NO: 64451 - DNA, 41 bp, Homo sapiens; identical to SEQ ID NO: 10557

SEQ ID NO: 64452 - DNA, 19 bp, Homo sapiens
caatatctacaatcaacca

SEQ ID NO: 64453 - DNA, 22 bp, Homo sapiens
caatatctacaatcaaccaaca

SEQ ID NO: 64454 - DNA, 20 bp, Homo sapiens
atatctacaatcaaccaaca

SEQ ID NO: 64455 - DNA, 18 bp, Homo sapiens
atctacaatcaaccaaca

SEQ ID NO: 64456 - DNA, 40 bp, Homo sapiens
acaatcaaccaacaagtcattattaccctcactgtcaacc

SEQ ID NO: 64457 - DNA, 41 bp, Homo sapiens
acaatcaaccaacaagtcattattaccctcactgtcaaccc

SEQ ID NO: 64458 - DNA, 37 bp, Homo sapiens
atcaaccaacaagtcattattaccctcactgtcaacc

SEQ ID NO: 64459 - DNA, 38 bp, Homo sapiens
atcaaccaacaagtcattattaccctcactgtcaaccc

SEQ ID NO: 64460 - DNA, 36 bp, Homo sapiens
caaccaacaagtcattattaccctcactgtcaaccc

SEQ ID NO: 64461 - DNA, 34 bp, Homo sapiens; identical to SEQ ID NO: 10581

SEQ ID NO: 64462 - DNA, 35 bp, Homo sapiens; identical to SEQ ID NO: 10582

SEQ ID NO: 64463 - DNA, 24 bp, Homo sapiens
accaacaagtcattattaccctca

SEQ ID NO: 64464 - DNA, 35 bp, Homo sapiens
accaacaagtcattattaccctcactgtcaaccca

SEQ ID NO: 64465 - DNA, 38 bp, Homo sapiens
accaacaagtcattattaccctcactgtcaacccaaca

SEQ ID NO: 64466 - DNA, 33 bp, Homo sapiens; identical to SEQ ID NO: 10585

SEQ ID NO: 64467 - DNA, 34 bp, Homo sapiens; identical to SEQ ID NO: 10586

SEQ ID NO: 64468 - DNA, 31 bp, Homo sapiens; identical to SEQ ID NO: 1440

SEQ ID NO: 64469 - DNA, 27 bp, Homo sapiens
agtcattattaccctcactgtcaaccc

SEQ ID NO: 64470 - DNA, 19 bp, Homo sapiens
aacccaacacaggcatgct

SEQ ID NO: 64471 - DNA, 18 bp, Homo sapiens
acccaacacaggcatgct

SEQ ID NO: 64472 - DNA, 27 bp, Homo sapiens
cggcaaatcttaccccgcctgtttacc

SEQ ID NO: 64473 - DNA, 28 bp, Homo sapiens
cggcaaatcttaccccgcctgtttacca

SEQ ID NO: 64474 - DNA, 26 bp, Homo sapiens
gcaaatcttaccccgcctgtttacca

SEQ ID NO: 64475 - DNA, 41 bp, Homo sapiens
taccccgcctgtttaccaaaaacatcacctctagcatcacc

SEQ ID NO: 64476 - DNA, 29 bp, Homo sapiens
accccgcctgtttaccaaaaacatcacct

SEQ ID NO: 64477 - DNA, 17 bp, Homo sapiens
accccgcctgtttacca

SEQ ID NO: 64478 - DNA, 28 bp, Homo sapiens
accccgcctgtttaccaaaaacatcacc

SEQ ID NO: 64479 - DNA, 35 bp, Homo sapiens
accccgcctgtttaccaaaaacatcacctctagca

SEQ ID NO: 64480 - DNA, 16 bp, Homo sapiens
accccgcctgtttacc

SEQ ID NO: 64481 - DNA, 40 bp, Homo sapiens
accccgcctgtttaccaaaaacatcacctctagcatcacc

SEQ ID NO: 64482 - DNA, 41 bp, Homo sapiens
accccgcctgtttaccaaaaacatcacctctagcatcacca

SEQ ID NO: 64483 - DNA, 39 bp, Homo sapiens
ccccgcctgtttaccaaaaacatcacctctagcatcacc

SEQ ID NO: 64484 - DNA, 38 bp, Homo sapiens
ccgcctgtttaccaaaaacatcacctctagcatcacca

SEQ ID NO: 64485 - DNA, 25 bp, Homo sapiens
ccgcctgtttaccaaaaacatcacc

SEQ ID NO: 64486 - DNA, 26 bp, Homo sapiens
ccgcctgtttaccaaaaacatcacct

SEQ ID NO: 64487 - DNA, 37 bp, Homo sapiens
ccgcctgtttaccaaaaacatcacctctagcatcacc

SEQ ID NO: 64488 - DNA, 25 bp, Homo sapiens
cgcctgtttaccaaaaacatcacct

SEQ ID NO: 64489 - DNA, 37 bp, Homo sapiens
cgcctgtttaccaaaaacatcacctctagcatcacca

SEQ ID NO: 64490 - DNA, 24 bp, Homo sapiens
cgcctgtttaccaaaaacatcacc

SEQ ID NO: 64491 - DNA, 36 bp, Homo sapiens
cgcctgtttaccaaaaacatcacctctagcatcacc

SEQ ID NO: 64492 - DNA, 35 bp, Homo sapiens
gcctgtttaccaaaaacatcacctctagcatcacc

SEQ ID NO: 64493 - DNA, 21 bp, Homo sapiens
gcctgtttaccaaaaacatca

SEQ ID NO: 64494 - DNA, 24 bp, Homo sapiens
gcctgtttaccaaaaacatcacct

SEQ ID NO: 64495 - DNA, 23 bp, Homo sapiens
gcctgtttaccaaaaacatcacc

SEQ ID NO: 64496 - DNA, 28 bp, Homo sapiens
accaaaaacatcacctctagcatcacca

SEQ ID NO: 64497 - DNA, 45 bp, Homo sapiens
accaaaaacatcacctctagcatcaccagtattagaggcaccgcc

SEQ ID NO: 64498 - DNA, 38 bp, Homo sapiens
aaaacatcacctctagcatcaccagtattagaggcacc

SEQ ID NO: 64499 - DNA, 39 bp, Homo sapiens
aaaacatcacctctagcatcaccagtattagaggcaccg

SEQ ID NO: 64500 - DNA, 41 bp, Homo sapiens
aaaacatcacctctagcatcaccagtattagaggcaccgcc

SEQ ID NO: 64501 - DNA, 37 bp, Homo sapiens
aaacatcacctctagcatcaccagtattagaggcacc

SEQ ID NO: 64502 - DNA, 38 bp, Homo sapiens
aaacatcacctctagcatcaccagtattagaggcaccg

SEQ ID NO: 64503 - DNA, 44 bp, Homo sapiens
aaacatcacctctagcatcaccagtattagaggcaccgcctgcc

SEQ ID NO: 64504 - DNA, 40 bp, Homo sapiens
aaacatcacctctagcatcaccagtattagaggcaccgcc

SEQ ID NO: 64505 - DNA, 19 bp, Homo sapiens
aacatcacctctagcatca

SEQ ID NO: 64506 - DNA, 21 bp, Homo sapiens
aacatcacctctagcatcacc

SEQ ID NO: 64507 - DNA, 22 bp, Homo sapiens
aacatcacctctagcatcacca

SEQ ID NO: 64508 - DNA, 41 bp, Homo sapiens
aacatcacctctagcatcaccagtattagaggcaccgcctg

SEQ ID NO: 64509 - DNA, 45 bp, Homo sapiens
aacatcacctctagcatcaccagtattagaggcaccgcctgccca

SEQ ID NO: 64510 - DNA, 46 bp, Homo sapiens
aacatcacctctagcatcaccagtattagaggcaccgcctgcccag

SEQ ID NO: 64511 - DNA, 43 bp, Homo sapiens
aacatcacctctagcatcaccagtattagaggcaccgcctgcc

SEQ ID NO: 64512 - DNA, 38 bp, Homo sapiens
aacatcacctctagcatcaccagtattagaggcaccgc

SEQ ID NO: 64513 - DNA, 36 bp, Homo sapiens
aacatcacctctagcatcaccagtattagaggcacc

SEQ ID NO: 64514 - DNA, 37 bp, Homo sapiens
aacatcacctctagcatcaccagtattagaggcaccg

SEQ ID NO: 64515 - DNA, 39 bp, Homo sapiens; identical to SEQ ID NO: 61514

SEQ ID NO: 64516 - DNA, 18 bp, Homo sapiens
acatcacctctagcatca

SEQ ID NO: 64517 - DNA, 20 bp, Homo sapiens
acatcacctctagcatcacc

SEQ ID NO: 64518 - DNA, 21 bp, Homo sapiens
acatcacctctagcatcacca

SEQ ID NO: 64519 - DNA, 40 bp, Homo sapiens
acatcacctctagcatcaccagtattagaggcaccgcctg

SEQ ID NO: 64520 - DNA, 46 bp, Homo sapiens
acatcacctctagcatcaccagtattagaggcaccgcctgcccagt

SEQ ID NO: 64521 - DNA, 42 bp, Homo sapiens
acatcacctctagcatcaccagtattagaggcaccgcctgcc

SEQ ID NO: 64522 - DNA, 37 bp, Homo sapiens
acatcacctctagcatcaccagtattagaggcaccgc

SEQ ID NO: 64523 - DNA, 35 bp, Homo sapiens
acatcacctctagcatcaccagtattagaggcacc

SEQ ID NO: 64524 - DNA, 44 bp, Homo sapiens
acatcacctctagcatcaccagtattagaggcaccgcctgccca

SEQ ID NO: 64525 - DNA, 36 bp, Homo sapiens
acatcacctctagcatcaccagtattagaggcaccg

SEQ ID NO: 64526 - DNA, 38 bp, Homo sapiens
acatcacctctagcatcaccagtattagaggcaccgcc

SEQ ID NO: 64527 - DNA, 19 bp, Homo sapiens
catcacctctagcatcacc

SEQ ID NO: 64528 - DNA, 20 bp, Homo sapiens
catcacctctagcatcacca

SEQ ID NO: 64529 - DNA, 43 bp, Homo sapiens
catcacctctagcatcaccagtattagaggcaccgcctgccca

SEQ ID NO: 64530 - DNA, 45 bp, Homo sapiens
catcacctctagcatcaccagtattagaggcaccgcctgcccagt

SEQ ID NO: 64531 - DNA, 41 bp, Homo sapiens
catcacctctagcatcaccagtattagaggcaccgcctgcc

SEQ ID NO: 64532 - DNA, 46 bp, Homo sapiens
catcacctctagcatcaccagtattagaggcaccgcctgcccagtg

SEQ ID NO: 64533 - DNA, 36 bp, Homo sapiens
catcacctctagcatcaccagtattagaggcaccgc

SEQ ID NO: 64534 - DNA, 34 bp, Homo sapiens
catcacctctagcatcaccagtattagaggcacc

SEQ ID NO: 64535 - DNA, 35 bp, Homo sapiens
catcacctctagcatcaccagtattagaggcaccg

SEQ ID NO: 64536 - DNA, 37 bp, Homo sapiens
catcacctctagcatcaccagtattagaggcaccgcc

SEQ ID NO: 64537 - DNA, 17 bp, Homo sapiens
tcacctctagcatcacc

SEQ ID NO: 64538 - DNA, 39 bp, Homo sapiens
tcacctctagcatcaccagtattagaggcaccgcctgcc

SEQ ID NO: 64539 - DNA, 16 bp, Homo sapiens
acctctagcatcacca

SEQ ID NO: 64540 - DNA, 24 bp, Homo sapiens
ctagcatcaccagtattagaggca

SEQ ID NO: 64541 - DNA, 27 bp, Homo sapiens
ctagcatcaccagtattagaggcaccg

SEQ ID NO: 64542 - DNA, 26 bp, Homo sapiens
ctagcatcaccagtattagaggcacc

SEQ ID NO: 64543 - DNA, 36 bp, Homo sapiens
agcatcaccagtattagaggcaccgcctgcccagtg

SEQ ID NO: 64544 - DNA, 37 bp, Homo sapiens
agcatcaccagtattagaggcaccgcctgcccagtga

SEQ ID NO: 64545 - DNA, 39 bp, Homo sapiens
agcatcaccagtattagaggcaccgcctgcccagtgaca

SEQ ID NO: 64546 - DNA, 30 bp, Homo sapiens
accagtattagaggcaccgcctgcccagtg

SEQ ID NO: 64547 - DNA, 31 bp, Homo sapiens
accagtattagaggcaccgcctgcccagtga

SEQ ID NO: 64548 - DNA, 30 bp, Homo sapiens
ccagtattagaggcaccgcctgcccagtga

SEQ ID NO: 64549 - DNA, 28 bp, Homo sapiens
cagtattagaggcaccgcctgcccagtg

SEQ ID NO: 64550 - DNA, 29 bp, Homo sapiens
cagtattagaggcaccgcctgcccagtga

SEQ ID NO: 64551 - DNA, 26 bp, Homo sapiens
agtattagaggcaccgcctgcccagt

SEQ ID NO: 64552 - DNA, 30 bp, Homo sapiens
agtattagaggcaccgcctgcccagtgaca

SEQ ID NO: 64553 - DNA, 32 bp, Homo sapiens
agtattagaggcaccgcctgcccagtgacaca

SEQ ID NO: 64554 - DNA, 18 bp, Homo sapiens
agtattagaggcaccgcc

SEQ ID NO: 64555 - DNA, 28 bp, Homo sapiens
agtattagaggcaccgcctgcccagtga

SEQ ID NO: 64556 - DNA, 27 bp, Homo sapiens
agtattagaggcaccgcctgcccagtg

SEQ ID NO: 64557 - DNA, 27 bp, Homo sapiens
gtattagaggcaccgcctgcccagtga

SEQ ID NO: 64558 - DNA, 17 bp, Homo sapiens
gcctgcccagtgacaca

SEQ ID NO: 64559 - DNA, 36 bp, Homo sapiens; identical to SEQ ID NO: 10814

SEQ ID NO: 64560 - DNA, 23 bp, Homo sapiens
tgcccagtgacacatgtttaacg

SEQ ID NO: 64561 - DNA, 34 bp, Homo sapiens; identical to SEQ ID NO: 10812

SEQ ID NO: 64562 - DNA, 35 bp, Homo sapiens; identical to SEQ ID NO: 10813

SEQ ID NO: 64563 - DNA, 37 bp, Homo sapiens; identical to SEQ ID NO: 10815

SEQ ID NO: 64564 - DNA, 20 bp, Homo sapiens
gcccagtgacacatgtttaa

SEQ ID NO: 64565 - DNA, 35 bp, Homo sapiens
gcccagtgacacatgtttaacggccgcggtaccct

SEQ ID NO: 64566 - DNA, 33 bp, Homo sapiens; identical to SEQ ID NO: 1520

SEQ ID NO: 64567 - DNA, 34 bp, Homo sapiens; identical to SEQ ID NO: 10817

SEQ ID NO: 64568 - DNA, 22 bp, Homo sapiens
gcccagtgacacatgtttaacg

SEQ ID NO: 64569 - DNA, 36 bp, Homo sapiens
gcccagtgacacatgtttaacggccgcggtacccta

SEQ ID NO: 64570 - DNA, 32 bp, Homo sapiens; identical to SEQ ID NO: 1521

SEQ ID NO: 64571 - DNA, 35 bp, Homo sapiens; identical to SEQ ID NO: 10821

SEQ ID NO: 64572 - DNA, 17 bp, Homo sapiens
cagtgacacatgtttaa

SEQ ID NO: 64573 - DNA, 22 bp, Homo sapiens
cagtgacacatgtttaacggcc

SEQ ID NO: 64574 - DNA, 24 bp, Homo sapiens
cagtgacacatgtttaacggccgc

SEQ ID NO: 64575 - DNA, 32 bp, Homo sapiens; identical to SEQ ID NO: 1527

SEQ ID NO: 64576 - DNA, 30 bp, Homo sapiens; identical to SEQ ID NO: 1525

SEQ ID NO: 64577 - DNA, 31 bp, Homo sapiens; identical to SEQ ID NO: 1526

SEQ ID NO: 64578 - DNA, 19 bp, Homo sapiens
cagtgacacatgtttaacg

SEQ ID NO: 64579 - DNA, 33 bp, Homo sapiens; identical to SEQ ID NO: 1528

SEQ ID NO: 64580 - DNA, 16 bp, Homo sapiens
agtgacacatgtttaa

SEQ ID NO: 64581 - DNA, 21 bp, Homo sapiens
agtgacacatgtttaacggcc

SEQ ID NO: 64582 - DNA, 31 bp, Homo sapiens; identical to SEQ ID NO: 1533

SEQ ID NO: 64583 - DNA, 18 bp, Homo sapiens
agtgacacatgtttaacg

SEQ ID NO: 64584 - DNA, 29 bp, Homo sapiens
agtgacacatgtttaacggccgcggtacc

SEQ ID NO: 64585 - DNA, 30 bp, Homo sapiens; identical to SEQ ID NO: 1532

SEQ ID NO: 64586 - DNA, 32 bp, Homo sapiens; identical to SEQ ID NO: 1534

SEQ ID NO: 64587 - DNA, 20 bp, Homo sapiens
gtgacacatgtttaacggcc

SEQ ID NO: 64588 - DNA, 30 bp, Homo sapiens; identical to SEQ ID NO: 1537

SEQ ID NO: 64589 - DNA, 17 bp, Homo sapiens
gtgacacatgtttaacg

SEQ ID NO: 64590 - DNA, 31 bp, Homo sapiens; identical to SEQ ID NO: 1538

SEQ ID NO: 64591 - DNA, 27 bp, Homo sapiens
tgacacatgtttaacggccgcggtacc

SEQ ID NO: 64592 - DNA, 28 bp, Homo sapiens
tgacacatgtttaacggccgcggtaccc

SEQ ID NO: 64593 - DNA, 30 bp, Homo sapiens; identical to SEQ ID NO: 1543

SEQ ID NO: 64594 - DNA, 28 bp, Homo sapiens
gacacatgtttaacggccgcggtaccct

SEQ ID NO: 64595 - DNA, 26 bp, Homo sapiens
gacacatgtttaacggccgcggtacc

SEQ ID NO: 64596 - DNA, 27 bp, Homo sapiens
gacacatgtttaacggccgcggtaccc

SEQ ID NO: 64597 - DNA, 29 bp, Homo sapiens
gacacatgtttaacggccgcggtacccta

SEQ ID NO: 64598 - DNA, 25 bp, Homo sapiens
acacatgtttaacggccgcggtacc

SEQ ID NO: 64599 - DNA, 28 bp, Homo sapiens
acacatgtttaacggccgcggtacccta

SEQ ID NO: 64600 - DNA, 25 bp, Homo sapiens
cacatgtttaacggccgcggtaccc

SEQ ID NO: 64601 - DNA, 26 bp, Homo sapiens
cacatgtttaacggccgcggtaccct

SEQ ID NO: 64602 - DNA, 24 bp, Homo sapiens
cacatgtttaacggccgcggtacc

SEQ ID NO: 64603 - DNA, 27 bp, Homo sapiens
cacatgtttaacggccgcggtacccta

SEQ ID NO: 64604 - DNA, 23 bp, Homo sapiens
acatgtttaacggccgcggtacc

SEQ ID NO: 64605 - DNA, 24 bp, Homo sapiens
acatgtttaacggccgcggtaccc

SEQ ID NO: 64606 - DNA, 25 bp, Homo sapiens
acatgtttaacggccgcggtaccct

SEQ ID NO: 64607 - DNA, 26 bp, Homo sapiens
acatgtttaacggccgcggtacccta

SEQ ID NO: 64608 - DNA, 34 bp, Homo sapiens
acatgtttaacggccgcggtaccctaaccgtgca

SEQ ID NO: 64609 - DNA, 24 bp, Homo sapiens
catgtttaacggccgcggtaccct

SEQ ID NO: 64610 - DNA, 22 bp, Homo sapiens
catgtttaacggccgcggtacc

SEQ ID NO: 64611 - DNA, 23 bp, Homo sapiens
catgtttaacggccgcggtaccc

SEQ ID NO: 64612 - DNA, 25 bp, Homo sapiens
catgtttaacggccgcggtacccta

SEQ ID NO: 64613 - DNA, 22 bp, Homo sapiens
gtttaacggccgcggtacccta

SEQ ID NO: 64614 - DNA, 16 bp, Homo sapiens
aacggccgcggtaccc

SEQ ID NO: 64615 - DNA, 17 bp, Homo sapiens
aacggccgcggtaccct

SEQ ID NO: 64616 - DNA, 33 bp, Homo sapiens
aacggccgcggtaccctaaccgtgcaaaggtag

SEQ ID NO: 64617 - DNA, 37 bp, Homo sapiens
aacggccgcggtaccctaaccgtgcaaaggtagcata

SEQ ID NO: 64618 - DNA, 18 bp, Homo sapiens
aacggccgcggtacccta

SEQ ID NO: 64619 - DNA, 35 bp, Homo sapiens
aacggccgcggtaccctaaccgtgcaaaggtagca

SEQ ID NO: 64620 - DNA, 30 bp, Homo sapiens
acggccgcggtaccctaaccgtgcaaaggt

SEQ ID NO: 64621 - DNA, 36 bp, Homo sapiens
acggccgcggtaccctaaccgtgcaaaggtagcata

SEQ ID NO: 64622 - DNA, 17 bp, Homo sapiens
acggccgcggtacccta

SEQ ID NO: 64623 - DNA, 34 bp, Homo sapiens
acggccgcggtaccctaaccgtgcaaaggtagca

SEQ ID NO: 64624 - DNA, 35 bp, Homo sapiens
cggccgcggtaccctaaccgtgcaaaggtagcata

SEQ ID NO: 64625 - DNA, 16 bp, Homo sapiens
cggccgcggtacccta

SEQ ID NO: 64626 - DNA, 34 bp, Homo sapiens
ggccgcggtaccctaaccgtgcaaaggtagcata

SEQ ID NO: 64627 - DNA, 32 bp, Homo sapiens
ggccgcggtaccctaaccgtgcaaaggtagca

SEQ ID NO: 64628 - DNA, 19 bp, Homo sapiens
gccgcggtaccctaaccgt

SEQ ID NO: 64629 - DNA, 37 bp, Homo sapiens
gccgcggtaccctaaccgtgcaaaggtagcataatca

SEQ ID NO: 64630 - DNA, 31 bp, Homo sapiens
gccgcggtaccctaaccgtgcaaaggtagca

SEQ ID NO: 64631 - DNA, 17 bp, Homo sapiens
gccgcggtaccctaacc

SEQ ID NO: 64632 - DNA, 33 bp, Homo sapiens
gccgcggtaccctaaccgtgcaaaggtagcata

SEQ ID NO: 64633 - DNA, 30 bp, Homo sapiens
gcggtaccctaaccgtgcaaaggtagcata

SEQ ID NO: 64634 - DNA, 17 bp, Homo sapiens
ggtaccctaaccgtgca

SEQ ID NO: 64635 - DNA, 16 bp, Homo sapiens
gtaccctaaccgtgca

SEQ ID NO: 64636 - DNA, 24 bp, Homo sapiens
gtaccctaaccgtgcaaaggtagc

SEQ ID NO: 64637 - DNA, 19 bp, Homo sapiens
ctaaccgtgcaaaggtagc

SEQ ID NO: 64638 - DNA, 35 bp, Homo sapiens
ctaaccgtgcaaaggtagcataatcacttgttcct

SEQ ID NO: 64639 - DNA, 18 bp, Homo sapiens
taaccgtgcaaaggtagc

SEQ ID NO: 64640 - DNA, 34 bp, Homo sapiens
taaccgtgcaaaggtagcataatcacttgttcct

SEQ ID NO: 64641 - DNA, 18 bp, Homo sapiens
aaccgtgcaaaggtagca

SEQ ID NO: 64642 - DNA, 17 bp, Homo sapiens
aaccgtgcaaaggtagc

SEQ ID NO: 64643 - DNA, 33 bp, Homo sapiens
aaccgtgcaaaggtagcataatcacttgttcct

SEQ ID NO: 64644 - DNA, 31 bp, Homo sapiens
accgtgcaaaggtagcataatcacttgttcc

SEQ ID NO: 64645 - DNA, 16 bp, Homo sapiens
accgtgcaaaggtagc

SEQ ID NO: 64646 - DNA, 19 bp, Homo sapiens
accgtgcaaaggtagcata

SEQ ID NO: 64647 - DNA, 22 bp, Homo sapiens
accgtgcaaaggtagcataatc

SEQ ID NO: 64648 - DNA, 23 bp, Homo sapiens
accgtgcaaaggtagcataatca

SEQ ID NO: 64649 - DNA, 17 bp, Homo sapiens
accgtgcaaaggtagca

SEQ ID NO: 64650 - DNA, 16 bp, Homo sapiens
ccgtgcaaaggtagca

SEQ ID NO: 64651 - DNA, 20 bp, Homo sapiens
gtagcataatcacttgttcc

SEQ ID NO: 64652 - DNA, 19 bp, Homo sapiens
gggacctgtatgaatggct

SEQ ID NO: 64653 - DNA, 18 bp, Homo sapiens
ggacctgtatgaatggct

SEQ ID NO: 64654 - DNA, 19 bp, Homo sapiens
gacctgtatgaatggctcc

SEQ ID NO: 64655 - DNA, 42 bp, Homo sapiens
agggttcagctgtctcttacttttaaccagtgaaattgacct

SEQ ID NO: 64656 - DNA, 20 bp, Homo sapiens
gctgtctcttacttttaacc

SEQ ID NO: 64657 - DNA, 37 bp, Homo sapiens
gctgtctcttacttttaaccagtgaaattgacctgcc

SEQ ID NO: 64658 - DNA, 39 bp, Homo sapiens
gctgtctcttacttttaaccagtgaaattgacctgcccg

SEQ ID NO: 64659 - DNA, 33 bp, Homo sapiens; identical to SEQ ID NO: 10991

SEQ ID NO: 64660 - DNA, 34 bp, Homo sapiens
gctgtctcttacttttaaccagtgaaattgacct

SEQ ID NO: 64661 - DNA, 17 bp, Homo sapiens
gtctcttacttttaacc

SEQ ID NO: 64662 - DNA, 30 bp, Homo sapiens
gtctcttacttttaaccagtgaaattgacc

SEQ ID NO: 64663 - DNA, 17 bp, Homo sapiens
aaccagtgaaattgacc

SEQ ID NO: 64664 - DNA, 18 bp, Homo sapiens
aaccagtgaaattgacct

SEQ ID NO: 64665 - DNA, 16 bp, Homo sapiens
accagtgaaattgacc

SEQ ID NO: 64666 - DNA, 17 bp, Homo sapiens
accagtgaaattgacct

SEQ ID NO: 64667 - DNA, 17 bp, Homo sapiens
gcgggcataacacagca

SEQ ID NO: 64668 - DNA, 32 bp, Homo sapiens
acagcaagacgagaagaccctatggagcttta

SEQ ID NO: 64669 - DNA, 23 bp, Homo sapiens
agacgagaagaccctatggagct

SEQ ID NO: 64670 - DNA, 19 bp, Homo sapiens
gagaagaccctatggagct

SEQ ID NO: 64671 - DNA, 41 bp, Homo sapiens
atgcaaacagtacctaacaaacccacaggtcctaaactacc

SEQ ID NO: 64672 - DNA, 39 bp, Homo sapiens
gcaaacagtacctaacaaacccacaggtcctaaactacc

SEQ ID NO: 64673 - DNA, 40 bp, Homo sapiens
gcaaacagtacctaacaaacccacaggtcctaaactacca

SEQ ID NO: 64674 - DNA, 37 bp, Homo sapiens
gtacctaacaaacccacaggtcctaaactaccaaacc

SEQ ID NO: 64675 - DNA, 18 bp, Homo sapiens
gtacctaacaaacccaca

SEQ ID NO: 64676 - DNA, 23 bp, Homo sapiens
gtacctaacaaacccacaggtcc

SEQ ID NO: 64677 - DNA, 24 bp, Homo sapiens
gtacctaacaaacccacaggtcct

SEQ ID NO: 64678 - DNA, 25 bp, Homo sapiens
gtacctaacaaacccacaggtccta

SEQ ID NO: 64679 - DNA, 32 bp, Homo sapiens; identical to SEQ ID NO: 11078

SEQ ID NO: 64680 - DNA, 33 bp, Homo sapiens; identical to SEQ ID NO: 61524

SEQ ID NO: 64681 - DNA, 31 bp, Homo sapiens; identical to SEQ ID NO: 11079

SEQ ID NO: 64682 - DNA, 32 bp, Homo sapiens
tacctaacaaacccacaggtcctaaactacca

SEQ ID NO: 64683 - DNA, 30 bp, Homo sapiens
acctaacaaacccacaggtcctaaactacc

SEQ ID NO: 64684 - DNA, 29 bp, Homo sapiens
cctaacaaacccacaggtcctaaactacc

SEQ ID NO: 64685 - DNA, 30 bp, Homo sapiens
cctaacaaacccacaggtcctaaactacca

SEQ ID NO: 64686 - DNA, 24 bp, Homo sapiens
aaacccacaggtcctaaactacca

SEQ ID NO: 64687 - DNA, 28 bp, Homo sapiens
aacccacaggtcctaaactaccaaacct

SEQ ID NO: 64688 - DNA, 31 bp, Homo sapiens
aacccacaggtcctaaactaccaaacctgca

SEQ ID NO: 64689 - DNA, 19 bp, Homo sapiens
aacccacaggtcctaaact

SEQ ID NO: 64690 - DNA, 22 bp, Homo sapiens
aacccacaggtcctaaactacc

SEQ ID NO: 64691 - DNA, 23 bp, Homo sapiens
aacccacaggtcctaaactacca

SEQ ID NO: 64692 - DNA, 27 bp, Homo sapiens
aacccacaggtcctaaactaccaaacc

SEQ ID NO: 64693 - DNA, 21 bp, Homo sapiens
acccacaggtcctaaactacc

SEQ ID NO: 64694 - DNA, 26 bp, Homo sapiens
acccacaggtcctaaactaccaaacc

SEQ ID NO: 64695 - DNA, 30 bp, Homo sapiens
acccacaggtcctaaactaccaaacctgca

SEQ ID NO: 64696 - DNA, 25 bp, Homo sapiens
cccacaggtcctaaactaccaaacc

SEQ ID NO: 64697 - DNA, 29 bp, Homo sapiens
cccacaggtcctaaactaccaaacctgca

SEQ ID NO: 64698 - DNA, 18 bp, Homo sapiens
cacaggtcctaaactacc

SEQ ID NO: 64699 - DNA, 17 bp, Homo sapiens
acaggtcctaaactacc

SEQ ID NO: 64700 - DNA, 16 bp, Homo sapiens
acctcggagcagaacc

SEQ ID NO: 64701 - DNA, 18 bp, Homo sapiens
gagcagaacccaacctcc

SEQ ID NO: 64702 - DNA, 19 bp, Homo sapiens
gagcagaacccaacctccg

SEQ ID NO: 64703 - DNA, 18 bp, Homo sapiens
gaacccaacctccgagca

SEQ ID NO: 64704 - DNA, 39 bp, Homo sapiens
gaacccaacctccgagcagtacatgctaagacttcacca

SEQ ID NO: 64705 - DNA, 38 bp, Homo sapiens
gaacccaacctccgagcagtacatgctaagacttcacc

SEQ ID NO: 64706 - DNA, 30 bp, Homo sapiens; identical to SEQ ID NO: 11251

SEQ ID NO: 64707 - DNA, 31 bp, Homo sapiens; identical to SEQ ID NO: 11252

SEQ ID NO: 64708 - DNA, 18 bp, Homo sapiens
caacctccgagcagtaca

SEQ ID NO: 64709 - DNA, 28 bp, Homo sapiens
caacctccgagcagtacatgctaagact

SEQ ID NO: 64710 - DNA, 33 bp, Homo sapiens; identical to SEQ ID NO: 1669

SEQ ID NO: 64711 - DNA, 34 bp, Homo sapiens; identical to SEQ ID NO: 11254

SEQ ID NO: 64712 - DNA, 27 bp, Homo sapiens
aacctccgagcagtacatgctaagact

SEQ ID NO: 64713 - DNA, 30 bp, Homo sapiens
aacctccgagcagtacatgctaagacttca

SEQ ID NO: 64714 - DNA, 46 bp, Homo sapiens; identical to SEQ ID NO: 11263

SEQ ID NO: 64715 - DNA, 17 bp, Homo sapiens
aacctccgagcagtaca

SEQ ID NO: 64716 - DNA, 33 bp, Homo sapiens; identical to SEQ ID NO: 11262

SEQ ID NO: 64717 - DNA, 32 bp, Homo sapiens; identical to SEQ ID NO: 1672

SEQ ID NO: 64718 - DNA, 26 bp, Homo sapiens
acctccgagcagtacatgctaagact

SEQ ID NO: 64719 - DNA, 29 bp, Homo sapiens
acctccgagcagtacatgctaagacttca

SEQ ID NO: 64720 - DNA, 46 bp, Homo sapiens
acctccgagcagtacatgctaagacttcaccagtcaaagcgaacta

SEQ ID NO: 64721 - DNA, 32 bp, Homo sapiens
acctccgagcagtacatgctaagacttcacca

SEQ ID NO: 64722 - DNA, 31 bp, Homo sapiens; identical to SEQ ID NO: 1673

SEQ ID NO: 64723 - DNA, 27 bp, Homo sapiens
ccgagcagtacatgctaagacttcacc

SEQ ID NO: 64724 - DNA, 27 bp, Homo sapiens
cgagcagtacatgctaagacttcacca

SEQ ID NO: 64725 - DNA, 45 bp, Homo sapiens
gagcagtacatgctaagacttcaccagtcaaagcgaactactata

SEQ ID NO: 64726 - DNA, 25 bp, Homo sapiens
gagcagtacatgctaagacttcacc

SEQ ID NO: 64727 - DNA, 26 bp, Homo sapiens
gagcagtacatgctaagacttcacca

SEQ ID NO: 64728 - DNA, 39 bp, Homo sapiens
gagcagtacatgctaagacttcaccagtcaaagcgaact

SEQ ID NO: 64729 - DNA, 43 bp, Homo sapiens
gagcagtacatgctaagacttcaccagtcaaagcgaactacta

SEQ ID NO: 64730 - DNA, 40 bp, Homo sapiens
gagcagtacatgctaagacttcaccagtcaaagcgaacta

SEQ ID NO: 64731 - DNA, 38 bp, Homo sapiens
agcagtacatgctaagacttcaccagtcaaagcgaact

SEQ ID NO: 64732 - DNA, 39 bp, Homo sapiens; identical to SEQ ID NO: 61530

SEQ ID NO: 64733 - DNA, 20 bp, Homo sapiens
gtacatgctaagacttcacc

SEQ ID NO: 64734 - DNA, 37 bp, Homo sapiens
gtacatgctaagacttcaccagtcaaagcgaactact

SEQ ID NO: 64735 - DNA, 38 bp, Homo sapiens
gtacatgctaagacttcaccagtcaaagcgaactacta

SEQ ID NO: 64736 - DNA, 34 bp, Homo sapiens; identical to SEQ ID NO: 61532

SEQ ID NO: 64737 - DNA, 35 bp, Homo sapiens; identical to SEQ ID NO: 61533

SEQ ID NO: 64738 - DNA, 28 bp, Homo sapiens
catgctaagacttcaccagtcaaagcga

SEQ ID NO: 64739 - DNA, 17 bp, Homo sapiens
catgctaagacttcacc

SEQ ID NO: 64740 - DNA, 18 bp, Homo sapiens
catgctaagacttcacca

SEQ ID NO: 64741 - DNA, 27 bp, Homo sapiens
atgctaagacttcaccagtcaaagcga

SEQ ID NO: 64742 - DNA, 17 bp, Homo sapiens
agtcaaagcgaactact

SEQ ID NO: 64743 - DNA, 18 bp, Homo sapiens
agtcaaagcgaactacta

SEQ ID NO: 64744 - DNA, 24 bp, Homo sapiens
agtcaaagcgaactactatactca

SEQ ID NO: 64745 - DNA, 33 bp, Homo sapiens
agtcaaagcgaactactatactcaattgatcca

SEQ ID NO: 64746 - DNA, 39 bp, Homo sapiens; identical to SEQ ID NO: 11299

SEQ ID NO: 64747 - DNA, 31 bp, Homo sapiens; identical to SEQ ID NO: 1685

SEQ ID NO: 64748 - DNA, 32 bp, Homo sapiens; identical to SEQ ID NO: 1686

SEQ ID NO: 64749 - DNA, 44 bp, Homo sapiens; identical to SEQ ID NO: 11300

SEQ ID NO: 64750 - DNA, 31 bp, Homo sapiens; identical to SEQ ID NO: 11305

SEQ ID NO: 64751 - DNA, 32 bp, Homo sapiens
gtcaaagcgaactactatactcaattgatcca

SEQ ID NO: 64752 - DNA, 38 bp, Homo sapiens
gtcaaagcgaactactatactcaattgatccaataact

SEQ ID NO: 64753 - DNA, 30 bp, Homo sapiens; identical to SEQ ID NO: 1696

SEQ ID NO: 64754 - DNA, 17 bp, Homo sapiens
gatccaataacttgacc

SEQ ID NO: 64755 - DNA, 36 bp, Homo sapiens
tgaccaacggaacaagttaccctagggataacagcg

SEQ ID NO: 64756 - DNA, 38 bp, Homo sapiens
tgaccaacggaacaagttaccctagggataacagcgca

SEQ ID NO: 64757 - DNA, 32 bp, Homo sapiens
gaccaacggaacaagttaccctagggataaca

SEQ ID NO: 64758 - DNA, 35 bp, Homo sapiens
gaccaacggaacaagttaccctagggataacagcg

SEQ ID NO: 64759 - DNA, 37 bp, Homo sapiens
gaccaacggaacaagttaccctagggataacagcgca

SEQ ID NO: 64760 - DNA, 31 bp, Homo sapiens
accaacggaacaagttaccctagggataaca

SEQ ID NO: 64761 - DNA, 32 bp, Homo sapiens
accaacggaacaagttaccctagggataacag

SEQ ID NO: 64762 - DNA, 34 bp, Homo sapiens
accaacggaacaagttaccctagggataacagcg

SEQ ID NO: 64763 - DNA, 36 bp, Homo sapiens
accaacggaacaagttaccctagggataacagcgca

SEQ ID NO: 64764 - DNA, 35 bp, Homo sapiens
ccaacggaacaagttaccctagggataacagcgca

SEQ ID NO: 64765 - DNA, 33 bp, Homo sapiens
caacggaacaagttaccctagggataacagcgc

SEQ ID NO: 64766 - DNA, 32 bp, Homo sapiens
caacggaacaagttaccctagggataacagcg

SEQ ID NO: 64767 - DNA, 34 bp, Homo sapiens
caacggaacaagttaccctagggataacagcgca

SEQ ID NO: 64768 - DNA, 32 bp, Homo sapiens
aacggaacaagttaccctagggataacagcgc

SEQ ID NO: 64769 - DNA, 34 bp, Homo sapiens
aacggaacaagttaccctagggataacagcgcaa

SEQ ID NO: 64770 - DNA, 31 bp, Homo sapiens
aacggaacaagttaccctagggataacagcg

SEQ ID NO: 64771 - DNA, 33 bp, Homo sapiens; identical to SEQ ID NO: 63158

SEQ ID NO: 64772 - DNA, 33 bp, Homo sapiens
acggaacaagttaccctagggataacagcgcaa

SEQ ID NO: 64773 - DNA, 31 bp, Homo sapiens
acggaacaagttaccctagggataacagcgc

SEQ ID NO: 64774 - DNA, 30 bp, Homo sapiens
acggaacaagttaccctagggataacagcg

SEQ ID NO: 64775 - DNA, 32 bp, Homo sapiens; identical to SEQ ID NO: 63159

SEQ ID NO: 64776 - DNA, 31 bp, Homo sapiens
cggaacaagttaccctagggataacagcgca

SEQ ID NO: 64777 - DNA, 28 bp, Homo sapiens
ggaacaagttaccctagggataacagcg

SEQ ID NO: 64778 - DNA, 29 bp, Homo sapiens
ggaacaagttaccctagggataacagcgc

SEQ ID NO: 64779 - DNA, 30 bp, Homo sapiens; identical to SEQ ID NO: 63160

SEQ ID NO: 64780 - DNA, 19 bp, Homo sapiens
gaacaagttaccctaggga

SEQ ID NO: 64781 - DNA, 20 bp, Homo sapiens
gaacaagttaccctagggat

SEQ ID NO: 64782 - DNA, 21 bp, Homo sapiens
gaacaagttaccctagggata

SEQ ID NO: 64783 - DNA, 28 bp, Homo sapiens
gaacaagttaccctagggataacagcgc

SEQ ID NO: 64784 - DNA, 30 bp, Homo sapiens
gaacaagttaccctagggataacagcgcaa

SEQ ID NO: 64785 - DNA, 34 bp, Homo sapiens
gaacaagttaccctagggataacagcgcaatcct

SEQ ID NO: 64786 - DNA, 27 bp, Homo sapiens
gaacaagttaccctagggataacagcg

SEQ ID NO: 64787 - DNA, 29 bp, Homo sapiens
gaacaagttaccctagggataacagcgca

SEQ ID NO: 64788 - DNA, 32 bp, Homo sapiens
gaacaagttaccctagggataacagcgcaatc

SEQ ID NO: 64789 - DNA, 24 bp, Homo sapiens
agcgcaatcctattctagagtcca

SEQ ID NO: 64790 - DNA, 45 bp, Homo sapiens
agcgcaatcctattctagagtccatatcaacaatagggtttacga

SEQ ID NO: 64791 - DNA, 21 bp, Homo sapiens
gcgcaatcctattctagagtc

SEQ ID NO: 64792 - DNA, 44 bp, Homo sapiens
gcgcaatcctattctagagtccatatcaacaatagggtttacga

SEQ ID NO: 64793 - DNA, 22 bp, Homo sapiens
gcgcaatcctattctagagtcc

SEQ ID NO: 64794 - DNA, 26 bp, Homo sapiens
gcgcaatcctattctagagtccatat

SEQ ID NO: 64795 - DNA, 43 bp, Homo sapiens
gcgcaatcctattctagagtccatatcaacaatagggtttacg

SEQ ID NO: 64796 - DNA, 45 bp, Homo sapiens
gcgcaatcctattctagagtccatatcaacaatagggtttacgac

SEQ ID NO: 64797 - DNA, 23 bp, Homo sapiens
gcgcaatcctattctagagtcca

SEQ ID NO: 64798 - DNA, 25 bp, Homo sapiens
gcgcaatcctattctagagtccata

SEQ ID NO: 64799 - DNA, 46 bp, Homo sapiens
gcgcaatcctattctagagtccatatcaacaatagggtttacgacc

SEQ ID NO: 64800 - DNA, 19 bp, Homo sapiens
caatcctattctagagtcc

SEQ ID NO: 64801 - DNA, 20 bp, Homo sapiens
caatcctattctagagtcca

SEQ ID NO: 64802 - DNA, 34 bp, Homo sapiens
agagtccatatcaacaatagggtttacgacctcg

SEQ ID NO: 64803 - DNA, 45 bp, Homo sapiens; identical to SEQ ID NO: 62759

SEQ ID NO: 64804 - DNA, 33 bp, Homo sapiens
gagtccatatcaacaatagggtttacgacctcg

SEQ ID NO: 64805 - DNA, 31 bp, Homo sapiens; identical to SEQ ID NO: 11391

SEQ ID NO: 64806 - DNA, 27 bp, Homo sapiens
agtccatatcaacaatagggtttacga

SEQ ID NO: 64807 - DNA, 33 bp, Homo sapiens
agtccatatcaacaatagggtttacgacctcga

SEQ ID NO: 64808 - DNA, 34 bp, Homo sapiens
agtccatatcaacaatagggtttacgacctcgat

SEQ ID NO: 64809 - DNA, 36 bp, Homo sapiens
agtccatatcaacaatagggtttacgacctcgatgt

SEQ ID NO: 64810 - DNA, 46 bp, Homo sapiens
agtccatatcaacaatagggtttacgacctcgatgttggatcagga

SEQ ID NO: 64811 - DNA, 30 bp, Homo sapiens; identical to SEQ ID NO: 33206

SEQ ID NO: 64812 - DNA, 42 bp, Homo sapiens
agtccatatcaacaatagggtttacgacctcgatgttggatc

SEQ ID NO: 64813 - DNA, 26 bp, Homo sapiens
agtccatatcaacaatagggtttacg

SEQ ID NO: 64814 - DNA, 43 bp, Homo sapiens
agtccatatcaacaatagggtttacgacctcgatgttggatca

SEQ ID NO: 64815 - DNA, 44 bp, Homo sapiens
agtccatatcaacaatagggtttacgacctcgatgttggatcag

SEQ ID NO: 64816 - DNA, 45 bp, Homo sapiens; identical to SEQ ID NO: 61536

SEQ ID NO: 64817 - DNA, 32 bp, Homo sapiens; identical to SEQ ID NO: 61535

SEQ ID NO: 64818 - DNA, 26 bp, Homo sapiens
caacaatagggtttacgacctcgatg

SEQ ID NO: 64819 - DNA, 27 bp, Homo sapiens
caacaatagggtttacgacctcgatgt

SEQ ID NO: 64820 - DNA, 43 bp, Homo sapiens
aacaatagggtttacgacctcgatgttggatcaggacatcccg

SEQ ID NO: 64821 - DNA, 44 bp, Homo sapiens
aacaatagggtttacgacctcgatgttggatcaggacatcccga

SEQ ID NO: 64822 - DNA, 45 bp, Homo sapiens
acaatagggtttacgacctcgatgttggatcaggacatcccgatg

SEQ ID NO: 64823 - DNA, 38 bp, Homo sapiens
acgacctcgatgttggatcaggacatcccgatggtgca

SEQ ID NO: 64824 - DNA, 29 bp, Homo sapiens
cgacctcgatgttggatcaggacatcccg

SEQ ID NO: 64825 - DNA, 39 bp, Homo sapiens
gacctcgatgttggatcaggacatcccgatggtgcagcc

SEQ ID NO: 64826 - DNA, 40 bp, Homo sapiens; identical to SEQ ID NO: 11466

SEQ ID NO: 64827 - DNA, 18 bp, Homo sapiens
gacctcgatgttggatca

SEQ ID NO: 64828 - DNA, 35 bp, Homo sapiens
gacctcgatgttggatcaggacatcccgatggtgc

SEQ ID NO: 64829 - DNA, 17 bp, Homo sapiens
gacctcgatgttggatc

SEQ ID NO: 64830 - DNA, 21 bp, Homo sapiens
gacctcgatgttggatcagga

SEQ ID NO: 64831 - DNA, 23 bp, Homo sapiens
gacctcgatgttggatcaggaca

SEQ ID NO: 64832 - DNA, 27 bp, Homo sapiens
gacctcgatgttggatcaggacatccc

SEQ ID NO: 64833 - DNA, 30 bp, Homo sapiens; identical to SEQ ID NO: 1734

SEQ ID NO: 64834 - DNA, 32 bp, Homo sapiens; identical to SEQ ID NO: 11464

SEQ ID NO: 64835 - DNA, 28 bp, Homo sapiens
gacctcgatgttggatcaggacatcccg

SEQ ID NO: 64836 - DNA, 29 bp, Homo sapiens
gacctcgatgttggatcaggacatcccga

SEQ ID NO: 64837 - DNA, 31 bp, Homo sapiens; identical to SEQ ID NO: 1735

SEQ ID NO: 64838 - DNA, 42 bp, Homo sapiens
gacctcgatgttggatcaggacatcccgatggtgcagccgct

SEQ ID NO: 64839 - DNA, 34 bp, Homo sapiens
gacctcgatgttggatcaggacatcccgatggtg

SEQ ID NO: 64840 - DNA, 36 bp, Homo sapiens; identical to SEQ ID NO: 63162

SEQ ID NO: 64841 - DNA, 41 bp, Homo sapiens
acctcgatgttggatcaggacatcccgatggtgcagccgct

SEQ ID NO: 64842 - DNA, 22 bp, Homo sapiens
acctcgatgttggatcaggaca

SEQ ID NO: 64843 - DNA, 31 bp, Homo sapiens; identical to SEQ ID NO: 11477

SEQ ID NO: 64844 - DNA, 35 bp, Homo sapiens
acctcgatgttggatcaggacatcccgatggtgca

SEQ ID NO: 64845 - DNA, 16 bp, Homo sapiens
acctcgatgttggatc

SEQ ID NO: 64846 - DNA, 17 bp, Homo sapiens
acctcgatgttggatca

SEQ ID NO: 64847 - DNA, 26 bp, Homo sapiens
acctcgatgttggatcaggacatccc

SEQ ID NO: 64848 - DNA, 28 bp, Homo sapiens
acctcgatgttggatcaggacatcccga

SEQ ID NO: 64849 - DNA, 29 bp, Homo sapiens
acctcgatgttggatcaggacatcccgat

SEQ ID NO: 64850 - DNA, 30 bp, Homo sapiens; identical to SEQ ID NO: 1742

SEQ ID NO: 64851 - DNA, 27 bp, Homo sapiens
acctcgatgttggatcaggacatcccg

SEQ ID NO: 64852 - DNA, 24 bp, Homo sapiens
ctcgatgttggatcaggacatccc

SEQ ID NO: 64853 - DNA, 25 bp, Homo sapiens
ctcgatgttggatcaggacatcccg

SEQ ID NO: 64854 - DNA, 22 bp, Homo sapiens
cgatgttggatcaggacatccc

SEQ ID NO: 64855 - DNA, 23 bp, Homo sapiens
cgatgttggatcaggacatcccg

SEQ ID NO: 64856 - DNA, 21 bp, Homo sapiens
gatgttggatcaggacatccc

SEQ ID NO: 64857 - DNA, 22 bp, Homo sapiens
gatgttggatcaggacatcccg

SEQ ID NO: 64858 - DNA, 20 bp, Homo sapiens
atgttggatcaggacatccc

SEQ ID NO: 64859 - DNA, 21 bp, Homo sapiens
atgttggatcaggacatcccg

SEQ ID NO: 64860 - DNA, 18 bp, Homo sapiens
caggacatcccgatggtg

SEQ ID NO: 64861 - DNA, 20 bp, Homo sapiens
caggacatcccgatggtgca

SEQ ID NO: 64862 - DNA, 23 bp, Homo sapiens
caggacatcccgatggtgcagcc

SEQ ID NO: 64863 - DNA, 23 bp, Homo sapiens
aggacatcccgatggtgcagccg

SEQ ID NO: 64864 - DNA, 26 bp, Homo sapiens
aggacatcccgatggtgcagccgcta

SEQ ID NO: 64865 - DNA, 17 bp, Homo sapiens
aggacatcccgatggtg

SEQ ID NO: 64866 - DNA, 21 bp, Homo sapiens
aggacatcccgatggtgcagc

SEQ ID NO: 64867 - DNA, 41 bp, Homo sapiens
aggacatcccgatggtgcagccgctattaaaggttcgtttg

SEQ ID NO: 64868 - DNA, 19 bp, Homo sapiens
aggacatcccgatggtgca

SEQ ID NO: 64869 - DNA, 22 bp, Homo sapiens
aggacatcccgatggtgcagcc

SEQ ID NO: 64870 - DNA, 25 bp, Homo sapiens
aggacatcccgatggtgcagccgct

SEQ ID NO: 64871 - DNA, 42 bp, Homo sapiens
aggacatcccgatggtgcagccgctattaaaggttcgtttgt

SEQ ID NO: 64872 - DNA, 27 bp, Homo sapiens
ggacatcccgatggtgcagccgctatt

SEQ ID NO: 64873 - DNA, 20 bp, Homo sapiens
ggacatcccgatggtgcagc

SEQ ID NO: 64874 - DNA, 25 bp, Homo sapiens
ggacatcccgatggtgcagccgcta

SEQ ID NO: 64875 - DNA, 35 bp, Homo sapiens
ggacatcccgatggtgcagccgctattaaaggttc

SEQ ID NO: 64876 - DNA, 18 bp, Homo sapiens
ggacatcccgatggtgca

SEQ ID NO: 64877 - DNA, 21 bp, Homo sapiens
ggacatcccgatggtgcagcc

SEQ ID NO: 64878 - DNA, 41 bp, Homo sapiens
ggacatcccgatggtgcagccgctattaaaggttcgtttgt

SEQ ID NO: 64879 - DNA, 24 bp, Homo sapiens
ggacatcccgatggtgcagccgct

SEQ ID NO: 64880 - DNA, 21 bp, Homo sapiens
gacatcccgatggtgcagccg

SEQ ID NO: 64881 - DNA, 34 bp, Homo sapiens
gacatcccgatggtgcagccgctattaaaggttc

SEQ ID NO: 64882 - DNA, 17 bp, Homo sapiens
gacatcccgatggtgca

SEQ ID NO: 64883 - DNA, 19 bp, Homo sapiens
gacatcccgatggtgcagc

SEQ ID NO: 64884 - DNA, 23 bp, Homo sapiens
gacatcccgatggtgcagccgct

SEQ ID NO: 64885 - DNA, 20 bp, Homo sapiens
gacatcccgatggtgcagcc

SEQ ID NO: 64886 - DNA, 40 bp, Homo sapiens
gacatcccgatggtgcagccgctattaaaggttcgtttgt

SEQ ID NO: 64887 - DNA, 19 bp, Homo sapiens
acatcccgatggtgcagcc

SEQ ID NO: 64888 - DNA, 38 bp, Homo sapiens; identical to SEQ ID NO: 62760

SEQ ID NO: 64889 - DNA, 17 bp, Homo sapiens
atcccgatggtgcagcc

SEQ ID NO: 64890 - DNA, 37 bp, Homo sapiens
atcccgatggtgcagccgctattaaaggttcgtttgt

SEQ ID NO: 64891 - DNA, 20 bp, Homo sapiens
atcccgatggtgcagccgct

SEQ ID NO: 64892 - DNA, 19 bp, Homo sapiens
tcccgatggtgcagccgct

SEQ ID NO: 64893 - DNA, 16 bp, Homo sapiens
cgatggtgcagccgct

SEQ ID NO: 64894 - DNA, 27 bp, Homo sapiens
cgatggtgcagccgctattaaaggttc

SEQ ID NO: 64895 - DNA, 39 bp, Homo sapiens
cgatggtgcagccgctattaaaggttcgtttgttcaacg

SEQ ID NO: 64896 - DNA, 38 bp, Homo sapiens
gatggtgcagccgctattaaaggttcgtttgttcaacg

SEQ ID NO: 64897 - DNA, 19 bp, Homo sapiens
gatggtgcagccgctatta

SEQ ID NO: 64898 - DNA, 32 bp, Homo sapiens
gatggtgcagccgctattaaaggttcgtttgt

SEQ ID NO: 64899 - DNA, 35 bp, Homo sapiens
gatggtgcagccgctattaaaggttcgtttgttca

SEQ ID NO: 64900 - DNA, 26 bp, Homo sapiens
gatggtgcagccgctattaaaggttc

SEQ ID NO: 64901 - DNA, 46 bp, Homo sapiens
ggtgcagccgctattaaaggttcgtttgttcaacgattaaagtcct

SEQ ID NO: 64902 - DNA, 24 bp, Homo sapiens
ggtgcagccgctattaaaggttcg

SEQ ID NO: 64903 - DNA, 29 bp, Homo sapiens
ggtgcagccgctattaaaggttcgtttgt

SEQ ID NO: 64904 - DNA, 32 bp, Homo sapiens
ggtgcagccgctattaaaggttcgtttgttca

SEQ ID NO: 64905 - DNA, 39 bp, Homo sapiens
ggtgcagccgctattaaaggttcgtttgttcaacgatta

SEQ ID NO: 64906 - DNA, 45 bp, Homo sapiens
ggtgcagccgctattaaaggttcgtttgttcaacgattaaagtcc

SEQ ID NO: 64907 - DNA, 44 bp, Homo sapiens
gtgcagccgctattaaaggttcgtttgttcaacgattaaagtcc

SEQ ID NO: 64908 - DNA, 21 bp, Homo sapiens
gcagccgctattaaaggttcg

SEQ ID NO: 64909 - DNA, 42 bp, Homo sapiens
gcagccgctattaaaggttcgtttgttcaacgattaaagtcc

SEQ ID NO: 64910 - DNA, 46 bp, Homo sapiens
gcagccgctattaaaggttcgtttgttcaacgattaaagtcctacg

SEQ ID NO: 64911 - DNA, 18 bp, Homo sapiens
cagccgctattaaaggtt

SEQ ID NO: 64912 - DNA, 19 bp, Homo sapiens
cagccgctattaaaggttc

SEQ ID NO: 64913 - DNA, 20 bp, Homo sapiens
cagccgctattaaaggttcg

SEQ ID NO: 64914 - DNA, 40 bp, Homo sapiens
cagccgctattaaaggttcgtttgttcaacgattaaagtc

SEQ ID NO: 64915 - DNA, 45 bp, Homo sapiens
cagccgctattaaaggttcgtttgttcaacgattaaagtcctacg

SEQ ID NO: 64916 - DNA, 41 bp, Homo sapiens
cagccgctattaaaggttcgtttgttcaacgattaaagtcc

SEQ ID NO: 64917 - DNA, 40 bp, Homo sapiens
agccgctattaaaggttcgtttgttcaacgattaaagtcc

SEQ ID NO: 64918 - DNA, 19 bp, Homo sapiens
agccgctattaaaggttcg

SEQ ID NO: 64919 - DNA, 16 bp, Homo sapiens
gccgctattaaaggtt

SEQ ID NO: 64920 - DNA, 39 bp, Homo sapiens
gccgctattaaaggttcgtttgttcaacgattaaagtcc

SEQ ID NO: 64921 - DNA, 17 bp, Homo sapiens
gccgctattaaaggttc

SEQ ID NO: 64922 - DNA, 18 bp, Homo sapiens
gccgctattaaaggttcg

SEQ ID NO: 64923 - DNA, 37 bp, Homo sapiens
cgctattaaaggttcgtttgttcaacgattaaagtcc

SEQ ID NO: 64924 - DNA, 43 bp, Homo sapiens
gctattaaaggttcgtttgttcaacgattaaagtcctacgtga

SEQ ID NO: 64925 - DNA, 35 bp, Homo sapiens
gctattaaaggttcgtttgttcaacgattaaagtc

SEQ ID NO: 64926 - DNA, 40 bp, Homo sapiens
gctattaaaggttcgtttgttcaacgattaaagtcctacg

SEQ ID NO: 64927 - DNA, 42 bp, Homo sapiens
gctattaaaggttcgtttgttcaacgattaaagtcctacgtg

SEQ ID NO: 64928 - DNA, 44 bp, Homo sapiens
gctattaaaggttcgtttgttcaacgattaaagtcctacgtgat

SEQ ID NO: 64929 - DNA, 36 bp, Homo sapiens
gctattaaaggttcgtttgttcaacgattaaagtcc

SEQ ID NO: 64930 - DNA, 30 bp, Homo sapiens
aaaggttcgtttgttcaacgattaaagtcc

SEQ ID NO: 64931 - DNA, 28 bp, Homo sapiens
aaggttcgtttgttcaacgattaaagtc

SEQ ID NO: 64932 - DNA, 29 bp, Homo sapiens
aaggttcgtttgttcaacgattaaagtcc

SEQ ID NO: 64933 - DNA, 27 bp, Homo sapiens
aggttcgtttgttcaacgattaaagtc

SEQ ID NO: 64934 - DNA, 28 bp, Homo sapiens
aggttcgtttgttcaacgattaaagtcc

SEQ ID NO: 64935 - DNA, 27 bp, Homo sapiens
ggttcgtttgttcaacgattaaagtcc

SEQ ID NO: 64936 - DNA, 29 bp, Homo sapiens
ggttcgtttgttcaacgattaaagtccta

SEQ ID NO: 64937 - DNA, 26 bp, Homo sapiens
gtttgttcaacgattaaagtcctacg

SEQ ID NO: 64938 - DNA, 27 bp, Homo sapiens
aagtcctacgtgatctgagttcagacc

SEQ ID NO: 64939 - DNA, 23 bp, Homo sapiens
cctacgtgatctgagttcagacc

SEQ ID NO: 64940 - DNA, 22 bp, Homo sapiens
ctacgtgatctgagttcagacc

SEQ ID NO: 64941 - DNA, 23 bp, Homo sapiens
ctacgtgatctgagttcagaccg

SEQ ID NO: 64942 - DNA, 28 bp, Homo sapiens
ctacgtgatctgagttcagaccggagta

SEQ ID NO: 64943 - DNA, 27 bp, Homo sapiens
tacgtgatctgagttcagaccggagta

SEQ ID NO: 64944 - DNA, 20 bp, Homo sapiens
acgtgatctgagttcagacc

SEQ ID NO: 64945 - DNA, 43 bp, Homo sapiens
aggacaagagaaataaggcctacttcacaaagcgccttccccc

SEQ ID NO: 64946 - DNA, 42 bp, Homo sapiens
aggacaagagaaataaggcctacttcacaaagcgccttcccc

SEQ ID NO: 64947 - DNA, 41 bp, Homo sapiens
ggacaagagaaataaggcctacttcacaaagcgccttcccc

SEQ ID NO: 64948 - DNA, 42 bp, Homo sapiens
ggacaagagaaataaggcctacttcacaaagcgccttccccc

SEQ ID NO: 64949 - DNA, 43 bp, Homo sapiens
ggacaagagaaataaggcctacttcacaaagcgccttcccccg

SEQ ID NO: 64950 - DNA, 42 bp, Homo sapiens
gacaagagaaataaggcctacttcacaaagcgccttcccccg

SEQ ID NO: 64951 - DNA, 40 bp, Homo sapiens
gacaagagaaataaggcctacttcacaaagcgccttcccc

SEQ ID NO: 64952 - DNA, 41 bp, Homo sapiens
gacaagagaaataaggcctacttcacaaagcgccttccccc

SEQ ID NO: 64953 - DNA, 37 bp, Homo sapiens
aagagaaataaggcctacttcacaaagcgccttcccc

SEQ ID NO: 64954 - DNA, 36 bp, Homo sapiens
agagaaataaggcctacttcacaaagcgccttcccc

SEQ ID NO: 64955 - DNA, 37 bp, Homo sapiens
agagaaataaggcctacttcacaaagcgccttccccc

SEQ ID NO: 64956 - DNA, 18 bp, Homo sapiens
caacttagtattataccc

SEQ ID NO: 64957 - DNA, 23 bp, Homo sapiens
caacttagtattatacccacacc

SEQ ID NO: 64958 - DNA, 24 bp, Homo sapiens
caacttagtattatacccacaccc

SEQ ID NO: 64959 - DNA, 28 bp, Homo sapiens
caacttagtattatacccacacccaccc

SEQ ID NO: 64960 - DNA, 45 bp, Homo sapiens
caacttagtattatacccacacccacccaagaacagggtttgtta

SEQ ID NO: 64961 - DNA, 35 bp, Homo sapiens
caacttagtattatacccacacccacccaagaaca

SEQ ID NO: 64962 - DNA, 22 bp, Homo sapiens
acttagtattatacccacaccc

SEQ ID NO: 64963 - DNA, 30 bp, Homo sapiens; identical to SEQ ID NO: 11849

SEQ ID NO: 64964 - DNA, 18 bp, Homo sapiens
cacacccacccaagaaca

SEQ ID NO: 64965 - DNA, 27 bp, Homo sapiens
acacccacccaagaacagggtttgtta

SEQ ID NO: 64966 - DNA, 17 bp, Homo sapiens
acacccacccaagaaca

SEQ ID NO: 64967 - DNA, 38 bp, Homo sapiens; identical to SEQ ID NO: 11918

SEQ ID NO: 64968 - DNA, 40 bp, Homo sapiens; identical to SEQ ID NO: 11920

SEQ ID NO: 64969 - DNA, 39 bp, Homo sapiens; identical to SEQ ID NO: 11919

SEQ ID NO: 64970 - DNA, 35 bp, Homo sapiens; identical to SEQ ID NO: 11915

SEQ ID NO: 64971 - DNA, 44 bp, Homo sapiens; identical to SEQ ID NO: 11924

SEQ ID NO: 64972 - DNA, 46 bp, Homo sapiens; identical to SEQ ID NO: 11926

SEQ ID NO: 64973 - DNA, 37 bp, Homo sapiens; identical to SEQ ID NO: 11917

SEQ ID NO: 64974 - DNA, 30 bp, Homo sapiens; identical to SEQ ID NO: 1878

SEQ ID NO: 64975 - DNA, 25 bp, Homo sapiens
cttcgtgatcgatgtggtgacgtcg

SEQ ID NO: 64976 - DNA, 24 bp, Homo sapiens
cttcgtgatcgatgtggtgacgtc

SEQ ID NO: 64977 - DNA, 22 bp, Homo sapiens
cttcgtgatcgatgtggtgacg

SEQ ID NO: 64978 - DNA, 27 bp, Homo sapiens
cttcgtgatcgatgtggtgacgtcgtg

SEQ ID NO: 64979 - DNA, 28 bp, Homo sapiens
cttcgtgatcgatgtggtgacgtcgtgc

SEQ ID NO: 64980 - DNA, 29 bp, Homo sapiens
cttcgtgatcgatgtggtgacgtcgtgct

SEQ ID NO: 64981 - DNA, 31 bp, Homo sapiens; identical to SEQ ID NO: 1879

SEQ ID NO: 64982 - DNA, 32 bp, Homo sapiens; identical to SEQ ID NO: 1880

SEQ ID NO: 64983 - DNA, 36 bp, Homo sapiens; identical to SEQ ID NO: 11916

SEQ ID NO: 64984 - DNA, 46 bp, Homo sapiens; identical to SEQ ID NO: 11953

SEQ ID NO: 64985 - DNA, 26 bp, Homo sapiens
ttcgtgatcgatgtggtgacgtcgtg

SEQ ID NO: 64986 - DNA, 29 bp, Homo sapiens
ttcgtgatcgatgtggtgacgtcgtgctc

SEQ ID NO: 64987 - DNA, 30 bp, Homo sapiens; identical to SEQ ID NO: 1888

SEQ ID NO: 64988 - DNA, 35 bp, Homo sapiens; identical to SEQ ID NO: 11944

SEQ ID NO: 64989 - DNA, 28 bp, Homo sapiens
ttcgtgatcgatgtggtgacgtcgtgct

SEQ ID NO: 64990 - DNA, 23 bp, Homo sapiens
ttcgtgatcgatgtggtgacgtc

SEQ ID NO: 64991 - DNA, 21 bp, Homo sapiens
ttcgtgatcgatgtggtgacg

SEQ ID NO: 64992 - DNA, 31 bp, Homo sapiens; identical to SEQ ID NO: 1895

SEQ ID NO: 64993 - DNA, 19 bp, Homo sapiens
gatcgatgtggtgacgtcg

SEQ ID NO: 64994 - DNA, 26 bp, Homo sapiens
gatcgatgtggtgacgtcgtgctctc

SEQ ID NO: 64995 - DNA, 34 bp, Homo sapiens
gatcgatgtggtgacgtcgtgctctcccgggccg

SEQ ID NO: 64996 - DNA, 43 bp, Homo sapiens; identical to SEQ ID NO: 11982

SEQ ID NO: 64997 - DNA, 25 bp, Homo sapiens
gatcgatgtggtgacgtcgtgctct

SEQ ID NO: 64998 - DNA, 29 bp, Homo sapiens
gatcgatgtggtgacgtcgtgctctcccg

SEQ ID NO: 64999 - DNA, 30 bp, Homo sapiens; identical to SEQ ID NO: 1894

SEQ ID NO: 65000 - DNA, 24 bp, Homo sapiens
gatcgatgtggtgacgtcgtgctc

SEQ ID NO: 65001 - DNA, 38 bp, Homo sapiens; identical to SEQ ID NO: 11977

SEQ ID NO: 65002 - DNA, 42 bp, Homo sapiens; identical to SEQ ID NO: 11981

SEQ ID NO: 65003 - DNA, 23 bp, Homo sapiens
gatcgatgtggtgacgtcgtgct

SEQ ID NO: 65004 - DNA, 18 bp, Homo sapiens
gatcgatgtggtgacgtc

SEQ ID NO: 65005 - DNA, 16 bp, Homo sapiens
gatcgatgtggtgacg

SEQ ID NO: 65006 - DNA, 21 bp, Homo sapiens
gatcgatgtggtgacgtcgtg

SEQ ID NO: 65007 - DNA, 45 bp, Homo sapiens; identical to SEQ ID NO: 61573

SEQ ID NO: 65008 - DNA, 46 bp, Homo sapiens; identical to SEQ ID NO: 61574

SEQ ID NO: 65009 - DNA, 40 bp, Homo sapiens; identical to SEQ ID NO: 11979

SEQ ID NO: 65010 - DNA, 41 bp, Homo sapiens; identical to SEQ ID NO: 11980

SEQ ID NO: 65011 - DNA, 24 bp, Homo sapiens
atcgatgtggtgacgtcgtgctct

SEQ ID NO: 65012 - DNA, 28 bp, Homo sapiens
atcgatgtggtgacgtcgtgctctcccg

SEQ ID NO: 65013 - DNA, 30 bp, Homo sapiens; identical to SEQ ID NO: 1904

SEQ ID NO: 65014 - DNA, 42 bp, Homo sapiens; identical to SEQ ID NO: 12007

SEQ ID NO: 65015 - DNA, 43 bp, Homo sapiens; identical to SEQ ID NO: 12008

SEQ ID NO: 65016 - DNA, 45 bp, Homo sapiens; identical to SEQ ID NO: 12010

SEQ ID NO: 65017 - DNA, 20 bp, Homo sapiens
atcgatgtggtgacgtcgtg

SEQ ID NO: 65018 - DNA, 22 bp, Homo sapiens
atcgatgtggtgacgtcgtgct

SEQ ID NO: 65019 - DNA, 23 bp, Homo sapiens
atcgatgtggtgacgtcgtgctc

SEQ ID NO: 65020 - DNA, 41 bp, Homo sapiens; identical to SEQ ID NO: 12006

SEQ ID NO: 65021 - DNA, 44 bp, Homo sapiens; identical to SEQ ID NO: 12009

SEQ ID NO: 65022 - DNA, 29 bp, Homo sapiens
atcgatgtggtgacgtcgtgctctcccgg

SEQ ID NO: 65023 - DNA, 37 bp, Homo sapiens; identical to SEQ ID NO: 12002

SEQ ID NO: 65024 - DNA, 46 bp, Homo sapiens; identical to SEQ ID NO: 12011

SEQ ID NO: 65025 - DNA, 39 bp, Homo sapiens; identical to SEQ ID NO: 12004

SEQ ID NO: 65026 - DNA, 40 bp, Homo sapiens; identical to SEQ ID NO: 12005

SEQ ID NO: 65027 - DNA, 22 bp, Homo sapiens
tacctggttgatcctgccagta

SEQ ID NO: 65028 - DNA, 30 bp, Homo sapiens; identical to SEQ ID NO: 12067

SEQ ID NO: 65029 - DNA, 31 bp, Homo sapiens; identical to SEQ ID NO: 12068

SEQ ID NO: 65030 - DNA, 32 bp, Homo sapiens; identical to SEQ ID NO: 12069

SEQ ID NO: 65031 - DNA, 17 bp, Homo sapiens
tacctggttgatcctgc

SEQ ID NO: 65032 - DNA, 19 bp, Homo sapiens
tacctggttgatcctgcca

SEQ ID NO: 65033 - DNA, 35 bp, Homo sapiens; identical to SEQ ID NO: 12071

SEQ ID NO: 65034 - DNA, 45 bp, Homo sapiens
tacctggttgatcctgccagtagcatatgcttgtctcaaagatta

SEQ ID NO: 65035 - DNA, 40 bp, Homo sapiens; identical to SEQ ID NO: 12075

SEQ ID NO: 65036 - DNA, 42 bp, Homo sapiens; identical to SEQ ID NO: 12077

SEQ ID NO: 65037 - DNA, 26 bp, Homo sapiens
tacctggttgatcctgccagtagcat

SEQ ID NO: 65038 - DNA, 18 bp, Homo sapiens
tacctggttgatcctgcc

SEQ ID NO: 65039 - DNA, 21 bp, Homo sapiens
tacctggttgatcctgccagt

SEQ ID NO: 65040 - DNA, 38 bp, Homo sapiens; identical to SEQ ID NO: 12074

SEQ ID NO: 65041 - DNA, 24 bp, Homo sapiens
tacctggttgatcctgccagtagc

SEQ ID NO: 65042 - DNA, 25 bp, Homo sapiens
tacctggttgatcctgccagtagca

SEQ ID NO: 65043 - DNA, 37 bp, Homo sapiens; identical to SEQ ID NO: 12073

SEQ ID NO: 65044 - DNA, 44 bp, Homo sapiens; identical to SEQ ID NO: 12079

SEQ ID NO: 65045 - DNA, 19 bp, Homo sapiens
cctggttgatcctgccagt

SEQ ID NO: 65046 - DNA, 17 bp, Homo sapiens
tggttgatcctgccagt

SEQ ID NO: 65047 - DNA, 35 bp, Homo sapiens
gatcctgccagtagcatatgcttgtctcaaagatt

SEQ ID NO: 65048 - DNA, 18 bp, Homo sapiens
atgcttgtctcaaagatt

SEQ ID NO: 65049 - DNA, 46 bp, Homo sapiens; identical to SEQ ID NO: 63166

SEQ ID NO: 65050 - DNA, 41 bp, Homo sapiens; identical to SEQ ID NO: 61621

SEQ ID NO: 65051 - DNA, 42 bp, Homo sapiens; identical to SEQ ID NO: 12493

SEQ ID NO: 65052 - DNA, 16 bp, Homo sapiens
agcccctctccggccc

SEQ ID NO: 65053 - DNA, 18 bp, Homo sapiens
agcccctctccggccccg

SEQ ID NO: 65054 - DNA, 17 bp, Homo sapiens
gcccctctccggccccg

SEQ ID NO: 65055 - DNA, 37 bp, Homo sapiens; identical to SEQ ID NO: 61637

SEQ ID NO: 65056 - DNA, 39 bp, Homo sapiens; identical to SEQ ID NO: 12750

SEQ ID NO: 65057 - DNA, 38 bp, Homo sapiens; identical to SEQ ID NO: 12749

SEQ ID NO: 65058 - DNA, 22 bp, Homo sapiens
accacgggtgacggggaatcag

SEQ ID NO: 65059 - DNA, 23 bp, Homo sapiens
accacgggtgacggggaatcagg

SEQ ID NO: 65060 - DNA, 21 bp, Homo sapiens
tcggcgccccctcgatgctct

SEQ ID NO: 65061 - DNA, 21 bp, Homo sapiens
gagtgtcccgcggggcccgaa

SEQ ID NO: 65062 - DNA, 44 bp, Homo sapiens; identical to SEQ ID NO: 57068

SEQ ID NO: 65063 - DNA, 43 bp, Homo sapiens; identical to SEQ ID NO: 58749

SEQ ID NO: 65064 - DNA, 42 bp, Homo sapiens; identical to SEQ ID NO: 58750

SEQ ID NO: 65065 - DNA, 17 bp, Homo sapiens
cggaggttcgaagacga

SEQ ID NO: 65066 - DNA, 43 bp, Homo sapiens
cggacaggattgacagattgatagctctttctcgattccgtgg

SEQ ID NO: 65067 - DNA, 18 bp, Homo sapiens
gccccgccggggtcggcc

SEQ ID NO: 65068 - DNA, 16 bp, Homo sapiens
cggccctggcggagcg

SEQ ID NO: 65069 - DNA, 37 bp, Homo sapiens; identical to SEQ ID NO: 57145

SEQ ID NO: 65070 - DNA, 39 bp, Homo sapiens
agcgctgagaagacggtcgaacttgactatctagaggaa

SEQ ID NO: 65071 - DNA, 41 bp, Homo sapiens; identical to SEQ ID NO: 61680

SEQ ID NO: 65072 - DNA, 16 bp, Homo sapiens
aggatcattaacggag

SEQ ID NO: 65073 - DNA, 37 bp, Homo sapiens
ccccgcgccgtgggggcgggaacccccgggcgcctgt

SEQ ID NO: 65074 - DNA, 36 bp, Homo sapiens; identical to SEQ ID NO: 61685

SEQ ID NO: 65075 - DNA, 45 bp, Homo sapiens
acctcgtacgactcttagcggtggatcactcggctcgtgcgtcga

SEQ ID NO: 65076 - DNA, 44 bp, Homo sapiens
cctcgtacgactcttagcggtggatcactcggctcgtgcgtcga

SEQ ID NO: 65077 - DNA, 46 bp, Homo sapiens
ctcgtacgactcttagcggtggatcactcggctcgtgcgtcgatga

SEQ ID NO: 65078 - DNA, 44 bp, Homo sapiens
ctcgtacgactcttagcggtggatcactcggctcgtgcgtcgat

SEQ ID NO: 65079 - DNA, 45 bp, Homo sapiens
ctcgtacgactcttagcggtggatcactcggctcgtgcgtcgatg

SEQ ID NO: 65080 - DNA, 43 bp, Homo sapiens; identical to SEQ ID NO: 61690

SEQ ID NO: 65081 - DNA, 40 bp, Homo sapiens; identical to SEQ ID NO: 57207

SEQ ID NO: 65082 - DNA, 41 bp, Homo sapiens; identical to SEQ ID NO: 61697

SEQ ID NO: 65083 - DNA, 35 bp, Homo sapiens; identical to SEQ ID NO: 61692

SEQ ID NO: 65084 - DNA, 36 bp, Homo sapiens; identical to SEQ ID NO: 17332

SEQ ID NO: 65085 - DNA, 46 bp, Homo sapiens
tcgtacgactcttagcggtggatcactcggctcgtgcgtcgatgaa

SEQ ID NO: 65086 - DNA, 44 bp, Homo sapiens
tcgtacgactcttagcggtggatcactcggctcgtgcgtcgatg

SEQ ID NO: 65087 - DNA, 43 bp, Homo sapiens
tcgtacgactcttagcggtggatcactcggctcgtgcgtcgat

SEQ ID NO: 65088 - DNA, 42 bp, Homo sapiens; identical to SEQ ID NO: 57208

SEQ ID NO: 65089 - DNA, 38 bp, Homo sapiens; identical to SEQ ID NO: 17334

SEQ ID NO: 65090 - DNA, 44 bp, Homo sapiens
cgtacgactcttagcggtggatcactcggctcgtgcgtcgatga

SEQ ID NO: 65091 - DNA, 45 bp, Homo sapiens
cgtacgactcttagcggtggatcactcggctcgtgcgtcgatgaa

SEQ ID NO: 65092 - DNA, 31 bp, Homo sapiens; identical to SEQ ID NO: 3560

SEQ ID NO: 65093 - DNA, 42 bp, Homo sapiens
cgtacgactcttagcggtggatcactcggctcgtgcgtcgat

SEQ ID NO: 65094 - DNA, 43 bp, Homo sapiens
cgtacgactcttagcggtggatcactcggctcgtgcgtcgatg

SEQ ID NO: 65095 - DNA, 34 bp, Homo sapiens; identical to SEQ ID NO: 61701

SEQ ID NO: 65096 - DNA, 41 bp, Homo sapiens; identical to SEQ ID NO: 61706

SEQ ID NO: 65097 - DNA, 35 bp, Homo sapiens; identical to SEQ ID NO: 17346

SEQ ID NO: 65098 - DNA, 37 bp, Homo sapiens; identical to SEQ ID NO: 17348

SEQ ID NO: 65099 - DNA, 42 bp, Homo sapiens
gtacgactcttagcggtggatcactcggctcgtgcgtcgatg

SEQ ID NO: 65100 - DNA, 46 bp, Homo sapiens
gtacgactcttagcggtggatcactcggctcgtgcgtcgatgaaga

SEQ ID NO: 65101 - DNA, 45 bp, Homo sapiens
gtacgactcttagcggtggatcactcggctcgtgcgtcgatgaag

SEQ ID NO: 65102 - DNA, 40 bp, Homo sapiens; identical to SEQ ID NO: 61715

SEQ ID NO: 65103 - DNA, 33 bp, Homo sapiens; identical to SEQ ID NO: 3566

SEQ ID NO: 65104 - DNA, 44 bp, Homo sapiens; identical to SEQ ID NO: 61718

SEQ ID NO: 65105 - DNA, 39 bp, Homo sapiens; identical to SEQ ID NO: 61714

SEQ ID NO: 65106 - DNA, 41 bp, Homo sapiens; identical to SEQ ID NO: 61716

SEQ ID NO: 65107 - DNA, 34 bp, Homo sapiens; identical to SEQ ID NO: 59173

SEQ ID NO: 65108 - DNA, 36 bp, Homo sapiens; identical to SEQ ID NO: 57213

SEQ ID NO: 65109 - DNA, 37 bp, Homo sapiens; identical to SEQ ID NO: 61712

SEQ ID NO: 65110 - DNA, 43 bp, Homo sapiens; identical to SEQ ID NO: 61717

SEQ ID NO: 65111 - DNA, 33 bp, Homo sapiens; identical to SEQ ID NO: 17367

SEQ ID NO: 65112 - DNA, 39 bp, Homo sapiens; identical to SEQ ID NO: 61723

SEQ ID NO: 65113 - DNA, 35 bp, Homo sapiens; identical to SEQ ID NO: 59175

SEQ ID NO: 65114 - DNA, 16 bp, Homo sapiens
acgactcttagcggtg

SEQ ID NO: 65115 - DNA, 20 bp, Homo sapiens
acgactcttagcggtggatc

SEQ ID NO: 65116 - DNA, 41 bp, Homo sapiens
acgactcttagcggtggatcactcggctcgtgcgtcgatga

SEQ ID NO: 65117 - DNA, 42 bp, Homo sapiens
acgactcttagcggtggatcactcggctcgtgcgtcgatgaa

SEQ ID NO: 65118 - DNA, 43 bp, Homo sapiens
acgactcttagcggtggatcactcggctcgtgcgtcgatgaag

SEQ ID NO: 65119 - DNA, 39 bp, Homo sapiens; identical to SEQ ID NO: 61734

SEQ ID NO: 65120 - DNA, 45 bp, Homo sapiens
acgactcttagcggtggatcactcggctcgtgcgtcgatgaagaa

SEQ ID NO: 65121 - DNA, 31 bp, Homo sapiens; identical to SEQ ID NO: 3569

SEQ ID NO: 65122 - DNA, 32 bp, Homo sapiens; identical to SEQ ID NO: 17375

SEQ ID NO: 65123 - DNA, 34 bp, Homo sapiens; identical to SEQ ID NO: 59178

SEQ ID NO: 65124 - DNA, 35 bp, Homo sapiens; identical to SEQ ID NO: 61731

SEQ ID NO: 65125 - DNA, 38 bp, Homo sapiens; identical to SEQ ID NO: 61733

SEQ ID NO: 65126 - DNA, 32 bp, Homo sapiens; identical to SEQ ID NO: 3581

SEQ ID NO: 65127 - DNA, 16 bp, Homo sapiens
cgactcttagcggtgg

SEQ ID NO: 65128 - DNA, 26 bp, Homo sapiens
cgactcttagcggtggatcactcggc

SEQ ID NO: 65129 - DNA, 18 bp, Homo sapiens
cgactcttagcggtggat

SEQ ID NO: 65130 - DNA, 22 bp, Homo sapiens
cgactcttagcggtggatcact

SEQ ID NO: 65131 - DNA, 17 bp, Homo sapiens
cgactcttagcggtgga

SEQ ID NO: 65132 - DNA, 19 bp, Homo sapiens
cgactcttagcggtggatc

SEQ ID NO: 65133 - DNA, 20 bp, Homo sapiens
cgactcttagcggtggatca

SEQ ID NO: 65134 - DNA, 25 bp, Homo sapiens
cgactcttagcggtggatcactcgg

SEQ ID NO: 65135 - DNA, 27 bp, Homo sapiens
cgactcttagcggtggatcactcggct

SEQ ID NO: 65136 - DNA, 28 bp, Homo sapiens
cgactcttagcggtggatcactcggctc

SEQ ID NO: 65137 - DNA, 29 bp, Homo sapiens
cgactcttagcggtggatcactcggctcg

SEQ ID NO: 65138 - DNA, 30 bp, Homo sapiens; identical to SEQ ID NO: 3579

SEQ ID NO: 65139 - DNA, 31 bp, Homo sapiens; identical to SEQ ID NO: 3580

SEQ ID NO: 65140 - DNA, 33 bp, Homo sapiens; identical to SEQ ID NO: 3582

SEQ ID NO: 65141 - DNA, 34 bp, Homo sapiens; identical to SEQ ID NO: 17395

SEQ ID NO: 65142 - DNA, 35 bp, Homo sapiens; identical to SEQ ID NO: 17396

SEQ ID NO: 65143 - DNA, 36 bp, Homo sapiens; identical to SEQ ID NO: 17397

SEQ ID NO: 65144 - DNA, 37 bp, Homo sapiens; identical to SEQ ID NO: 17398

SEQ ID NO: 65145 - DNA, 38 bp, Homo sapiens; identical to SEQ ID NO: 17399

SEQ ID NO: 65146 - DNA, 39 bp, Homo sapiens; identical to SEQ ID NO: 17400

SEQ ID NO: 65147 - DNA, 40 bp, Homo sapiens; identical to SEQ ID NO: 61756

SEQ ID NO: 65148 - DNA, 41 bp, Homo sapiens; identical to SEQ ID NO: 61757

SEQ ID NO: 65149 - DNA, 42 bp, Homo sapiens; identical to SEQ ID NO: 17401

SEQ ID NO: 65150 - DNA, 43 bp, Homo sapiens; identical to SEQ ID NO: 17402

SEQ ID NO: 65151 - DNA, 44 bp, Homo sapiens; identical to SEQ ID NO: 17403

SEQ ID NO: 65152 - DNA, 46 bp, Homo sapiens; identical to SEQ ID NO: 17405

SEQ ID NO: 65153 - DNA, 19 bp, Homo sapiens
gactcttagcggtggatca

SEQ ID NO: 65154 - DNA, 16 bp, Homo sapiens
gactcttagcggtgga

SEQ ID NO: 65155 - DNA, 24 bp, Homo sapiens
gactcttagcggtggatcactcgg

SEQ ID NO: 65156 - DNA, 41 bp, Homo sapiens; identical to SEQ ID NO: 61783

SEQ ID NO: 65157 - DNA, 27 bp, Homo sapiens
gactcttagcggtggatcactcggctc

SEQ ID NO: 65158 - DNA, 37 bp, Homo sapiens; identical to SEQ ID NO: 17423

SEQ ID NO: 65159 - DNA, 25 bp, Homo sapiens
gactcttagcggtggatcactcggc

SEQ ID NO: 65160 - DNA, 42 bp, Homo sapiens
gactcttagcggtggatcactcggctcgtgcgtcgatgaaga

SEQ ID NO: 65161 - DNA, 38 bp, Homo sapiens; identical to SEQ ID NO: 61780

SEQ ID NO: 65162 - DNA, 18 bp, Homo sapiens
gactcttagcggtggatc

SEQ ID NO: 65163 - DNA, 17 bp, Homo sapiens
gactcttagcggtggat

SEQ ID NO: 65164 - DNA, 28 bp, Homo sapiens
gactcttagcggtggatcactcggctcg

SEQ ID NO: 65165 - DNA, 40 bp, Homo sapiens; identical to SEQ ID NO: 61782

SEQ ID NO: 65166 - DNA, 26 bp, Homo sapiens
gactcttagcggtggatcactcggct

SEQ ID NO: 65167 - DNA, 29 bp, Homo sapiens
gactcttagcggtggatcactcggctcgt

SEQ ID NO: 65168 - DNA, 30 bp, Homo sapiens; identical to SEQ ID NO: 3590

SEQ ID NO: 65169 - DNA, 32 bp, Homo sapiens; identical to SEQ ID NO: 3591

SEQ ID NO: 65170 - DNA, 33 bp, Homo sapiens; identical to SEQ ID NO: 17420

SEQ ID NO: 65171 - DNA, 35 bp, Homo sapiens; identical to SEQ ID NO: 61777

SEQ ID NO: 65172 - DNA, 36 bp, Homo sapiens; identical to SEQ ID NO: 17422

SEQ ID NO: 65173 - DNA, 39 bp, Homo sapiens; identical to SEQ ID NO: 61781

SEQ ID NO: 65174 - DNA, 43 bp, Homo sapiens; identical to SEQ ID NO: 61784

SEQ ID NO: 65175 - DNA, 45 bp, Homo sapiens; identical to SEQ ID NO: 61785

SEQ ID NO: 65176 - DNA, 32 bp, Homo sapiens; identical to SEQ ID NO: 17435

SEQ ID NO: 65177 - DNA, 31 bp, Homo sapiens; identical to SEQ ID NO: 17434

SEQ ID NO: 65178 - DNA, 37 bp, Homo sapiens
gcggtggatcactcggctcgtgcgtcgatgaagaacg

SEQ ID NO: 65179 - DNA, 23 bp, Homo sapiens
cggtggatcactcggctcgtgcg

SEQ ID NO: 65180 - DNA, 36 bp, Homo sapiens; identical to SEQ ID NO: 17463

SEQ ID NO: 65181 - DNA, 35 bp, Homo sapiens
ttcctcccggggctacgcctgtctgagcgtcgctt

SEQ ID NO: 65182 - DNA, 34 bp, Homo sapiens; identical to SEQ ID NO: 17993

SEQ ID NO: 65183 - DNA, 33 bp, Homo sapiens; identical to SEQ ID NO: 3741

SEQ ID NO: 65184 - DNA, 34 bp, Homo sapiens; identical to SEQ ID NO: 18002

SEQ ID NO: 65185 - DNA, 33 bp, Homo sapiens; identical to SEQ ID NO: 18007

SEQ ID NO: 65186 - DNA, 32 bp, Homo sapiens; identical to SEQ ID NO: 3743

SEQ ID NO: 65187 - DNA, 27 bp, Homo sapiens
cggggctacgcctgtctgagcgtcgct

SEQ ID NO: 65188 - DNA, 26 bp, Homo sapiens
ggggctacgcctgtctgagcgtcgct

SEQ ID NO: 65189 - DNA, 25 bp, Homo sapiens
gggctacgcctgtctgagcgtcgct

SEQ ID NO: 65190 - DNA, 24 bp, Homo sapiens
ggctacgcctgtctgagcgtcgct

SEQ ID NO: 65191 - DNA, 22 bp, Homo sapiens
ctacgcctgtctgagcgtcgct

SEQ ID NO: 65192 - DNA, 21 bp, Homo sapiens
tacgcctgtctgagcgtcgct

SEQ ID NO: 65193 - DNA, 21 bp, Homo sapiens
acgcctgtctgagcgtcgctt

SEQ ID NO: 65194 - DNA, 20 bp, Homo sapiens
acgcctgtctgagcgtcgct

SEQ ID NO: 65195 - DNA, 19 bp, Homo sapiens
cgcctgtctgagcgtcgct

SEQ ID NO: 65196 - DNA, 20 bp, Homo sapiens
cgcctgtctgagcgtcgctt

SEQ ID NO: 65197 - DNA, 17 bp, Homo sapiens
cctgtctgagcgtcgct

SEQ ID NO: 65198 - DNA, 16 bp, Homo sapiens
gacgcgacctcagatc

SEQ ID NO: 65199 - DNA, 30 bp, Homo sapiens; identical to SEQ ID NO: 3832

SEQ ID NO: 65200 - DNA, 19 bp, Homo sapiens
gacgcgacctcagatcaga

SEQ ID NO: 65201 - DNA, 20 bp, Homo sapiens
gacgcgacctcagatcagac

SEQ ID NO: 65202 - DNA, 36 bp, Homo sapiens; identical to SEQ ID NO: 18198

SEQ ID NO: 65203 - DNA, 35 bp, Homo sapiens; identical to SEQ ID NO: 18197

SEQ ID NO: 65204 - DNA, 33 bp, Homo sapiens; identical to SEQ ID NO: 3835

SEQ ID NO: 65205 - DNA, 22 bp, Homo sapiens
acgcgacctcagatcagacgtg

SEQ ID NO: 65206 - DNA, 30 bp, Homo sapiens; identical to SEQ ID NO: 3848

SEQ ID NO: 65207 - DNA, 31 bp, Homo sapiens; identical to SEQ ID NO: 3849

SEQ ID NO: 65208 - DNA, 44 bp, Homo sapiens; identical to SEQ ID NO: 18236

SEQ ID NO: 65209 - DNA, 28 bp, Homo sapiens
acgcgacctcagatcagacgtggcgacc

SEQ ID NO: 65210 - DNA, 29 bp, Homo sapiens
acgcgacctcagatcagacgtggcgaccc

SEQ ID NO: 65211 - DNA, 45 bp, Homo sapiens; identical to SEQ ID NO: 18237

SEQ ID NO: 65212 - DNA, 20 bp, Homo sapiens
acgcgacctcagatcagacg

SEQ ID NO: 65213 - DNA, 25 bp, Homo sapiens
acgcgacctcagatcagacgtggcg

SEQ ID NO: 65214 - DNA, 43 bp, Homo sapiens; identical to SEQ ID NO: 18235

SEQ ID NO: 65215 - DNA, 18 bp, Homo sapiens
acgcgacctcagatcaga

SEQ ID NO: 65216 - DNA, 19 bp, Homo sapiens
acgcgacctcagatcagac

SEQ ID NO: 65217 - DNA, 21 bp, Homo sapiens
acgcgacctcagatcagacgt

SEQ ID NO: 65218 - DNA, 32 bp, Homo sapiens; identical to SEQ ID NO: 3850

SEQ ID NO: 65219 - DNA, 34 bp, Homo sapiens; identical to SEQ ID NO: 18226

SEQ ID NO: 65220 - DNA, 35 bp, Homo sapiens; identical to SEQ ID NO: 18227

SEQ ID NO: 65221 - DNA, 36 bp, Homo sapiens; identical to SEQ ID NO: 18228

SEQ ID NO: 65222 - DNA, 37 bp, Homo sapiens; identical to SEQ ID NO: 18229

SEQ ID NO: 65223 - DNA, 38 bp, Homo sapiens; identical to SEQ ID NO: 18230

SEQ ID NO: 65224 - DNA, 42 bp, Homo sapiens; identical to SEQ ID NO: 18234

SEQ ID NO: 65225 - DNA, 16 bp, Homo sapiens
cgcgacctcagatcag

SEQ ID NO: 65226 - DNA, 39 bp, Homo sapiens; identical to SEQ ID NO: 18263

SEQ ID NO: 65227 - DNA, 45 bp, Homo sapiens; identical to SEQ ID NO: 18269

SEQ ID NO: 65228 - DNA, 46 bp, Homo sapiens; identical to SEQ ID NO: 18270

SEQ ID NO: 65229 - DNA, 17 bp, Homo sapiens
cgcgacctcagatcaga

SEQ ID NO: 65230 - DNA, 18 bp, Homo sapiens
cgcgacctcagatcagac

SEQ ID NO: 65231 - DNA, 19 bp, Homo sapiens
cgcgacctcagatcagacg

SEQ ID NO: 65232 - DNA, 20 bp, Homo sapiens
cgcgacctcagatcagacgt

SEQ ID NO: 65233 - DNA, 21 bp, Homo sapiens
cgcgacctcagatcagacgtg

SEQ ID NO: 65234 - DNA, 22 bp, Homo sapiens
cgcgacctcagatcagacgtgg

SEQ ID NO: 65235 - DNA, 23 bp, Homo sapiens
cgcgacctcagatcagacgtggc

SEQ ID NO: 65236 - DNA, 24 bp, Homo sapiens
cgcgacctcagatcagacgtggcg

SEQ ID NO: 65237 - DNA, 25 bp, Homo sapiens
cgcgacctcagatcagacgtggcga

SEQ ID NO: 65238 - DNA, 26 bp, Homo sapiens
cgcgacctcagatcagacgtggcgac

SEQ ID NO: 65239 - DNA, 27 bp, Homo sapiens
cgcgacctcagatcagacgtggcgacc

SEQ ID NO: 65240 - DNA, 28 bp, Homo sapiens
cgcgacctcagatcagacgtggcgaccc

SEQ ID NO: 65241 - DNA, 29 bp, Homo sapiens
cgcgacctcagatcagacgtggcgacccg

SEQ ID NO: 65242 - DNA, 30 bp, Homo sapiens; identical to SEQ ID NO: 3865

SEQ ID NO: 65243 - DNA, 31 bp, Homo sapiens; identical to SEQ ID NO: 3866

SEQ ID NO: 65244 - DNA, 32 bp, Homo sapiens; identical to SEQ ID NO: 3867

SEQ ID NO: 65245 - DNA, 33 bp, Homo sapiens; identical to SEQ ID NO: 3868

SEQ ID NO: 65246 - DNA, 34 bp, Homo sapiens; identical to SEQ ID NO: 18258

SEQ ID NO: 65247 - DNA, 35 bp, Homo sapiens; identical to SEQ ID NO: 18259

SEQ ID NO: 65248 - DNA, 36 bp, Homo sapiens; identical to SEQ ID NO: 18260

SEQ ID NO: 65249 - DNA, 37 bp, Homo sapiens; identical to SEQ ID NO: 18261

SEQ ID NO: 65250 - DNA, 38 bp, Homo sapiens; identical to SEQ ID NO: 18262

SEQ ID NO: 65251 - DNA, 40 bp, Homo sapiens; identical to SEQ ID NO: 18264

SEQ ID NO: 65252 - DNA, 41 bp, Homo sapiens; identical to SEQ ID NO: 18265

SEQ ID NO: 65253 - DNA, 42 bp, Homo sapiens; identical to SEQ ID NO: 18266

SEQ ID NO: 65254 - DNA, 43 bp, Homo sapiens; identical to SEQ ID NO: 18267

SEQ ID NO: 65255 - DNA, 44 bp, Homo sapiens; identical to SEQ ID NO: 18268

SEQ ID NO: 65256 - DNA, 18 bp, Homo sapiens
gcgacctcagatcagacg

SEQ ID NO: 65257 - DNA, 41 bp, Homo sapiens; identical to SEQ ID NO: 18293

SEQ ID NO: 65258 - DNA, 34 bp, Homo sapiens; identical to SEQ ID NO: 18287

SEQ ID NO: 65259 - DNA, 32 bp, Homo sapiens; identical to SEQ ID NO: 3878

SEQ ID NO: 65260 - DNA, 35 bp, Homo sapiens; identical to SEQ ID NO: 18288

SEQ ID NO: 65261 - DNA, 30 bp, Homo sapiens; identical to SEQ ID NO: 3876

SEQ ID NO: 65262 - DNA, 19 bp, Homo sapiens
gcgacctcagatcagacgt

SEQ ID NO: 65263 - DNA, 33 bp, Homo sapiens; identical to SEQ ID NO: 3879

SEQ ID NO: 65264 - DNA, 18 bp, Homo sapiens
cgacctcagatcagacgt

SEQ ID NO: 65265 - DNA, 17 bp, Homo sapiens
gacctcagatcagacgt

SEQ ID NO: 65266 - DNA, 39 bp, Homo sapiens; identical to SEQ ID NO: 18330

SEQ ID NO: 65267 - DNA, 38 bp, Homo sapiens; identical to SEQ ID NO: 18345

SEQ ID NO: 65268 - DNA, 41 bp, Homo sapiens
gagtgaacagggaagagcccagcgccgaatccccgccccgc

SEQ ID NO: 65269 - DNA, 38 bp, Homo sapiens; identical to SEQ ID NO: 61903

SEQ ID NO: 65270 - DNA, 22 bp, Homo sapiens
agagcccagcgccgaatccccg

SEQ ID NO: 65271 - DNA, 18 bp, Homo sapiens
gagcccagcgccgaatcc

SEQ ID NO: 65272 - DNA, 25 bp, Homo sapiens
gagcccagcgccgaatccccgcccc

SEQ ID NO: 65273 - DNA, 26 bp, Homo sapiens
gagcccagcgccgaatccccgccccg

SEQ ID NO: 65274 - DNA, 27 bp, Homo sapiens
gagcccagcgccgaatccccgccccgc

SEQ ID NO: 65275 - DNA, 19 bp, Homo sapiens
gagcccagcgccgaatccc

SEQ ID NO: 65276 - DNA, 20 bp, Homo sapiens
gagcccagcgccgaatcccc

SEQ ID NO: 65277 - DNA, 21 bp, Homo sapiens
gagcccagcgccgaatccccg

SEQ ID NO: 65278 - DNA, 23 bp, Homo sapiens
gagcccagcgccgaatccccgcc

SEQ ID NO: 65279 - DNA, 22 bp, Homo sapiens
gagcccagcgccgaatccccgc

SEQ ID NO: 65280 - DNA, 24 bp, Homo sapiens
gagcccagcgccgaatccccgccc

SEQ ID NO: 65281 - DNA, 25 bp, Homo sapiens
agcccagcgccgaatccccgccccg

SEQ ID NO: 65282 - DNA, 18 bp, Homo sapiens
agcccagcgccgaatccc

SEQ ID NO: 65283 - DNA, 21 bp, Homo sapiens
agcccagcgccgaatccccgc

SEQ ID NO: 65284 - DNA, 22 bp, Homo sapiens
agcccagcgccgaatccccgcc

SEQ ID NO: 65285 - DNA, 19 bp, Homo sapiens
agcccagcgccgaatcccc

SEQ ID NO: 65286 - DNA, 20 bp, Homo sapiens
agcccagcgccgaatccccg

SEQ ID NO: 65287 - DNA, 35 bp, Homo sapiens; identical to SEQ ID NO: 57409

SEQ ID NO: 65288 - DNA, 23 bp, Homo sapiens
cgcgggacatgtggcgtacggaa

SEQ ID NO: 65289 - DNA, 24 bp, Homo sapiens
cgcgggacatgtggcgtacggaag

SEQ ID NO: 65290 - DNA, 25 bp, Homo sapiens
cgcgggacatgtggcgtacggaaga

SEQ ID NO: 65291 - DNA, 26 bp, Homo sapiens
cgcgggacatgtggcgtacggaagac

SEQ ID NO: 65292 - DNA, 27 bp, Homo sapiens
cgcgggacatgtggcgtacggaagacc

SEQ ID NO: 65293 - DNA, 37 bp, Homo sapiens
cgcgggacatgtggcgtacggaagacccgctccccgg

SEQ ID NO: 65294 - DNA, 25 bp, Homo sapiens
agcccgtggacggtgtgaggccggt

SEQ ID NO: 65295 - DNA, 35 bp, Homo sapiens
actccatctaaggctaaataccggcacgagaccga

SEQ ID NO: 65296 - DNA, 31 bp, Homo sapiens
tccatctaaggctaaataccggcacgagacc

SEQ ID NO: 65297 - DNA, 27 bp, Homo sapiens
tccatctaaggctaaataccggcacga

SEQ ID NO: 65298 - DNA, 29 bp, Homo sapiens
tccatctaaggctaaataccggcacgaga

SEQ ID NO: 65299 - DNA, 33 bp, Homo sapiens
tccatctaaggctaaataccggcacgagaccga

SEQ ID NO: 65300 - DNA, 29 bp, Homo sapiens
ccatctaaggctaaataccggcacgagac

SEQ ID NO: 65301 - DNA, 30 bp, Homo sapiens; identical to SEQ ID NO: 41278

SEQ ID NO: 65302 - DNA, 32 bp, Homo sapiens
ccatctaaggctaaataccggcacgagaccga

SEQ ID NO: 65303 - DNA, 28 bp, Homo sapiens
ccatctaaggctaaataccggcacgaga

SEQ ID NO: 65304 - DNA, 35 bp, Homo sapiens; identical to SEQ ID NO: 57469

SEQ ID NO: 65305 - DNA, 43 bp, Homo sapiens; identical to SEQ ID NO: 63357

SEQ ID NO: 65306 - DNA, 25 bp, Homo sapiens
cccggcggatctttcccgccccccg

SEQ ID NO: 65307 - DNA, 46 bp, Homo sapiens; identical to SEQ ID NO: 63360

SEQ ID NO: 65308 - DNA, 26 bp, Homo sapiens
cccggcggatctttcccgccccccgt

SEQ ID NO: 65309 - DNA, 20 bp, Homo sapiens
cgaccggccgccgccgggcg

SEQ ID NO: 65310 - DNA, 36 bp, Homo sapiens; identical to SEQ ID NO: 63105

SEQ ID NO: 65311 - DNA, 36 bp, Homo sapiens; identical to SEQ ID NO: 57624

SEQ ID NO: 65312 - DNA, 35 bp, Homo sapiens; identical to SEQ ID NO: 61998

SEQ ID NO: 65313 - DNA, 34 bp, Homo sapiens; identical to SEQ ID NO: 62001

SEQ ID NO: 65314 - DNA, 30 bp, Homo sapiens; identical to SEQ ID NO: 19759

SEQ ID NO: 65315 - DNA, 24 bp, Homo sapiens
aatcccggggccgagggagcgaga

SEQ ID NO: 65316 - DNA, 19 bp, Homo sapiens
cgcccacccccgcggggaa

SEQ ID NO: 65317 - DNA, 18 bp, Homo sapiens
ggactgtccccagtgcgc

SEQ ID NO: 65318 - DNA, 39 bp, Homo sapiens
gagcgcacggggtcggcggcgacgtcggctacccacccg

SEQ ID NO: 65319 - DNA, 20 bp, Homo sapiens
gcacggggtcggcggcgacg

SEQ ID NO: 65320 - DNA, 16 bp, Homo sapiens
tctaacacgtgcgcga

SEQ ID NO: 65321 - DNA, 33 bp, Homo sapiens; identical to SEQ ID NO: 20454

SEQ ID NO: 65322 - DNA, 18 bp, Homo sapiens
cgcccgccgcgccgggga

SEQ ID NO: 65323 - DNA, 21 bp, Homo sapiens
agcgcacgtgttaggacccga

SEQ ID NO: 65324 - DNA, 20 bp, Homo sapiens
gcgcacgtgttaggacccga

SEQ ID NO: 65325 - DNA, 19 bp, Homo sapiens
cgcacgtgttaggacccga

SEQ ID NO: 65326 - DNA, 46 bp, Homo sapiens
acccccgccacgcagttttatccggtaaagcgaatgattagaggtc

SEQ ID NO: 65327 - DNA, 32 bp, Homo sapiens; identical to SEQ ID NO: 62920

SEQ ID NO: 65328 - DNA, 33 bp, Homo sapiens
cccccgccacgcagttttatccggtaaagcgaa

SEQ ID NO: 65329 - DNA, 46 bp, Homo sapiens; identical to SEQ ID NO: 62922

SEQ ID NO: 65330 - DNA, 45 bp, Homo sapiens; identical to SEQ ID NO: 62048

SEQ ID NO: 65331 - DNA, 45 bp, Homo sapiens; identical to SEQ ID NO: 62925

SEQ ID NO: 65332 - DNA, 44 bp, Homo sapiens; identical to SEQ ID NO: 62053

SEQ ID NO: 65333 - DNA, 30 bp, Homo sapiens
cccgccacgcagttttatccggtaaagcga

SEQ ID NO: 65334 - DNA, 43 bp, Homo sapiens; identical to SEQ ID NO: 57761

SEQ ID NO: 65335 - DNA, 26 bp, Homo sapiens
ccccgcggacgctacgccgcgacgag

SEQ ID NO: 65336 - DNA, 34 bp, Homo sapiens; identical to SEQ ID NO: 62075

SEQ ID NO: 65337 - DNA, 32 bp, Homo sapiens; identical to SEQ ID NO: 4742

SEQ ID NO: 65338 - DNA, 33 bp, Homo sapiens
gggccgctgcggtgagccttgaagcctagggcg

SEQ ID NO: 65339 - DNA, 31 bp, Homo sapiens; identical to SEQ ID NO: 22212

SEQ ID NO: 65340 - DNA, 41 bp, Homo sapiens; identical to SEQ ID NO: 62077

SEQ ID NO: 65341 - DNA, 37 bp, Homo sapiens
ggagccgccgcaggtgcagatcttggtggtagtagca

SEQ ID NO: 65342 - DNA, 23 bp, Homo sapiens
ggcgtccagtgcggtaacgcgac

SEQ ID NO: 65343 - DNA, 26 bp, Homo sapiens
ggcgtccagtgcggtaacgcgaccga

SEQ ID NO: 65344 - DNA, 24 bp, Homo sapiens
ggcgtccagtgcggtaacgcgacc

SEQ ID NO: 65345 - DNA, 22 bp, Homo sapiens
ggcgtccagtgcggtaacgcga

SEQ ID NO: 65346 - DNA, 22 bp, Homo sapiens
tccagtgcggtaacgcgaccga

SEQ ID NO: 65347 - DNA, 21 bp, Homo sapiens
ccagtgcggtaacgcgaccga

SEQ ID NO: 65348 - DNA, 21 bp, Homo sapiens
agccggcgggagccccgggga

SEQ ID NO: 65349 - DNA, 18 bp, Homo sapiens
gccggcgggagccccggg

SEQ ID NO: 65350 - DNA, 20 bp, Homo sapiens
gccggcgggagccccgggga

SEQ ID NO: 65351 - DNA, 30 bp, Homo sapiens; identical to SEQ ID NO: 5051

SEQ ID NO: 65352 - DNA, 32 bp, Homo sapiens; identical to SEQ ID NO: 23261

SEQ ID NO: 65353 - DNA, 32 bp, Homo sapiens; identical to SEQ ID NO: 62125

SEQ ID NO: 65354 - DNA, 31 bp, Homo sapiens; identical to SEQ ID NO: 5063

SEQ ID NO: 65355 - DNA, 16 bp, Homo sapiens
gagctctcgctggccc

SEQ ID NO: 65356 - DNA, 34 bp, Homo sapiens; identical to SEQ ID NO: 24068

SEQ ID NO: 65357 - DNA, 21 bp, Homo sapiens
cccgctccccgtcctcccccc

SEQ ID NO: 65358 - DNA, 22 bp, Homo sapiens
cccgctccccgtcctcccccct

SEQ ID NO: 65359 - DNA, 19 bp, Homo sapiens
gctccccgtcctcccccct

SEQ ID NO: 65360 - DNA, 19 bp, Homo sapiens
tcccgtggatcgccccagc

SEQ ID NO: 65361 - DNA, 20 bp, Homo sapiens
tcccgtggatcgccccagct

SEQ ID NO: 65362 - DNA, 17 bp, Homo sapiens
cccggcgggcgccggcg

SEQ ID NO: 65363 - DNA, 21 bp, Homo sapiens
gccccccgttcccccctcctc

SEQ ID NO: 65364 - DNA, 18 bp, Homo sapiens
agcagccgacttagaact

SEQ ID NO: 65365 - DNA, 17 bp, Homo sapiens
gcagccgacttagaact

SEQ ID NO: 65366 - DNA, 20 bp, Homo sapiens
aaagcatcgcgaaggcccgc

SEQ ID NO: 65367 - DNA, 20 bp, Homo sapiens
cggcgggtgttgacgcgatg

SEQ ID NO: 65368 - DNA, 17 bp, Homo sapiens
ggcgggtgttgacgcga

SEQ ID NO: 65369 - DNA, 22 bp, Homo sapiens
ggcgggtgttgacgcgatgtga

SEQ ID NO: 65370 - DNA, 18 bp, Homo sapiens
gcgggtgttgacgcgatg

SEQ ID NO: 65371 - DNA, 16 bp, Homo sapiens
gcgggtgttgacgcga

SEQ ID NO: 65372 - DNA, 21 bp, Homo sapiens
gcgggtgttgacgcgatgtga

SEQ ID NO: 65373 - DNA, 42 bp, Homo sapiens; identical to SEQ ID NO: 62521

SEQ ID NO: 65374 - DNA, 43 bp, Homo sapiens; identical to SEQ ID NO: 62522

SEQ ID NO: 65375 - DNA, 35 bp, Homo sapiens; identical to SEQ ID NO: 25842

SEQ ID NO: 65376 - DNA, 37 bp, Homo sapiens; identical to SEQ ID NO: 63502

SEQ ID NO: 65377 - DNA, 30 bp, Homo sapiens; identical to SEQ ID NO: 5841

SEQ ID NO: 65378 - DNA, 25 bp, Homo sapiens
gcgggccgccggtgaaataccacta

SEQ ID NO: 65379 - DNA, 26 bp, Homo sapiens
gcgggccgccggtgaaataccactac

SEQ ID NO: 65380 - DNA, 31 bp, Homo sapiens; identical to SEQ ID NO: 5842

SEQ ID NO: 65381 - DNA, 27 bp, Homo sapiens
gcgggccgccggtgaaataccactact

SEQ ID NO: 65382 - DNA, 29 bp, Homo sapiens
cgggccgccggtgaaataccactactctg

SEQ ID NO: 65383 - DNA, 30 bp, Homo sapiens; identical to SEQ ID NO: 5848

SEQ ID NO: 65384 - DNA, 24 bp, Homo sapiens
cgggccgccggtgaaataccacta

SEQ ID NO: 65385 - DNA, 25 bp, Homo sapiens
cgggccgccggtgaaataccactac

SEQ ID NO: 65386 - DNA, 26 bp, Homo sapiens
cgggccgccggtgaaataccactact

SEQ ID NO: 65387 - DNA, 28 bp, Homo sapiens
gggccgccggtgaaataccactactctg

SEQ ID NO: 65388 - DNA, 23 bp, Homo sapiens
gggccgccggtgaaataccacta

SEQ ID NO: 65389 - DNA, 29 bp, Homo sapiens
gggccgccggtgaaataccactactctga

SEQ ID NO: 65390 - DNA, 24 bp, Homo sapiens
gggccgccggtgaaataccactac

SEQ ID NO: 65391 - DNA, 25 bp, Homo sapiens
gggccgccggtgaaataccactact

SEQ ID NO: 65392 - DNA, 22 bp, Homo sapiens
ggccgccggtgaaataccacta

SEQ ID NO: 65393 - DNA, 26 bp, Homo sapiens
ggccgccggtgaaataccactactct

SEQ ID NO: 65394 - DNA, 29 bp, Homo sapiens
ggccgccggtgaaataccactactctgat

SEQ ID NO: 65395 - DNA, 25 bp, Homo sapiens
ggccgccggtgaaataccactactc

SEQ ID NO: 65396 - DNA, 23 bp, Homo sapiens
ggccgccggtgaaataccactac

SEQ ID NO: 65397 - DNA, 27 bp, Homo sapiens
ggccgccggtgaaataccactactctg

SEQ ID NO: 65398 - DNA, 24 bp, Homo sapiens
ggccgccggtgaaataccactact

SEQ ID NO: 65399 - DNA, 28 bp, Homo sapiens
ggccgccggtgaaataccactactctga

SEQ ID NO: 65400 - DNA, 45 bp, Homo sapiens
gccgccggtgaaataccactactctgatcgttttttcactgaccc

SEQ ID NO: 65401 - DNA, 21 bp, Homo sapiens
gccgccggtgaaataccacta

SEQ ID NO: 65402 - DNA, 28 bp, Homo sapiens
gccgccggtgaaataccactactctgat

SEQ ID NO: 65403 - DNA, 25 bp, Homo sapiens
gccgccggtgaaataccactactct

SEQ ID NO: 65404 - DNA, 46 bp, Homo sapiens; identical to SEQ ID NO: 61161

SEQ ID NO: 65405 - DNA, 24 bp, Homo sapiens
gccgccggtgaaataccactactc

SEQ ID NO: 65406 - DNA, 26 bp, Homo sapiens
gccgccggtgaaataccactactctg

SEQ ID NO: 65407 - DNA, 22 bp, Homo sapiens
gccgccggtgaaataccactac

SEQ ID NO: 65408 - DNA, 23 bp, Homo sapiens
gccgccggtgaaataccactact

SEQ ID NO: 65409 - DNA, 27 bp, Homo sapiens
gccgccggtgaaataccactactctga

SEQ ID NO: 65410 - DNA, 23 bp, Homo sapiens
ccgccggtgaaataccactactc

SEQ ID NO: 65411 - DNA, 22 bp, Homo sapiens
ccgccggtgaaataccactact

SEQ ID NO: 65412 - DNA, 32 bp, Homo sapiens; identical to SEQ ID NO: 27767

SEQ ID NO: 65413 - DNA, 46 bp, Homo sapiens; identical to SEQ ID NO: 58144

SEQ ID NO: 65414 - DNA, 45 bp, Homo sapiens; identical to SEQ ID NO: 62965

SEQ ID NO: 65415 - DNA, 34 bp, Homo sapiens; identical to SEQ ID NO: 62647

SEQ ID NO: 65416 - DNA, 41 bp, Homo sapiens; identical to SEQ ID NO: 58141

SEQ ID NO: 65417 - DNA, 42 bp, Homo sapiens; identical to SEQ ID NO: 58142

SEQ ID NO: 65418 - DNA, 43 bp, Homo sapiens; identical to SEQ ID NO: 61281

SEQ ID NO: 65419 - DNA, 40 bp, Homo sapiens; identical to SEQ ID NO: 27768

SEQ ID NO: 65420 - DNA, 30 bp, Homo sapiens; identical to SEQ ID NO: 27776

SEQ ID NO: 65421 - DNA, 36 bp, Homo sapiens; identical to SEQ ID NO: 27809

SEQ ID NO: 65422 - DNA, 37 bp, Homo sapiens; identical to SEQ ID NO: 58159

SEQ ID NO: 65423 - DNA, 22 bp, Homo sapiens
ggagcctcggttggcctcggat

SEQ ID NO: 65424 - DNA, 30 bp, Homo sapiens; identical to SEQ ID NO: 6334

SEQ ID NO: 65425 - DNA, 36 bp, Homo sapiens; identical to SEQ ID NO: 58158

SEQ ID NO: 65426 - DNA, 33 bp, Homo sapiens; identical to SEQ ID NO: 62658

SEQ ID NO: 65427 - DNA, 35 bp, Homo sapiens; identical to SEQ ID NO: 58157

SEQ ID NO: 65428 - DNA, 36 bp, Homo sapiens; identical to SEQ ID NO: 58166

SEQ ID NO: 65429 - DNA, 35 bp, Homo sapiens; identical to SEQ ID NO: 58165

SEQ ID NO: 65430 - DNA, 29 bp, Homo sapiens
gagcctcggttggcctcggatagccggtc

SEQ ID NO: 65431 - DNA, 32 bp, Homo sapiens; identical to SEQ ID NO: 58162

SEQ ID NO: 65432 - DNA, 34 bp, Homo sapiens; identical to SEQ ID NO: 27825

SEQ ID NO: 65433 - DNA, 33 bp, Homo sapiens; identical to SEQ ID NO: 6337

SEQ ID NO: 65434 - DNA, 31 bp, Homo sapiens; identical to SEQ ID NO: 58168

SEQ ID NO: 65435 - DNA, 30 bp, Homo sapiens
gcctcggttggcctcggatagccggtcccc

SEQ ID NO: 65436 - DNA, 34 bp, Homo sapiens
gcctcggttggcctcggatagccggtcccccgcc

SEQ ID NO: 65437 - DNA, 27 bp, Homo sapiens
gtccggtgcggagtgcccttcgtcctg

SEQ ID NO: 65438 - DNA, 39 bp, Homo sapiens; identical to SEQ ID NO: 58207

SEQ ID NO: 65439 - DNA, 38 bp, Homo sapiens; identical to SEQ ID NO: 61371

SEQ ID NO: 65440 - DNA, 33 bp, Homo sapiens
ctcgcccgtcacgcaccgcacgttcgtggggaa

SEQ ID NO: 65441 - DNA, 32 bp, Homo sapiens
tcgcccgtcacgcaccgcacgttcgtggggaa

SEQ ID NO: 65442 - DNA, 38 bp, Homo sapiens; identical to SEQ ID NO: 61401

SEQ ID NO: 65443 - DNA, 37 bp, Homo sapiens; identical to SEQ ID NO: 62687

SEQ ID NO: 65444 - DNA, 46 bp, Homo sapiens; identical to SEQ ID NO: 28404

SEQ ID NO: 65445 - DNA, 37 bp, Homo sapiens; identical to SEQ ID NO: 62691

SEQ ID NO: 65446 - DNA, 42 bp, Homo sapiens; identical to SEQ ID NO: 28411

SEQ ID NO: 65447 - DNA, 44 bp, Homo sapiens; identical to SEQ ID NO: 28412

SEQ ID NO: 65448 - DNA, 46 bp, Homo sapiens; identical to SEQ ID NO: 28414

SEQ ID NO: 65449 - DNA, 36 bp, Homo sapiens; identical to SEQ ID NO: 28409

SEQ ID NO: 65450 - DNA, 45 bp, Homo sapiens; identical to SEQ ID NO: 28413

SEQ ID NO: 65451 - DNA, 45 bp, Homo sapiens
tcgctgcgatctattgaaagtcagccctcgacacaagggtttgtc

SEQ ID NO: 65452 - DNA, 43 bp, Homo sapiens; identical to SEQ ID NO: 28424

SEQ ID NO: 65453 - DNA, 35 bp, Homo sapiens; identical to SEQ ID NO: 58227

SEQ ID NO: 65454 - DNA, 44 bp, Homo sapiens; identical to SEQ ID NO: 28425

SEQ ID NO: 65455 - DNA, 34 bp, Homo sapiens; identical to SEQ ID NO: 58230

SEQ ID NO: 65456 - DNA, 43 bp, Homo sapiens; identical to SEQ ID NO: 28437

SEQ ID NO: 65457 - DNA, 41 bp, Homo sapiens; identical to SEQ ID NO: 28443

SEQ ID NO: 65458 - DNA, 33 bp, Homo sapiens; identical to SEQ ID NO: 58233

SEQ ID NO: 65459 - DNA, 42 bp, Homo sapiens; identical to SEQ ID NO: 28444

SEQ ID NO: 65460 - DNA, 43 bp, Homo sapiens; identical to SEQ ID NO: 62707

SEQ ID NO: 65461 - DNA, 39 bp, Homo sapiens; identical to SEQ ID NO: 58236

SEQ ID NO: 65462 - DNA, 37 bp, Homo sapiens; identical to SEQ ID NO: 63028

SEQ ID NO: 65463 - DNA, 36 bp, Homo sapiens; identical to SEQ ID NO: 28453

SEQ ID NO: 65464 - DNA, 34 bp, Homo sapiens; identical to SEQ ID NO: 58238

SEQ ID NO: 65465 - DNA, 33 bp, Homo sapiens; identical to SEQ ID NO: 6508

SEQ ID NO: 65466 - DNA, 32 bp, Homo sapiens; identical to SEQ ID NO: 6511

SEQ ID NO: 65467 - DNA, 28 bp, Homo sapiens
gaaagtcagccctcgacacaagggtttg

SEQ ID NO: 65468 - DNA, 29 bp, Homo sapiens
gaaagtcagccctcgacacaagggtttgt

SEQ ID NO: 65469 - DNA, 27 bp, Homo sapiens
aagtcagccctcgacacaagggtttgt

SEQ ID NO: 65470 - DNA, 25 bp, Homo sapiens
gtcagccctcgacacaagggtttgt

SEQ ID NO: 65471 - DNA, 19 bp, Homo sapiens
cctcgacacaagggtttgt

SEQ ID NO: 65472 - DNA, 17 bp, Homo sapiens
tcgacacaagggtttgt

SEQ ID NO: 65473 - DNA, 16 bp, Homo sapiens
cgacacaagggtttgt

SEQ ID NO: 65474 - DNA, 38 bp, Homo sapiens; identical to SEQ ID NO: 64498

SEQ ID NO: 65475 - DNA, 39 bp, Homo sapiens; identical to SEQ ID NO: 64499

SEQ ID NO: 65476 - DNA, 31 bp, Homo sapiens; identical to SEQ ID NO: 64119

SEQ ID NO: 65477 - DNA, 37 bp, Homo sapiens; identical to SEQ ID NO: 64501

SEQ ID NO: 65478 - DNA, 38 bp, Homo sapiens; identical to SEQ ID NO: 64502

SEQ ID NO: 65479 - DNA, 44 bp, Homo sapiens; identical to SEQ ID NO: 64503

SEQ ID NO: 65480 - DNA, 30 bp, Homo sapiens; identical to SEQ ID NO: 64120

SEQ ID NO: 65481 - DNA, 18 bp, Homo sapiens
aaacctagccccaaaccc

SEQ ID NO: 65482 - DNA, 42 bp, Homo sapiens; identical to SEQ ID NO: 64206

SEQ ID NO: 65483 - DNA, 36 bp, Homo sapiens; identical to SEQ ID NO: 63919

SEQ ID NO: 65484 - DNA, 37 bp, Homo sapiens; identical to SEQ ID NO: 63846

SEQ ID NO: 65485 - DNA, 44 bp, Homo sapiens; identical to SEQ ID NO: 63842

SEQ ID NO: 65486 - DNA, 46 bp, Homo sapiens; identical to SEQ ID NO: 63841

SEQ ID NO: 65487 - DNA, 30 bp, Homo sapiens; identical to SEQ ID NO: 64930

SEQ ID NO: 65488 - DNA, 22 bp, Homo sapiens
aacaaaactgctcgccagaaca

SEQ ID NO: 65489 - DNA, 34 bp, Homo sapiens; identical to SEQ ID NO: 63944

SEQ ID NO: 65490 - DNA, 32 bp, Homo sapiens; identical to SEQ ID NO: 64351

SEQ ID NO: 65491 - DNA, 43 bp, Homo sapiens; identical to SEQ ID NO: 64413

SEQ ID NO: 65492 - DNA, 18 bp, Homo sapiens
aacagctaaaagagcaca

SEQ ID NO: 65493 - DNA, 20 bp, Homo sapiens
aacagctaaaagagcacacc

SEQ ID NO: 65494 - DNA, 21 bp, Homo sapiens
aacagctaaaagagcacaccc

SEQ ID NO: 65495 - DNA, 22 bp, Homo sapiens
aacagctaaaagagcacacccg

SEQ ID NO: 65496 - DNA, 33 bp, Homo sapiens; identical to SEQ ID NO: 64302

SEQ ID NO: 65497 - DNA, 46 bp, Homo sapiens; identical to SEQ ID NO: 63937

SEQ ID NO: 65498 - DNA, 19 bp, Homo sapiens
aacatcacctctagcatca

SEQ ID NO: 65499 - DNA, 22 bp, Homo sapiens
aacatcacctctagcatcacca

SEQ ID NO: 65500 - DNA, 41 bp, Homo sapiens; identical to SEQ ID NO: 64508

SEQ ID NO: 65501 - DNA, 45 bp, Homo sapiens; identical to SEQ ID NO: 64509

SEQ ID NO: 65502 - DNA, 46 bp, Homo sapiens; identical to SEQ ID NO: 64510

SEQ ID NO: 65503 - DNA, 19 bp, Homo sapiens
aacccaacacaggcatgct

SEQ ID NO: 65504 - DNA, 34 bp, Homo sapiens; identical to SEQ ID NO: 63764

SEQ ID NO: 65505 - DNA, 29 bp, Homo sapiens
aacccctacgcatttatatagaggagaca

SEQ ID NO: 65506 - DNA, 19 bp, Homo sapiens
aaccctgatgaaggctaca

SEQ ID NO: 65507 - DNA, 33 bp, Homo sapiens; identical to SEQ ID NO: 64319

SEQ ID NO: 65508 - DNA, 22 bp, Homo sapiens
aacctcaacagttaaatcaaca

SEQ ID NO: 65509 - DNA, 30 bp, Homo sapiens; identical to SEQ ID NO: 63924

SEQ ID NO: 65510 - DNA, 45 bp, Homo sapiens; identical to SEQ ID NO: 63925

SEQ ID NO: 65511 - DNA, 30 bp, Homo sapiens; identical to SEQ ID NO: 64713

SEQ ID NO: 65512 - DNA, 19 bp, Homo sapiens
aacgcttagcctagccaca

SEQ ID NO: 65513 - DNA, 32 bp, Homo sapiens; identical to SEQ ID NO: 64768

SEQ ID NO: 65514 - DNA, 34 bp, Homo sapiens; identical to SEQ ID NO: 64769

SEQ ID NO: 65515 - DNA, 33 bp, Homo sapiens; identical to SEQ ID NO: 64616

SEQ ID NO: 65516 - DNA, 18 bp, Homo sapiens
aactaaaacccctacgca

SEQ ID NO: 65517 - DNA, 35 bp, Homo sapiens; identical to SEQ ID NO: 64118

SEQ ID NO: 65518 - DNA, 34 bp, Homo sapiens; identical to SEQ ID NO: 64036

SEQ ID NO: 65519 - DNA, 16 bp, Homo sapiens
aactccagttgacaca

SEQ ID NO: 65520 - DNA, 17 bp, Homo sapiens
aactgctcgccagaaca

SEQ ID NO: 65521 - DNA, 29 bp, Homo sapiens
aactgctcgccagaacactacgagccaca

SEQ ID NO: 65522 - DNA, 37 bp, Homo sapiens; identical to SEQ ID NO: 64953

SEQ ID NO: 65523 - DNA, 40 bp, Homo sapiens; identical to SEQ ID NO: 64271

SEQ ID NO: 65524 - DNA, 45 bp, Homo sapiens; identical to SEQ ID NO: 64400

SEQ ID NO: 65525 - DNA, 43 bp, Homo sapiens; identical to SEQ ID NO: 63843

SEQ ID NO: 65526 - DNA, 26 bp, Homo sapiens
aaggacatttaactaaaacccctacg

SEQ ID NO: 65527 - DNA, 28 bp, Homo sapiens
aaggctacaaagtaagcgcaagtaccca

SEQ ID NO: 65528 - DNA, 28 bp, Homo sapiens
aaggttcgtttgttcaacgattaaagtc

SEQ ID NO: 65529 - DNA, 29 bp, Homo sapiens
aaggttcgtttgttcaacgattaaagtcc

SEQ ID NO: 65530 - DNA, 21 bp, Homo sapiens
acaaaactgctcgccagaaca

SEQ ID NO: 65531 - DNA, 37 bp, Homo sapiens; identical to SEQ ID NO: 64316

SEQ ID NO: 65532 - DNA, 27 bp, Homo sapiens
acacccacccaagaacagggtttgtta

SEQ ID NO: 65533 - DNA, 21 bp, Homo sapiens
acacccccacgggaaacagca

SEQ ID NO: 65534 - DNA, 24 bp, Homo sapiens
acacccccacgggaaacagcagtg

SEQ ID NO: 65535 - DNA, 18 bp, Homo sapiens
acacgattaacccaagtc

SEQ ID NO: 65536 - DNA, 19 bp, Homo sapiens
acacgattaacccaagtca

SEQ ID NO: 65537 - DNA, 35 bp, Homo sapiens; identical to SEQ ID NO: 64415

SEQ ID NO: 65538 - DNA, 18 bp, Homo sapiens
acatcacctctagcatca

SEQ ID NO: 65539 - DNA, 21 bp, Homo sapiens
acatcacctctagcatcacca

SEQ ID NO: 65540 - DNA, 40 bp, Homo sapiens; identical to SEQ ID NO: 64519

SEQ ID NO: 65541 - DNA, 46 bp, Homo sapiens; identical to SEQ ID NO: 64520

SEQ ID NO: 65542 - DNA, 34 bp, Homo sapiens; identical to SEQ ID NO: 64608

SEQ ID NO: 65543 - DNA, 17 bp, Homo sapiens
acatttaactaaaaccc

SEQ ID NO: 65544 - DNA, 18 bp, Homo sapiens
acatttaactaaaacccc

SEQ ID NO: 65545 - DNA, 45 bp, Homo sapiens; identical to SEQ ID NO: 64497

SEQ ID NO: 65546 - DNA, 17 bp, Homo sapiens
accagacaaccttagcc

SEQ ID NO: 65547 - DNA, 30 bp, Homo sapiens; identical to SEQ ID NO: 64546

SEQ ID NO: 65548 - DNA, 31 bp, Homo sapiens; identical to SEQ ID NO: 64547

SEQ ID NO: 65549 - DNA, 18 bp, Homo sapiens
acccaacacaggcatgct

SEQ ID NO: 65550 - DNA, 17 bp, Homo sapiens
accccgcctgtttacca

SEQ ID NO: 65551 - DNA, 28 bp, Homo sapiens
accccgcctgtttaccaaaaacatcacc

SEQ ID NO: 65552 - DNA, 35 bp, Homo sapiens; identical to SEQ ID NO: 64479

SEQ ID NO: 65553 - DNA, 21 bp, Homo sapiens
accctcctcaagtatacttca

SEQ ID NO: 65554 - DNA, 35 bp, Homo sapiens; identical to SEQ ID NO: 64046

SEQ ID NO: 65555 - DNA, 42 bp, Homo sapiens; identical to SEQ ID NO: 64047

SEQ ID NO: 65556 - DNA, 33 bp, Homo sapiens; identical to SEQ ID NO: 63932

SEQ ID NO: 65557 - DNA, 29 bp, Homo sapiens
acctccgagcagtacatgctaagacttca

SEQ ID NO: 65558 - DNA, 46 bp, Homo sapiens; identical to SEQ ID NO: 64720

SEQ ID NO: 65559 - DNA, 45 bp, Homo sapiens; identical to SEQ ID NO: 65075

SEQ ID NO: 65560 - DNA, 16 bp, Homo sapiens
acctctagcatcacca

SEQ ID NO: 65561 - DNA, 38 bp, Homo sapiens; identical to SEQ ID NO: 64823

SEQ ID NO: 65562 - DNA, 25 bp, Homo sapiens
acgcatttatatagaggagacaagt

SEQ ID NO: 65563 - DNA, 30 bp, Homo sapiens; identical to SEQ ID NO: 64620

SEQ ID NO: 65564 - DNA, 22 bp, Homo sapiens
actacctaaaaaatcccaaaca

SEQ ID NO: 65565 - DNA, 35 bp, Homo sapiens; identical to SEQ ID NO: 63847

SEQ ID NO: 65566 - DNA, 21 bp, Homo sapiens
actccaccttactaccagaca

SEQ ID NO: 65567 - DNA, 42 bp, Homo sapiens; identical to SEQ ID NO: 64227

SEQ ID NO: 65568 - DNA, 16 bp, Homo sapiens
actccagttgacacaa

SEQ ID NO: 65569 - DNA, 30 bp, Homo sapiens; identical to SEQ ID NO: 64067

SEQ ID NO: 65570 - DNA, 23 bp, Homo sapiens
agaacagctaaaagagcacaccc

SEQ ID NO: 65571 - DNA, 20 bp, Homo sapiens
agacaaccttagccaaacca

SEQ ID NO: 65572 - DNA, 32 bp, Homo sapiens; identical to SEQ ID NO: 64285

SEQ ID NO: 65573 - DNA, 36 bp, Homo sapiens; identical to SEQ ID NO: 64954

SEQ ID NO: 65574 - DNA, 37 bp, Homo sapiens; identical to SEQ ID NO: 64955

SEQ ID NO: 65575 - DNA, 34 bp, Homo sapiens; identical to SEQ ID NO: 64802

SEQ ID NO: 65576 - DNA, 21 bp, Homo sapiens
agagtgttttagatcaccccc

SEQ ID NO: 65577 - DNA, 23 bp, Homo sapiens
agcaaaccctgatgaaggctaca

SEQ ID NO: 65578 - DNA, 39 bp, Homo sapiens; identical to SEQ ID NO: 64272

SEQ ID NO: 65579 - DNA, 36 bp, Homo sapiens; identical to SEQ ID NO: 64543

SEQ ID NO: 65580 - DNA, 37 bp, Homo sapiens; identical to SEQ ID NO: 64544

SEQ ID NO: 65581 - DNA, 39 bp, Homo sapiens; identical to SEQ ID NO: 64545

SEQ ID NO: 65582 - DNA, 41 bp, Homo sapiens; identical to SEQ ID NO: 63630

SEQ ID NO: 65583 - DNA, 25 bp, Homo sapiens
agccacacccccacgggaaacagca

SEQ ID NO: 65584 - DNA, 23 bp, Homo sapiens
agcccaatatctacaatcaacca

SEQ ID NO: 65585 - DNA, 26 bp, Homo sapiens
agcccaatatctacaatcaaccaaca

SEQ ID NO: 65586 - DNA, 19 bp, Homo sapiens
agccgctattaaaggttcg

SEQ ID NO: 65587 - DNA, 25 bp, Homo sapiens
agcctatataccgccatcttcagca

SEQ ID NO: 65588 - DNA, 25 bp, Homo sapiens
agcctggtgatagctggttgtccaa

SEQ ID NO: 65589 - DNA, 24 bp, Homo sapiens
agcgcaatcctattctagagtcca

SEQ ID NO: 65590 - DNA, 39 bp, Homo sapiens; identical to SEQ ID NO: 65070

SEQ ID NO: 65591 - DNA, 41 bp, Homo sapiens; identical to SEQ ID NO: 61680

SEQ ID NO: 65592 - DNA, 42 bp, Homo sapiens; identical to SEQ ID NO: 63844

SEQ ID NO: 65593 - DNA, 23 bp, Homo sapiens
agctcaaaacgcttagcctagcc

SEQ ID NO: 65594 - DNA, 28 bp, Homo sapiens
agctcaaaacgcttagcctagccacacc

SEQ ID NO: 65595 - DNA, 31 bp, Homo sapiens; identical to SEQ ID NO: 63708

SEQ ID NO: 65596 - DNA, 42 bp, Homo sapiens; identical to SEQ ID NO: 64946

SEQ ID NO: 65597 - DNA, 23 bp, Homo sapiens
aggacatcccgatggtgcagccg

SEQ ID NO: 65598 - DNA, 26 bp, Homo sapiens
aggacatcccgatggtgcagccgcta

SEQ ID NO: 65599 - DNA, 19 bp, Homo sapiens
aggctacaaagtaagcgca

SEQ ID NO: 65600 - DNA, 27 bp, Homo sapiens
aggttcgtttgttcaacgattaaagtc

SEQ ID NO: 65601 - DNA, 26 bp, Homo sapiens
agtattagaggcaccgcctgcccagt

SEQ ID NO: 65602 - DNA, 30 bp, Homo sapiens; identical to SEQ ID NO: 64552

SEQ ID NO: 65603 - DNA, 32 bp, Homo sapiens; identical to SEQ ID NO: 64553

SEQ ID NO: 65604 - DNA, 18 bp, Homo sapiens
agtcaaagcgaactacta

SEQ ID NO: 65605 - DNA, 24 bp, Homo sapiens
agtcaaagcgaactactatactca

SEQ ID NO: 65606 - DNA, 33 bp, Homo sapiens; identical to SEQ ID NO: 64745

SEQ ID NO: 65607 - DNA, 16 bp, Homo sapiens
agtccaaagaggaaca

SEQ ID NO: 65608 - DNA, 43 bp, Homo sapiens; identical to SEQ ID NO: 64146

SEQ ID NO: 65609 - DNA, 31 bp, Homo sapiens; identical to SEQ ID NO: 64060

SEQ ID NO: 65610 - DNA, 32 bp, Homo sapiens; identical to SEQ ID NO: 64061

SEQ ID NO: 65611 - DNA, 18 bp, Homo sapiens
ataggtttggtcctagcc

SEQ ID NO: 65612 - DNA, 37 bp, Homo sapiens; identical to SEQ ID NO: 63939

SEQ ID NO: 65613 - DNA, 40 bp, Homo sapiens; identical to SEQ ID NO: 63940

SEQ ID NO: 65614 - DNA, 37 bp, Homo sapiens; identical to SEQ ID NO: 64890

SEQ ID NO: 65615 - DNA, 18 bp, Homo sapiens
atctacaatcaaccaaca

SEQ ID NO: 65616 - DNA, 22 bp, Homo sapiens
atgcagctcaaaacgcttagcc

SEQ ID NO: 65617 - DNA, 27 bp, Homo sapiens
atgcagctcaaaacgcttagcctagcc

SEQ ID NO: 65618 - DNA, 28 bp, Homo sapiens
atgcagctcaaaacgcttagcctagcca

SEQ ID NO: 65619 - DNA, 33 bp, Homo sapiens; identical to SEQ ID NO: 63678

SEQ ID NO: 65620 - DNA, 34 bp, Homo sapiens; identical to SEQ ID NO: 63679

SEQ ID NO: 65621 - DNA, 35 bp, Homo sapiens; identical to SEQ ID NO: 63680

SEQ ID NO: 65622 - DNA, 27 bp, Homo sapiens
atgctaagacttcaccagtcaaagcga

SEQ ID NO: 65623 - DNA, 20 bp, Homo sapiens
atgcttagccctaaacctca

SEQ ID NO: 65624 - DNA, 34 bp, Homo sapiens; identical to SEQ ID NO: 64166

SEQ ID NO: 65625 - DNA, 36 bp, Homo sapiens; identical to SEQ ID NO: 63903

SEQ ID NO: 65626 - DNA, 28 bp, Homo sapiens
caaaggacatttaactaaaacccctacg

SEQ ID NO: 65627 - DNA, 46 bp, Homo sapiens; identical to SEQ ID NO: 63964

SEQ ID NO: 65628 - DNA, 23 bp, Homo sapiens
caacaaaactgctcgccagaaca

SEQ ID NO: 65629 - DNA, 35 bp, Homo sapiens; identical to SEQ ID NO: 63942

SEQ ID NO: 65630 - DNA, 17 bp, Homo sapiens
caacagttaaatcaaca

SEQ ID NO: 65631 - DNA, 35 bp, Homo sapiens; identical to SEQ ID NO: 63936

SEQ ID NO: 65632 - DNA, 18 bp, Homo sapiens
caacttagtattataccc

SEQ ID NO: 65633 - DNA, 45 bp, Homo sapiens; identical to SEQ ID NO: 64960

SEQ ID NO: 65634 - DNA, 34 bp, Homo sapiens; identical to SEQ ID NO: 63892

SEQ ID NO: 65635 - DNA, 19 bp, Homo sapiens
caatatctacaatcaacca

SEQ ID NO: 65636 - DNA, 19 bp, Homo sapiens
caatcctattctagagtcc

SEQ ID NO: 65637 - DNA, 20 bp, Homo sapiens
caatcctattctagagtcca

SEQ ID NO: 65638 - DNA, 23 bp, Homo sapiens
cactacctaaaaaatcccaaaca

SEQ ID NO: 65639 - DNA, 37 bp, Homo sapiens; identical to SEQ ID NO: 64222

SEQ ID NO: 65640 - DNA, 24 bp, Homo sapiens
cagcaaaccctgatgaaggctaca

SEQ ID NO: 65641 - DNA, 18 bp, Homo sapiens
cagccgctattaaaggtt

SEQ ID NO: 65642 - DNA, 19 bp, Homo sapiens
cagccgctattaaaggttc

SEQ ID NO: 65643 - DNA, 20 bp, Homo sapiens
cagccgctattaaaggttcg

SEQ ID NO: 65644 - DNA, 40 bp, Homo sapiens; identical to SEQ ID NO: 64914

SEQ ID NO: 65645 - DNA, 26 bp, Homo sapiens
cagcctatataccgccatcttcagca

SEQ ID NO: 65646 - DNA, 18 bp, Homo sapiens
cagctaaaagagcacacc

SEQ ID NO: 65647 - DNA, 19 bp, Homo sapiens
cagctcaaaacgcttagcc

SEQ ID NO: 65648 - DNA, 25 bp, Homo sapiens
cagctcaaaacgcttagcctagcca

SEQ ID NO: 65649 - DNA, 29 bp, Homo sapiens
cagctcaaaacgcttagcctagccacacc

SEQ ID NO: 65650 - DNA, 33 bp, Homo sapiens; identical to SEQ ID NO: 63703

SEQ ID NO: 65651 - DNA, 18 bp, Homo sapiens
caggacatcccgatggtg

SEQ ID NO: 65652 - DNA, 20 bp, Homo sapiens
caggacatcccgatggtgca

SEQ ID NO: 65653 - DNA, 29 bp, Homo sapiens
cagggttggtcaatttcgtgccagccacc

SEQ ID NO: 65654 - DNA, 30 bp, Homo sapiens; identical to SEQ ID NO: 63779

SEQ ID NO: 65655 - DNA, 28 bp, Homo sapiens
cagtattagaggcaccgcctgcccagtg

SEQ ID NO: 65656 - DNA, 29 bp, Homo sapiens
cagtattagaggcaccgcctgcccagtga

SEQ ID NO: 65657 - DNA, 17 bp, Homo sapiens
cagtgacacatgtttaa

SEQ ID NO: 65658 - DNA, 38 bp, Homo sapiens; identical to SEQ ID NO: 64358

SEQ ID NO: 65659 - DNA, 20 bp, Homo sapiens
catcacctctagcatcacca

SEQ ID NO: 65660 - DNA, 43 bp, Homo sapiens; identical to SEQ ID NO: 64529

SEQ ID NO: 65661 - DNA, 45 bp, Homo sapiens; identical to SEQ ID NO: 64530

SEQ ID NO: 65662 - DNA, 28 bp, Homo sapiens
catgctaagacttcaccagtcaaagcga

SEQ ID NO: 65663 - DNA, 18 bp, Homo sapiens
ccacgggaaacagcagtg

SEQ ID NO: 65664 - DNA, 32 bp, Homo sapiens; identical to SEQ ID NO: 63748

SEQ ID NO: 65665 - DNA, 18 bp, Homo sapiens
ccactatgcttagcccta

SEQ ID NO: 65666 - DNA, 28 bp, Homo sapiens
ccactatgcttagccctaaacctcaaca

SEQ ID NO: 65667 - DNA, 30 bp, Homo sapiens; identical to SEQ ID NO: 64548

SEQ ID NO: 65668 - DNA, 16 bp, Homo sapiens
ccatcttcagcaaacc

SEQ ID NO: 65669 - DNA, 18 bp, Homo sapiens
ccatcttcagcaaaccct

SEQ ID NO: 65670 - DNA, 31 bp, Homo sapiens; identical to SEQ ID NO: 64015

SEQ ID NO: 65671 - DNA, 20 bp, Homo sapiens
cccacgggaaacagcagtga

SEQ ID NO: 65672 - DNA, 18 bp, Homo sapiens
cccactatgcttagccct

SEQ ID NO: 65673 - DNA, 40 bp, Homo sapiens; identical to SEQ ID NO: 64355

SEQ ID NO: 65674 - DNA, 18 bp, Homo sapiens
cccccacgggaaacagca

SEQ ID NO: 65675 - DNA, 17 bp, Homo sapiens
cccggcgggcgccggcg

SEQ ID NO: 65676 - DNA, 27 bp, Homo sapiens
ccgagcagtacatgctaagacttcacc

SEQ ID NO: 65677 - DNA, 19 bp, Homo sapiens
cctacgcatttatatagag

SEQ ID NO: 65678 - DNA, 23 bp, Homo sapiens
cctacgcatttatatagaggaga

SEQ ID NO: 65679 - DNA, 23 bp, Homo sapiens
cctcaagtatacttcaaaggaca

SEQ ID NO: 65680 - DNA, 27 bp, Homo sapiens
cgagcagtacatgctaagacttcacca

SEQ ID NO: 65681 - DNA, 27 bp, Homo sapiens
cgatggtgcagccgctattaaaggttc

SEQ ID NO: 65682 - DNA, 37 bp, Homo sapiens; identical to SEQ ID NO: 65293

SEQ ID NO: 65683 - DNA, 17 bp, Homo sapiens
cggtcacacgattaacc

SEQ ID NO: 65684 - DNA, 33 bp, Homo sapiens; identical to SEQ ID NO: 63636

SEQ ID NO: 65685 - DNA, 19 bp, Homo sapiens
ctaaccgtgcaaaggtagc

SEQ ID NO: 65686 - DNA, 31 bp, Homo sapiens; identical to SEQ ID NO: 63933

SEQ ID NO: 65687 - DNA, 20 bp, Homo sapiens
ctccaccttactaccagaca

SEQ ID NO: 65688 - DNA, 46 bp, Homo sapiens; identical to SEQ ID NO: 63166

SEQ ID NO: 65689 - DNA, 18 bp, Homo sapiens
ctcctcaagtatacttca

SEQ ID NO: 65690 - DNA, 33 bp, Homo sapiens; identical to SEQ ID NO: 65440

SEQ ID NO: 65691 - DNA, 39 bp, Homo sapiens; identical to SEQ ID NO: 64417

SEQ ID NO: 65692 - DNA, 27 bp, Homo sapiens
ctgtaatcgataaaccccgatcaacct

SEQ ID NO: 65693 - DNA, 31 bp, Homo sapiens; identical to SEQ ID NO: 64070

SEQ ID NO: 65694 - DNA, 33 bp, Homo sapiens; identical to SEQ ID NO: 64071

SEQ ID NO: 65695 - DNA, 40 bp, Homo sapiens; identical to SEQ ID NO: 64282

SEQ ID NO: 65696 - DNA, 32 bp, Homo sapiens; identical to SEQ ID NO: 63866

SEQ ID NO: 65697 - DNA, 40 bp, Homo sapiens; identical to SEQ ID NO: 63867

SEQ ID NO: 65698 - DNA, 21 bp, Homo sapiens
gaacagctaaaagagcacacc

SEQ ID NO: 65699 - DNA, 22 bp, Homo sapiens
gaacagctaaaagagcacaccc

SEQ ID NO: 65700 - DNA, 18 bp, Homo sapiens
gaacccaacctccgagca

SEQ ID NO: 65701 - DNA, 39 bp, Homo sapiens; identical to SEQ ID NO: 64704

SEQ ID NO: 65702 - DNA, 21 bp, Homo sapiens
gaactgacaattaacagccca

SEQ ID NO: 65703 - DNA, 30 bp, Homo sapiens; identical to SEQ ID NO: 64421

SEQ ID NO: 65704 - DNA, 38 bp, Homo sapiens; identical to SEQ ID NO: 64422

SEQ ID NO: 65705 - DNA, 19 bp, Homo sapiens
gacaaccttagccaaacca

SEQ ID NO: 65706 - DNA, 19 bp, Homo sapiens
gacaattaacagcccaata

SEQ ID NO: 65707 - DNA, 25 bp, Homo sapiens
gacaattaacagcccaatatctaca

SEQ ID NO: 65708 - DNA, 28 bp, Homo sapiens
gacaattaacagcccaatatctacaatc

SEQ ID NO: 65709 - DNA, 34 bp, Homo sapiens; identical to SEQ ID NO: 64881

SEQ ID NO: 65710 - DNA, 40 bp, Homo sapiens; identical to SEQ ID NO: 64886

SEQ ID NO: 65711 - DNA, 42 bp, Homo sapiens; identical to SEQ ID NO: 64104

SEQ ID NO: 65712 - DNA, 17 bp, Homo sapiens
gaccaatctatcaccct

SEQ ID NO: 65713 - DNA, 28 bp, Homo sapiens
gaccaatctatcaccctatagaagaact

SEQ ID NO: 65714 - DNA, 18 bp, Homo sapiens
gacctcgatgttggatca

SEQ ID NO: 65715 - DNA, 35 bp, Homo sapiens; identical to SEQ ID NO: 64828

SEQ ID NO: 65716 - DNA, 42 bp, Homo sapiens; identical to SEQ ID NO: 64838

SEQ ID NO: 65717 - DNA, 41 bp, Homo sapiens; identical to SEQ ID NO: 61783

SEQ ID NO: 65718 - DNA, 40 bp, Homo sapiens; identical to SEQ ID NO: 63962

SEQ ID NO: 65719 - DNA, 16 bp, Homo sapiens
gagctacctaagaaca

SEQ ID NO: 65720 - DNA, 33 bp, Homo sapiens; identical to SEQ ID NO: 64804

SEQ ID NO: 65721 - DNA, 19 bp, Homo sapiens
gagtgttttagatcacccc

SEQ ID NO: 65722 - DNA, 20 bp, Homo sapiens
gagtgttttagatcaccccc

SEQ ID NO: 65723 - DNA, 19 bp, Homo sapiens
gatcgatgtggtgacgtcg

SEQ ID NO: 65724 - DNA, 32 bp, Homo sapiens; identical to SEQ ID NO: 64898

SEQ ID NO: 65725 - DNA, 35 bp, Homo sapiens; identical to SEQ ID NO: 64899

SEQ ID NO: 65726 - DNA, 22 bp, Homo sapiens
gcaaaccctgatgaaggctaca

SEQ ID NO: 65727 - DNA, 26 bp, Homo sapiens
gcaaatcttaccccgcctgtttacca

SEQ ID NO: 65728 - DNA, 21 bp, Homo sapiens
gcagccgctattaaaggttcg

SEQ ID NO: 65729 - DNA, 20 bp, Homo sapiens
gcagctcaaaacgcttagcc

SEQ ID NO: 65730 - DNA, 21 bp, Homo sapiens
gcagctcaaaacgcttagcct

SEQ ID NO: 65731 - DNA, 26 bp, Homo sapiens
gcagctcaaaacgcttagcctagcca

SEQ ID NO: 65732 - DNA, 28 bp, Homo sapiens
gcagctcaaaacgcttagcctagccaca

SEQ ID NO: 65733 - DNA, 20 bp, Homo sapiens
gcagtgattaacctttagca

SEQ ID NO: 65734 - DNA, 23 bp, Homo sapiens
gcagtgattaacctttagcaata

SEQ ID NO: 65735 - DNA, 19 bp, Homo sapiens
gccatcttcagcaaaccct

SEQ ID NO: 65736 - DNA, 20 bp, Homo sapiens
gcccagtgacacatgtttaa

SEQ ID NO: 65737 - DNA, 35 bp, Homo sapiens; identical to SEQ ID NO: 64040

SEQ ID NO: 65738 - DNA, 28 bp, Homo sapiens
gccctaaacctcaacagttaaatcaaca

SEQ ID NO: 65739 - DNA, 19 bp, Homo sapiens
gccgcggtaccctaaccgt

SEQ ID NO: 65740 - DNA, 37 bp, Homo sapiens; identical to SEQ ID NO: 64629

SEQ ID NO: 65741 - DNA, 21 bp, Homo sapiens
gcctgtttaccaaaaacatca

SEQ ID NO: 65742 - DNA, 24 bp, Homo sapiens
gcctgtttaccaaaaacatcacct

SEQ ID NO: 65743 - DNA, 44 bp, Homo sapiens; identical to SEQ ID NO: 64792

SEQ ID NO: 65744 - DNA, 32 bp, Homo sapiens; identical to SEQ ID NO: 62125

SEQ ID NO: 65745 - DNA, 20 bp, Homo sapiens
gcggtcacacgattaaccca

SEQ ID NO: 65746 - DNA, 17 bp, Homo sapiens
gctacaaagtaagcgca

SEQ ID NO: 65747 - DNA, 35 bp, Homo sapiens; identical to SEQ ID NO: 64925

SEQ ID NO: 65748 - DNA, 40 bp, Homo sapiens; identical to SEQ ID NO: 64926

SEQ ID NO: 65749 - DNA, 42 bp, Homo sapiens; identical to SEQ ID NO: 64927

SEQ ID NO: 65750 - DNA, 44 bp, Homo sapiens; identical to SEQ ID NO: 64928

SEQ ID NO: 65751 - DNA, 18 bp, Homo sapiens
gctcaaaacgcttagcct

SEQ ID NO: 65752 - DNA, 37 bp, Homo sapiens; identical to SEQ ID NO: 64657

SEQ ID NO: 65753 - DNA, 39 bp, Homo sapiens; identical to SEQ ID NO: 64658

SEQ ID NO: 65754 - DNA, 28 bp, Homo sapiens
ggaacaagttaccctagggataacagcg

SEQ ID NO: 65755 - DNA, 41 bp, Homo sapiens; identical to SEQ ID NO: 64878

SEQ ID NO: 65756 - DNA, 23 bp, Homo sapiens
ggacatttaactaaaacccctac

SEQ ID NO: 65757 - DNA, 37 bp, Homo sapiens; identical to SEQ ID NO: 57145

SEQ ID NO: 65758 - DNA, 34 bp, Homo sapiens; identical to SEQ ID NO: 64626

SEQ ID NO: 65759 - DNA, 26 bp, Homo sapiens
ggctacaaagtaagcgcaagtaccca

SEQ ID NO: 65760 - DNA, 33 bp, Homo sapiens; identical to SEQ ID NO: 65338

SEQ ID NO: 65761 - DNA, 24 bp, Homo sapiens
ggtgcagccgctattaaaggttcg

SEQ ID NO: 65762 - DNA, 29 bp, Homo sapiens
ggtgcagccgctattaaaggttcgtttgt

SEQ ID NO: 65763 - DNA, 32 bp, Homo sapiens; identical to SEQ ID NO: 64904

SEQ ID NO: 65764 - DNA, 39 bp, Homo sapiens; identical to SEQ ID NO: 64905

SEQ ID NO: 65765 - DNA, 27 bp, Homo sapiens
ggttcgtttgttcaacgattaaagtcc

SEQ ID NO: 65766 - DNA, 29 bp, Homo sapiens
ggttcgtttgttcaacgattaaagtccta

SEQ ID NO: 65767 - DNA, 24 bp, Homo sapiens
gtaatcgataaaccccgatcaacc

SEQ ID NO: 65768 - DNA, 44 bp, Homo sapiens; identical to SEQ ID NO: 63969

SEQ ID NO: 65769 - DNA, 37 bp, Homo sapiens; identical to SEQ ID NO: 64734

SEQ ID NO: 65770 - DNA, 38 bp, Homo sapiens; identical to SEQ ID NO: 64735

SEQ ID NO: 65771 - DNA, 18 bp, Homo sapiens
gtacctaacaaacccaca

SEQ ID NO: 65772 - DNA, 23 bp, Homo sapiens
gtacctaacaaacccacaggtcc

SEQ ID NO: 65773 - DNA, 24 bp, Homo sapiens
gtacctaacaaacccacaggtcct

SEQ ID NO: 65774 - DNA, 25 bp, Homo sapiens
gtacctaacaaacccacaggtccta

SEQ ID NO: 65775 - DNA, 45 bp, Homo sapiens; identical to SEQ ID NO: 65101

SEQ ID NO: 65776 - DNA, 27 bp, Homo sapiens
gtattagaggcaccgcctgcccagtga

SEQ ID NO: 65777 - DNA, 32 bp, Homo sapiens; identical to SEQ ID NO: 64751

SEQ ID NO: 65778 - DNA, 38 bp, Homo sapiens; identical to SEQ ID NO: 64752

SEQ ID NO: 65779 - DNA, 17 bp, Homo sapiens
gtcacacgattaaccca

SEQ ID NO: 65780 - DNA, 45 bp, Homo sapiens; identical to SEQ ID NO: 64042

SEQ ID NO: 65781 - DNA, 41 bp, Homo sapiens; identical to SEQ ID NO: 64149

SEQ ID NO: 65782 - DNA, 17 bp, Homo sapiens
gtctcttacttttaacc

SEQ ID NO: 65783 - DNA, 30 bp, Homo sapiens; identical to SEQ ID NO: 64662

SEQ ID NO: 65784 - DNA, 32 bp, Homo sapiens; identical to SEQ ID NO: 63637

SEQ ID NO: 65785 - DNA, 35 bp, Homo sapiens; identical to SEQ ID NO: 63759

SEQ ID NO: 65786 - DNA, 18 bp, Homo sapiens
taaccgtgcaaaggtagc

SEQ ID NO: 65787 - DNA, 27 bp, Homo sapiens
taccgagcctggtgatagctggttgtc

SEQ ID NO: 65788 - DNA, 27 bp, Homo sapiens
tacgtgatctgagttcagaccggagta

SEQ ID NO: 65789 - DNA, 31 bp, Homo sapiens; identical to SEQ ID NO: 64064

SEQ ID NO: 65790 - DNA, 35 bp, Homo sapiens; identical to SEQ ID NO: 64065

SEQ ID NO: 65791 - DNA, 23 bp, Homo sapiens
tagccacacccccacgggaaaca

SEQ ID NO: 65792 - DNA, 26 bp, Homo sapiens
tagccacacccccacgggaaacagca

SEQ ID NO: 65793 - DNA, 35 bp, Homo sapiens; identical to SEQ ID NO: 64058

SEQ ID NO: 65794 - DNA, 37 bp, Homo sapiens; identical to SEQ ID NO: 64059

SEQ ID NO: 65795 - DNA, 36 bp, Homo sapiens; identical to SEQ ID NO: 63934

SEQ ID NO: 65796 - DNA, 17 bp, Homo sapiens
tcacctctagcatcacc

SEQ ID NO: 65797 - DNA, 39 bp, Homo sapiens; identical to SEQ ID NO: 64538

SEQ ID NO: 65798 - DNA, 34 bp, Homo sapiens; identical to SEQ ID NO: 63632

SEQ ID NO: 65799 - DNA, 35 bp, Homo sapiens; identical to SEQ ID NO: 63633

SEQ ID NO: 65800 - DNA, 37 bp, Homo sapiens; identical to SEQ ID NO: 63634

SEQ ID NO: 65801 - DNA, 19 bp, Homo sapiens
tcccgatggtgcagccgct

SEQ ID NO: 65802 - DNA, 32 bp, Homo sapiens; identical to SEQ ID NO: 65441

SEQ ID NO: 65803 - DNA, 41 bp, Homo sapiens; identical to SEQ ID NO: 61697

SEQ ID NO: 65804 - DNA, 21 bp, Homo sapiens
tgcagctcaaaacgcttagcc

SEQ ID NO: 65805 - DNA, 26 bp, Homo sapiens
tgcagctcaaaacgcttagcctagcc

SEQ ID NO: 65806 - DNA, 27 bp, Homo sapiens
tgcagctcaaaacgcttagcctagcca

SEQ ID NO: 65807 - DNA, 31 bp, Homo sapiens; identical to SEQ ID NO: 63684

SEQ ID NO: 65808 - DNA, 32 bp, Homo sapiens; identical to SEQ ID NO: 63685

SEQ ID NO: 65809 - DNA, 33 bp, Homo sapiens; identical to SEQ ID NO: 63686

SEQ ID NO: 65810 - DNA, 34 bp, Homo sapiens; identical to SEQ ID NO: 63687

SEQ ID NO: 65811 - DNA, 33 bp, Homo sapiens; identical to SEQ ID NO: 64169

SEQ ID NO: 65812 - DNA, 36 bp, Homo sapiens; identical to SEQ ID NO: 63761

SEQ ID NO: 65813 - DNA, 40 bp, Homo sapiens; identical to SEQ ID NO: 63762

SEQ ID NO: 65814 - DNA, 43 bp, Homo sapiens; identical to SEQ ID NO: 63763

SEQ ID NO: 65815 - DNA, 32 bp, Homo sapiens; identical to SEQ ID NO: 64318

SEQ ID NO: 65816 - DNA, 41 bp, Homo sapiens; identical to SEQ ID NO: 63922

SEQ ID NO: 65817 - DNA, 39 bp, Homo sapiens; identical to SEQ ID NO: 63646

SEQ ID NO: 65818 - DNA, 35 bp, Homo sapiens; identical to SEQ ID NO: 63946

SEQ ID NO: 65819 - DNA, 45 bp, Homo sapiens; identical to SEQ ID NO: 64822

SEQ ID NO: 65820 - DNA, 40 bp, Homo sapiens; identical to SEQ ID NO: 64456

SEQ ID NO: 65821 - DNA, 41 bp, Homo sapiens; identical to SEQ ID NO: 64457

SEQ ID NO: 65822 - DNA, 38 bp, Homo sapiens; identical to SEQ ID NO: 63883

SEQ ID NO: 65823 - DNA, 17 bp, Homo sapiens
acaggtcctaaactacc

SEQ ID NO: 65824 - DNA, 28 bp, Homo sapiens
accaaaaacatcacctctagcatcacca

SEQ ID NO: 65825 - DNA, 35 bp, Homo sapiens; identical to SEQ ID NO: 64464

SEQ ID NO: 65826 - DNA, 38 bp, Homo sapiens; identical to SEQ ID NO: 64465

SEQ ID NO: 65827 - DNA, 31 bp, Homo sapiens; identical to SEQ ID NO: 64760

SEQ ID NO: 65828 - DNA, 35 bp, Homo sapiens; identical to SEQ ID NO: 64371

SEQ ID NO: 65829 - DNA, 35 bp, Homo sapiens; identical to SEQ ID NO: 63768

SEQ ID NO: 65830 - DNA, 36 bp, Homo sapiens; identical to SEQ ID NO: 63738

SEQ ID NO: 65831 - DNA, 29 bp, Homo sapiens
accccgcctgtttaccaaaaacatcacct

SEQ ID NO: 65832 - DNA, 28 bp, Homo sapiens
accgagcctggtgatagctggttgtcca

SEQ ID NO: 65833 - DNA, 31 bp, Homo sapiens; identical to SEQ ID NO: 64644

SEQ ID NO: 65834 - DNA, 30 bp, Homo sapiens; identical to SEQ ID NO: 64683

SEQ ID NO: 65835 - DNA, 39 bp, Homo sapiens; identical to SEQ ID NO: 63931

SEQ ID NO: 65836 - DNA, 41 bp, Homo sapiens; identical to SEQ ID NO: 64841

SEQ ID NO: 65837 - DNA, 42 bp, Homo sapiens; identical to SEQ ID NO: 63755

SEQ ID NO: 65838 - DNA, 44 bp, Homo sapiens; identical to SEQ ID NO: 63756

SEQ ID NO: 65839 - DNA, 41 bp, Homo sapiens; identical to SEQ ID NO: 65116

SEQ ID NO: 65840 - DNA, 42 bp, Homo sapiens; identical to SEQ ID NO: 65117

SEQ ID NO: 65841 - DNA, 43 bp, Homo sapiens; identical to SEQ ID NO: 65118

SEQ ID NO: 65842 - DNA, 33 bp, Homo sapiens; identical to SEQ ID NO: 64772

SEQ ID NO: 65843 - DNA, 33 bp, Homo sapiens; identical to SEQ ID NO: 63750

SEQ ID NO: 65844 - DNA, 39 bp, Homo sapiens; identical to SEQ ID NO: 63894

SEQ ID NO: 65845 - DNA, 41 bp, Homo sapiens; identical to SEQ ID NO: 63647

SEQ ID NO: 65846 - DNA, 46 bp, Homo sapiens; identical to SEQ ID NO: 63648

SEQ ID NO: 65847 - DNA, 38 bp, Homo sapiens; identical to SEQ ID NO: 64731

SEQ ID NO: 65848 - DNA, 18 bp, Homo sapiens
agcatcaagcacgcagca

SEQ ID NO: 65849 - DNA, 39 bp, Homo sapiens; identical to SEQ ID NO: 63963

SEQ ID NO: 65850 - DNA, 16 bp, Homo sapiens
agccaccgcggtcaca

SEQ ID NO: 65851 - DNA, 40 bp, Homo sapiens; identical to SEQ ID NO: 64917

SEQ ID NO: 65852 - DNA, 30 bp, Homo sapiens; identical to SEQ ID NO: 64006

SEQ ID NO: 65853 - DNA, 43 bp, Homo sapiens; identical to SEQ ID NO: 64945

SEQ ID NO: 65854 - DNA, 42 bp, Homo sapiens; identical to SEQ ID NO: 64655

SEQ ID NO: 65855 - DNA, 16 bp, Homo sapiens
agtgacacatgtttaa

SEQ ID NO: 65856 - DNA, 37 bp, Homo sapiens; identical to SEQ ID NO: 64458

SEQ ID NO: 65857 - DNA, 17 bp, Homo sapiens
atcccgatggtgcagcc

SEQ ID NO: 65858 - DNA, 41 bp, Homo sapiens; identical to SEQ ID NO: 64671

SEQ ID NO: 65859 - DNA, 36 bp, Homo sapiens; identical to SEQ ID NO: 64460

SEQ ID NO: 65860 - DNA, 35 bp, Homo sapiens; identical to SEQ ID NO: 63672

SEQ ID NO: 65861 - DNA, 38 bp, Homo sapiens; identical to SEQ ID NO: 63673

SEQ ID NO: 65862 - DNA, 28 bp, Homo sapiens
cagtgagttcaccctctaaatcaccacg

SEQ ID NO: 65863 - DNA, 31 bp, Homo sapiens; identical to SEQ ID NO: 64160

SEQ ID NO: 65864 - DNA, 38 bp, Homo sapiens; identical to SEQ ID NO: 64385

SEQ ID NO: 65865 - DNA, 35 bp, Homo sapiens; identical to SEQ ID NO: 64764

SEQ ID NO: 65866 - DNA, 33 bp, Homo sapiens; identical to SEQ ID NO: 64369

SEQ ID NO: 65867 - DNA, 33 bp, Homo sapiens; identical to SEQ ID NO: 64242

SEQ ID NO: 65868 - DNA, 25 bp, Homo sapiens
cccacaggtcctaaactaccaaacc

SEQ ID NO: 65869 - DNA, 32 bp, Homo sapiens; identical to SEQ ID NO: 63905

SEQ ID NO: 65870 - DNA, 41 bp, Homo sapiens; identical to SEQ ID NO: 63906

SEQ ID NO: 65871 - DNA, 34 bp, Homo sapiens; identical to SEQ ID NO: 63771

SEQ ID NO: 65872 - DNA, 34 bp, Homo sapiens; identical to SEQ ID NO: 63741

SEQ ID NO: 65873 - DNA, 45 bp, Homo sapiens; identical to SEQ ID NO: 62925

SEQ ID NO: 65874 - DNA, 30 bp, Homo sapiens; identical to SEQ ID NO: 65333

SEQ ID NO: 65875 - DNA, 34 bp, Homo sapiens; identical to SEQ ID NO: 63973

SEQ ID NO: 65876 - DNA, 30 bp, Homo sapiens; identical to SEQ ID NO: 64248

SEQ ID NO: 65877 - DNA, 24 bp, Homo sapiens
cgagcctggtgatagctggttgtc

SEQ ID NO: 65878 - DNA, 26 bp, Homo sapiens
cgagcctggtgatagctggttgtcca

SEQ ID NO: 65879 - DNA, 37 bp, Homo sapiens; identical to SEQ ID NO: 63667

SEQ ID NO: 65880 - DNA, 39 bp, Homo sapiens; identical to SEQ ID NO: 63668

SEQ ID NO: 65881 - DNA, 41 bp, Homo sapiens; identical to SEQ ID NO: 63669

SEQ ID NO: 65882 - DNA, 35 bp, Homo sapiens; identical to SEQ ID NO: 64624

SEQ ID NO: 65883 - DNA, 20 bp, Homo sapiens
cggcgggtgttgacgcgatg

SEQ ID NO: 65884 - DNA, 44 bp, Homo sapiens; identical to SEQ ID NO: 65090

SEQ ID NO: 65885 - DNA, 45 bp, Homo sapiens; identical to SEQ ID NO: 65091

SEQ ID NO: 65886 - DNA, 34 bp, Homo sapiens; identical to SEQ ID NO: 58238

SEQ ID NO: 65887 - DNA, 42 bp, Homo sapiens; identical to SEQ ID NO: 64236

SEQ ID NO: 65888 - DNA, 38 bp, Homo sapiens; identical to SEQ ID NO: 64051

SEQ ID NO: 65889 - DNA, 46 bp, Homo sapiens; identical to SEQ ID NO: 65077

SEQ ID NO: 65890 - DNA, 43 bp, Homo sapiens; identical to SEQ ID NO: 64281

SEQ ID NO: 65891 - DNA, 41 bp, Homo sapiens; identical to SEQ ID NO: 64427

SEQ ID NO: 65892 - DNA, 43 bp, Homo sapiens; identical to SEQ ID NO: 63852

SEQ ID NO: 65893 - DNA, 43 bp, Homo sapiens; identical to SEQ ID NO: 64349

SEQ ID NO: 65894 - DNA, 45 bp, Homo sapiens; identical to SEQ ID NO: 64350

SEQ ID NO: 65895 - DNA, 32 bp, Homo sapiens; identical to SEQ ID NO: 63895

SEQ ID NO: 65896 - DNA, 39 bp, Homo sapiens; identical to SEQ ID NO: 64825

SEQ ID NO: 65897 - DNA, 45 bp, Homo sapiens; identical to SEQ ID NO: 64725

SEQ ID NO: 65898 - DNA, 36 bp, Homo sapiens; identical to SEQ ID NO: 58166

SEQ ID NO: 65899 - DNA, 36 bp, Homo sapiens; identical to SEQ ID NO: 64326

SEQ ID NO: 65900 - DNA, 39 bp, Homo sapiens; identical to SEQ ID NO: 65318

SEQ ID NO: 65901 - DNA, 41 bp, Homo sapiens; identical to SEQ ID NO: 65268

SEQ ID NO: 65902 - DNA, 26 bp, Homo sapiens
gagtgcttagttgaacagggccctga

SEQ ID NO: 65903 - DNA, 38 bp, Homo sapiens; identical to SEQ ID NO: 64896

SEQ ID NO: 65904 - DNA, 34 bp, Homo sapiens; identical to SEQ ID NO: 63656

SEQ ID NO: 65905 - DNA, 38 bp, Homo sapiens; identical to SEQ ID NO: 63657

SEQ ID NO: 65906 - DNA, 40 bp, Homo sapiens; identical to SEQ ID NO: 63658

SEQ ID NO: 65907 - DNA, 43 bp, Homo sapiens; identical to SEQ ID NO: 63662

SEQ ID NO: 65908 - DNA, 44 bp, Homo sapiens; identical to SEQ ID NO: 63659

SEQ ID NO: 65909 - DNA, 45 bp, Homo sapiens; identical to SEQ ID NO: 63660

SEQ ID NO: 65910 - DNA, 46 bp, Homo sapiens; identical to SEQ ID NO: 63661

SEQ ID NO: 65911 - DNA, 40 bp, Homo sapiens; identical to SEQ ID NO: 63671

SEQ ID NO: 65912 - DNA, 38 bp, Homo sapiens; identical to SEQ ID NO: 64364

SEQ ID NO: 65913 - DNA, 36 bp, Homo sapiens; identical to SEQ ID NO: 64366

SEQ ID NO: 65914 - DNA, 38 bp, Homo sapiens; identical to SEQ ID NO: 64443

SEQ ID NO: 65915 - DNA, 39 bp, Homo sapiens; identical to SEQ ID NO: 64444

SEQ ID NO: 65916 - DNA, 44 bp, Homo sapiens; identical to SEQ ID NO: 64442

SEQ ID NO: 65917 - DNA, 45 bp, Homo sapiens; identical to SEQ ID NO: 65400

SEQ ID NO: 65918 - DNA, 30 bp, Homo sapiens; identical to SEQ ID NO: 65435

SEQ ID NO: 65919 - DNA, 34 bp, Homo sapiens; identical to SEQ ID NO: 65436

SEQ ID NO: 65920 - DNA, 35 bp, Homo sapiens; identical to SEQ ID NO: 64492

SEQ ID NO: 65921 - DNA, 39 bp, Homo sapiens; identical to SEQ ID NO: 58236

SEQ ID NO: 65922 - DNA, 17 bp, Homo sapiens
gcgggcataacacagca

SEQ ID NO: 65923 - DNA, 30 bp, Homo sapiens; identical to SEQ ID NO: 64633

SEQ ID NO: 65924 - DNA, 37 bp, Homo sapiens; identical to SEQ ID NO: 65178

SEQ ID NO: 65925 - DNA, 43 bp, Homo sapiens; identical to SEQ ID NO: 64924

SEQ ID NO: 65926 - DNA, 27 bp, Homo sapiens
ggacatcccgatggtgcagccgctatt

SEQ ID NO: 65927 - DNA, 46 bp, Homo sapiens; identical to SEQ ID NO: 64901

SEQ ID NO: 65928 - DNA, 16 bp, Homo sapiens
gtaccctaaccgtgca

SEQ ID NO: 65929 - DNA, 42 bp, Homo sapiens; identical to SEQ ID NO: 65099

SEQ ID NO: 65930 - DNA, 46 bp, Homo sapiens; identical to SEQ ID NO: 65100

SEQ ID NO: 65931 - DNA, 31 bp, Homo sapiens; identical to SEQ ID NO: 65296

SEQ ID NO: 65932 - DNA, 35 bp, Homo sapiens; identical to SEQ ID NO: 65181

SEQ ID NO: 65933 - DNA, 41 bp, Homo sapiens; identical to SEQ ID NO: 64500

SEQ ID NO: 65934 - DNA, 40 bp, Homo sapiens; identical to SEQ ID NO: 64504

SEQ ID NO: 65935 - DNA, 34 bp, Homo sapiens; identical to SEQ ID NO: 64121

SEQ ID NO: 65936 - DNA, 35 bp, Homo sapiens; identical to SEQ ID NO: 63920

SEQ ID NO: 65937 - DNA, 41 bp, Homo sapiens; identical to SEQ ID NO: 63921

SEQ ID NO: 65938 - DNA, 30 bp, Homo sapiens; identical to SEQ ID NO: 63953

SEQ ID NO: 65939 - DNA, 37 bp, Homo sapiens; identical to SEQ ID NO: 63945

SEQ ID NO: 65940 - DNA, 43 bp, Homo sapiens; identical to SEQ ID NO: 64820

SEQ ID NO: 65941 - DNA, 44 bp, Homo sapiens; identical to SEQ ID NO: 64821

SEQ ID NO: 65942 - DNA, 22 bp, Homo sapiens
aacacacaatagctaagaccca

SEQ ID NO: 65943 - DNA, 40 bp, Homo sapiens; identical to SEQ ID NO: 63881

SEQ ID NO: 65944 - DNA, 41 bp, Homo sapiens; identical to SEQ ID NO: 63880

SEQ ID NO: 65945 - DNA, 38 bp, Homo sapiens; identical to SEQ ID NO: 64512

SEQ ID NO: 65946 - DNA, 43 bp, Homo sapiens; identical to SEQ ID NO: 64511

SEQ ID NO: 65947 - DNA, 17 bp, Homo sapiens
aaccagtgaaattgacc

SEQ ID NO: 65948 - DNA, 18 bp, Homo sapiens
aaccagtgaaattgacct

SEQ ID NO: 65949 - DNA, 35 bp, Homo sapiens; identical to SEQ ID NO: 63765

SEQ ID NO: 65950 - DNA, 39 bp, Homo sapiens; identical to SEQ ID NO: 63766

SEQ ID NO: 65951 - DNA, 36 bp, Homo sapiens; identical to SEQ ID NO: 64021

SEQ ID NO: 65952 - DNA, 37 bp, Homo sapiens; identical to SEQ ID NO: 64022

SEQ ID NO: 65953 - DNA, 17 bp, Homo sapiens
aaccgtgcaaaggtagc

SEQ ID NO: 65954 - DNA, 33 bp, Homo sapiens; identical to SEQ ID NO: 64643

SEQ ID NO: 65955 - DNA, 35 bp, Homo sapiens; identical to SEQ ID NO: 63926

SEQ ID NO: 65956 - DNA, 42 bp, Homo sapiens; identical to SEQ ID NO: 63927

SEQ ID NO: 65957 - DNA, 43 bp, Homo sapiens; identical to SEQ ID NO: 63928

SEQ ID NO: 65958 - DNA, 17 bp, Homo sapiens
aacctccgagcagtaca

SEQ ID NO: 65959 - DNA, 35 bp, Homo sapiens; identical to SEQ ID NO: 64619

SEQ ID NO: 65960 - DNA, 37 bp, Homo sapiens; identical to SEQ ID NO: 64617

SEQ ID NO: 65961 - DNA, 24 bp, Homo sapiens
aaggacatttaactaaaaccccta

SEQ ID NO: 65962 - DNA, 33 bp, Homo sapiens; identical to SEQ ID NO: 63949

SEQ ID NO: 65963 - DNA, 36 bp, Homo sapiens; identical to SEQ ID NO: 63950

SEQ ID NO: 65964 - DNA, 35 bp, Homo sapiens; identical to SEQ ID NO: 64315

SEQ ID NO: 65965 - DNA, 19 bp, Homo sapiens
acacaatagctaagaccca

SEQ ID NO: 65966 - DNA, 37 bp, Homo sapiens; identical to SEQ ID NO: 63886

SEQ ID NO: 65967 - DNA, 39 bp, Homo sapiens; identical to SEQ ID NO: 63122

SEQ ID NO: 65968 - DNA, 18 bp, Homo sapiens
acacccccacgggaaaca

SEQ ID NO: 65969 - DNA, 45 bp, Homo sapiens; identical to SEQ ID NO: 63938

SEQ ID NO: 65970 - DNA, 37 bp, Homo sapiens; identical to SEQ ID NO: 64522

SEQ ID NO: 65971 - DNA, 42 bp, Homo sapiens; identical to SEQ ID NO: 64521

SEQ ID NO: 65972 - DNA, 44 bp, Homo sapiens; identical to SEQ ID NO: 64524

SEQ ID NO: 65973 - DNA, 19 bp, Homo sapiens
acatcccgatggtgcagcc

SEQ ID NO: 65974 - DNA, 36 bp, Homo sapiens; identical to SEQ ID NO: 64157

SEQ ID NO: 65975 - DNA, 19 bp, Homo sapiens
acatttaactaaaacccct

SEQ ID NO: 65976 - DNA, 32 bp, Homo sapiens; identical to SEQ ID NO: 64761

SEQ ID NO: 65977 - DNA, 34 bp, Homo sapiens; identical to SEQ ID NO: 64762

SEQ ID NO: 65978 - DNA, 46 bp, Homo sapiens; identical to SEQ ID NO: 65326

SEQ ID NO: 65979 - DNA, 40 bp, Homo sapiens; identical to SEQ ID NO: 64481

SEQ ID NO: 65980 - DNA, 41 bp, Homo sapiens; identical to SEQ ID NO: 64482

SEQ ID NO: 65981 - DNA, 41 bp, Homo sapiens; identical to SEQ ID NO: 64048

SEQ ID NO: 65982 - DNA, 35 bp, Homo sapiens; identical to SEQ ID NO: 64008

SEQ ID NO: 65983 - DNA, 16 bp, Homo sapiens
accgtgcaaaggtagc

SEQ ID NO: 65984 - DNA, 19 bp, Homo sapiens
accgtgcaaaggtagcata

SEQ ID NO: 65985 - DNA, 22 bp, Homo sapiens
accgtgcaaaggtagcataatc

SEQ ID NO: 65986 - DNA, 23 bp, Homo sapiens
accgtgcaaaggtagcataatca

SEQ ID NO: 65987 - DNA, 32 bp, Homo sapiens; identical to SEQ ID NO: 64721

SEQ ID NO: 65988 - DNA, 35 bp, Homo sapiens; identical to SEQ ID NO: 64844

SEQ ID NO: 65989 - DNA, 43 bp, Homo sapiens; identical to SEQ ID NO: 63757

SEQ ID NO: 65990 - DNA, 45 bp, Homo sapiens; identical to SEQ ID NO: 63758

SEQ ID NO: 65991 - DNA, 27 bp, Homo sapiens
acgcatttatatagaggagacaagtcg

SEQ ID NO: 65992 - DNA, 30 bp, Homo sapiens; identical to SEQ ID NO: 64774

SEQ ID NO: 65993 - DNA, 36 bp, Homo sapiens; identical to SEQ ID NO: 64621

SEQ ID NO: 65994 - DNA, 43 bp, Homo sapiens; identical to SEQ ID NO: 64229

SEQ ID NO: 65995 - DNA, 44 bp, Homo sapiens; identical to SEQ ID NO: 64230

SEQ ID NO: 65996 - DNA, 35 bp, Homo sapiens; identical to SEQ ID NO: 65295

SEQ ID NO: 65997 - DNA, 34 bp, Homo sapiens; identical to SEQ ID NO: 64286

SEQ ID NO: 65998 - DNA, 38 bp, Homo sapiens; identical to SEQ ID NO: 63651

SEQ ID NO: 65999 - DNA, 43 bp, Homo sapiens; identical to SEQ ID NO: 63652

SEQ ID NO: 66000 - DNA, 38 bp, Homo sapiens; identical to SEQ ID NO: 64362

SEQ ID NO: 66001 - DNA, 39 bp, Homo sapiens; identical to SEQ ID NO: 64363

SEQ ID NO: 66002 - DNA, 28 bp, Homo sapiens
agccacacccccacgggaaacagcagtg

SEQ ID NO: 66003 - DNA, 29 bp, Homo sapiens
agccctaaacctcaacagttaaatcaaca

SEQ ID NO: 66004 - DNA, 45 bp, Homo sapiens; identical to SEQ ID NO: 64790

SEQ ID NO: 66005 - DNA, 17 bp, Homo sapiens
agctaaaagagcacacc

SEQ ID NO: 66006 - DNA, 17 bp, Homo sapiens
aggacatcccgatggtg

SEQ ID NO: 66007 - DNA, 41 bp, Homo sapiens; identical to SEQ ID NO: 64867

SEQ ID NO: 66008 - DNA, 42 bp, Homo sapiens; identical to SEQ ID NO: 64871

SEQ ID NO: 66009 - DNA, 27 bp, Homo sapiens
aggacatttaactaaaacccctacgca

SEQ ID NO: 66010 - DNA, 28 bp, Homo sapiens
aggttcgtttgttcaacgattaaagtcc

SEQ ID NO: 66011 - DNA, 18 bp, Homo sapiens
agtattagaggcaccgcc

SEQ ID NO: 66012 - DNA, 28 bp, Homo sapiens
agtattagaggcaccgcctgcccagtga

SEQ ID NO: 66013 - DNA, 27 bp, Homo sapiens
agtccatatcaacaatagggtttacga

SEQ ID NO: 66014 - DNA, 33 bp, Homo sapiens; identical to SEQ ID NO: 64807

SEQ ID NO: 66015 - DNA, 34 bp, Homo sapiens; identical to SEQ ID NO: 64808

SEQ ID NO: 66016 - DNA, 36 bp, Homo sapiens; identical to SEQ ID NO: 64809

SEQ ID NO: 66017 - DNA, 42 bp, Homo sapiens; identical to SEQ ID NO: 64812

SEQ ID NO: 66018 - DNA, 43 bp, Homo sapiens; identical to SEQ ID NO: 64814

SEQ ID NO: 66019 - DNA, 44 bp, Homo sapiens; identical to SEQ ID NO: 64815

SEQ ID NO: 66020 - DNA, 46 bp, Homo sapiens; identical to SEQ ID NO: 64810

SEQ ID NO: 66021 - DNA, 41 bp, Homo sapiens; identical to SEQ ID NO: 64147

SEQ ID NO: 66022 - DNA, 42 bp, Homo sapiens; identical to SEQ ID NO: 64148

SEQ ID NO: 66023 - DNA, 33 bp, Homo sapiens; identical to SEQ ID NO: 64765

SEQ ID NO: 66024 - DNA, 35 bp, Homo sapiens; identical to SEQ ID NO: 64961

SEQ ID NO: 66025 - DNA, 32 bp, Homo sapiens; identical to SEQ ID NO: 63674

SEQ ID NO: 66026 - DNA, 45 bp, Homo sapiens; identical to SEQ ID NO: 64915

SEQ ID NO: 66027 - DNA, 24 bp, Homo sapiens
cagctcaaaacgcttagcctagcc

SEQ ID NO: 66028 - DNA, 32 bp, Homo sapiens; identical to SEQ ID NO: 63780

SEQ ID NO: 66029 - DNA, 34 bp, Homo sapiens; identical to SEQ ID NO: 64534

SEQ ID NO: 66030 - DNA, 36 bp, Homo sapiens; identical to SEQ ID NO: 64533

SEQ ID NO: 66031 - DNA, 41 bp, Homo sapiens; identical to SEQ ID NO: 64531

SEQ ID NO: 66032 - DNA, 46 bp, Homo sapiens; identical to SEQ ID NO: 64532

SEQ ID NO: 66033 - DNA, 35 bp, Homo sapiens; identical to SEQ ID NO: 64162

SEQ ID NO: 66034 - DNA, 40 bp, Homo sapiens; identical to SEQ ID NO: 63913

SEQ ID NO: 66035 - DNA, 30 bp, Homo sapiens; identical to SEQ ID NO: 63773

SEQ ID NO: 66036 - DNA, 37 bp, Homo sapiens; identical to SEQ ID NO: 63774

SEQ ID NO: 66037 - DNA, 39 bp, Homo sapiens; identical to SEQ ID NO: 63775

SEQ ID NO: 66038 - DNA, 32 bp, Homo sapiens; identical to SEQ ID NO: 65302

SEQ ID NO: 66039 - DNA, 19 bp, Homo sapiens
cccacgggaaacagcagtg

SEQ ID NO: 66040 - DNA, 36 bp, Homo sapiens; identical to SEQ ID NO: 63744

SEQ ID NO: 66041 - DNA, 39 bp, Homo sapiens; identical to SEQ ID NO: 64483

SEQ ID NO: 66042 - DNA, 25 bp, Homo sapiens
ccgcctgtttaccaaaaacatcacc

SEQ ID NO: 66043 - DNA, 38 bp, Homo sapiens; identical to SEQ ID NO: 64484

SEQ ID NO: 66044 - DNA, 39 bp, Homo sapiens; identical to SEQ ID NO: 64895

SEQ ID NO: 66045 - DNA, 25 bp, Homo sapiens
cgcctgtttaccaaaaacatcacct

SEQ ID NO: 66046 - DNA, 36 bp, Homo sapiens; identical to SEQ ID NO: 64491

SEQ ID NO: 66047 - DNA, 37 bp, Homo sapiens; identical to SEQ ID NO: 64489

SEQ ID NO: 66048 - DNA, 37 bp, Homo sapiens; identical to SEQ ID NO: 64923

SEQ ID NO: 66049 - DNA, 43 bp, Homo sapiens; identical to SEQ ID NO: 65066

SEQ ID NO: 66050 - DNA, 34 bp, Homo sapiens; identical to SEQ ID NO: 63802

SEQ ID NO: 66051 - DNA, 38 bp, Homo sapiens; identical to SEQ ID NO: 64152

SEQ ID NO: 66052 - DNA, 35 bp, Homo sapiens; identical to SEQ ID NO: 64638

SEQ ID NO: 66053 - DNA, 28 bp, Homo sapiens
gaacaagttaccctagggataacagcgc

SEQ ID NO: 66054 - DNA, 30 bp, Homo sapiens; identical to SEQ ID NO: 64784

SEQ ID NO: 66055 - DNA, 34 bp, Homo sapiens; identical to SEQ ID NO: 64785

SEQ ID NO: 66056 - DNA, 45 bp, Homo sapiens; identical to SEQ ID NO: 63870

SEQ ID NO: 66057 - DNA, 38 bp, Homo sapiens; identical to SEQ ID NO: 64705

SEQ ID NO: 66058 - DNA, 37 bp, Homo sapiens; identical to SEQ ID NO: 64424

SEQ ID NO: 66059 - DNA, 41 bp, Homo sapiens; identical to SEQ ID NO: 64423

SEQ ID NO: 66060 - DNA, 27 bp, Homo sapiens
gaaggctacaaagtaagcgcaagtacc

SEQ ID NO: 66061 - DNA, 33 bp, Homo sapiens; identical to SEQ ID NO: 64431

SEQ ID NO: 66062 - DNA, 36 bp, Homo sapiens; identical to SEQ ID NO: 64432

SEQ ID NO: 66063 - DNA, 40 bp, Homo sapiens; identical to SEQ ID NO: 64433

SEQ ID NO: 66064 - DNA, 17 bp, Homo sapiens
gacatcccgatggtgca

SEQ ID NO: 66065 - DNA, 19 bp, Homo sapiens
gacatcccgatggtgcagc

SEQ ID NO: 66066 - DNA, 22 bp, Homo sapiens
gacatttaactaaaacccctac

SEQ ID NO: 66067 - DNA, 46 bp, Homo sapiens; identical to SEQ ID NO: 64106

SEQ ID NO: 66068 - DNA, 35 bp, Homo sapiens; identical to SEQ ID NO: 64758

SEQ ID NO: 66069 - DNA, 18 bp, Homo sapiens
gaccaatctatcacccta

SEQ ID NO: 66070 - DNA, 33 bp, Homo sapiens; identical to SEQ ID NO: 63901

SEQ ID NO: 66071 - DNA, 38 bp, Homo sapiens; identical to SEQ ID NO: 63902

SEQ ID NO: 66072 - DNA, 39 bp, Homo sapiens; identical to SEQ ID NO: 63896

SEQ ID NO: 66073 - DNA, 40 bp, Homo sapiens; identical to SEQ ID NO: 63897

SEQ ID NO: 66074 - DNA, 41 bp, Homo sapiens; identical to SEQ ID NO: 63898

SEQ ID NO: 66075 - DNA, 45 bp, Homo sapiens; identical to SEQ ID NO: 63899

SEQ ID NO: 66076 - DNA, 46 bp, Homo sapiens; identical to SEQ ID NO: 63900

SEQ ID NO: 66077 - DNA, 21 bp, Homo sapiens
gacctcgatgttggatcagga

SEQ ID NO: 66078 - DNA, 23 bp, Homo sapiens
gacctcgatgttggatcaggaca

SEQ ID NO: 66079 - DNA, 34 bp, Homo sapiens; identical to SEQ ID NO: 64839

SEQ ID NO: 66080 - DNA, 31 bp, Homo sapiens; identical to SEQ ID NO: 64290

SEQ ID NO: 66081 - DNA, 33 bp, Homo sapiens; identical to SEQ ID NO: 64291

SEQ ID NO: 66082 - DNA, 18 bp, Homo sapiens
gagcagaacccaacctcc

SEQ ID NO: 66083 - DNA, 19 bp, Homo sapiens
gagcagaacccaacctccg

SEQ ID NO: 66084 - DNA, 39 bp, Homo sapiens; identical to SEQ ID NO: 64728

SEQ ID NO: 66085 - DNA, 26 bp, Homo sapiens
gagcctggtgatagctggttgtccaa

SEQ ID NO: 66086 - DNA, 35 bp, Homo sapiens; identical to SEQ ID NO: 65047

SEQ ID NO: 66087 - DNA, 26 bp, Homo sapiens
gatggtgcagccgctattaaaggttc

SEQ ID NO: 66088 - DNA, 37 bp, Homo sapiens; identical to SEQ ID NO: 64365

SEQ ID NO: 66089 - DNA, 42 bp, Homo sapiens; identical to SEQ ID NO: 64909

SEQ ID NO: 66090 - DNA, 46 bp, Homo sapiens; identical to SEQ ID NO: 64910

SEQ ID NO: 66091 - DNA, 25 bp, Homo sapiens
gcagctcaaaacgcttagcctagcc

SEQ ID NO: 66092 - DNA, 30 bp, Homo sapiens; identical to SEQ ID NO: 63696

SEQ ID NO: 66093 - DNA, 32 bp, Homo sapiens; identical to SEQ ID NO: 63692

SEQ ID NO: 66094 - DNA, 33 bp, Homo sapiens; identical to SEQ ID NO: 63693

SEQ ID NO: 66095 - DNA, 34 bp, Homo sapiens; identical to SEQ ID NO: 63694

SEQ ID NO: 66096 - DNA, 29 bp, Homo sapiens
gcccaatatctacaatcaaccaacaagtc

SEQ ID NO: 66097 - DNA, 30 bp, Homo sapiens; identical to SEQ ID NO: 64447

SEQ ID NO: 66098 - DNA, 31 bp, Homo sapiens; identical to SEQ ID NO: 64630

SEQ ID NO: 66099 - DNA, 33 bp, Homo sapiens; identical to SEQ ID NO: 64632

SEQ ID NO: 66100 - DNA, 16 bp, Homo sapiens
gccgctattaaaggtt

SEQ ID NO: 66101 - DNA, 39 bp, Homo sapiens; identical to SEQ ID NO: 64920

SEQ ID NO: 66102 - DNA, 23 bp, Homo sapiens
gcctgtttaccaaaaacatcacc

SEQ ID NO: 66103 - DNA, 25 bp, Homo sapiens
gcgcaatcctattctagagtccata

SEQ ID NO: 66104 - DNA, 26 bp, Homo sapiens
gcgcaatcctattctagagtccatat

SEQ ID NO: 66105 - DNA, 43 bp, Homo sapiens; identical to SEQ ID NO: 64795

SEQ ID NO: 66106 - DNA, 45 bp, Homo sapiens; identical to SEQ ID NO: 64796

SEQ ID NO: 66107 - DNA, 18 bp, Homo sapiens
gcggtcacacgattaacc

SEQ ID NO: 66108 - DNA, 25 bp, Homo sapiens
gcggtcacacgattaacccaagtca

SEQ ID NO: 66109 - DNA, 25 bp, Homo sapiens
gcgtaaagagtgttttagatcaccc

SEQ ID NO: 66110 - DNA, 33 bp, Homo sapiens; identical to SEQ ID NO: 63827

SEQ ID NO: 66111 - DNA, 18 bp, Homo sapiens
gcgttcaagctcaacacc

SEQ ID NO: 66112 - DNA, 41 bp, Homo sapiens; identical to SEQ ID NO: 63845

SEQ ID NO: 66113 - DNA, 36 bp, Homo sapiens; identical to SEQ ID NO: 64929

SEQ ID NO: 66114 - DNA, 34 bp, Homo sapiens; identical to SEQ ID NO: 64660

SEQ ID NO: 66115 - DNA, 27 bp, Homo sapiens
ggaaacagcagtgattaacctttagca

SEQ ID NO: 66116 - DNA, 29 bp, Homo sapiens
ggaacaagttaccctagggataacagcgc

SEQ ID NO: 66117 - DNA, 41 bp, Homo sapiens; identical to SEQ ID NO: 64947

SEQ ID NO: 66118 - DNA, 42 bp, Homo sapiens; identical to SEQ ID NO: 64948

SEQ ID NO: 66119 - DNA, 43 bp, Homo sapiens; identical to SEQ ID NO: 64949

SEQ ID NO: 66120 - DNA, 25 bp, Homo sapiens
ggacatcccgatggtgcagccgcta

SEQ ID NO: 66121 - DNA, 35 bp, Homo sapiens; identical to SEQ ID NO: 64875

SEQ ID NO: 66122 - DNA, 43 bp, Homo sapiens; identical to SEQ ID NO: 64097

SEQ ID NO: 66123 - DNA, 18 bp, Homo sapiens
ggaccaatctatcaccct

SEQ ID NO: 66124 - DNA, 19 bp, Homo sapiens
ggaccaatctatcacccta

SEQ ID NO: 66125 - DNA, 37 bp, Homo sapiens; identical to SEQ ID NO: 65341

SEQ ID NO: 66126 - DNA, 46 bp, Homo sapiens; identical to SEQ ID NO: 64361

SEQ ID NO: 66127 - DNA, 30 bp, Homo sapiens; identical to SEQ ID NO: 63817

SEQ ID NO: 66128 - DNA, 33 bp, Homo sapiens; identical to SEQ ID NO: 63818

SEQ ID NO: 66129 - DNA, 23 bp, Homo sapiens
ggcgtccagtgcggtaacgcgac

SEQ ID NO: 66130 - DNA, 24 bp, Homo sapiens
ggcgtccagtgcggtaacgcgacc

SEQ ID NO: 66131 - DNA, 26 bp, Homo sapiens
ggcgtccagtgcggtaacgcgaccga

SEQ ID NO: 66132 - DNA, 18 bp, Homo sapiens
ggctacaaagtaagcgca

SEQ ID NO: 66133 - DNA, 24 bp, Homo sapiens
ggctacaaagtaagcgcaagtacc

SEQ ID NO: 66134 - DNA, 25 bp, Homo sapiens
ggctacaaagtaagcgcaagtaccc

SEQ ID NO: 66135 - DNA, 17 bp, Homo sapiens
ggtaccctaaccgtgca

SEQ ID NO: 66136 - DNA, 45 bp, Homo sapiens; identical to SEQ ID NO: 64906

SEQ ID NO: 66137 - DNA, 24 bp, Homo sapiens
gtaccctaaccgtgcaaaggtagc

SEQ ID NO: 66138 - DNA, 44 bp, Homo sapiens; identical to SEQ ID NO: 64044

SEQ ID NO: 66139 - DNA, 40 bp, Homo sapiens; identical to SEQ ID NO: 64150

SEQ ID NO: 66140 - DNA, 17 bp, Homo sapiens
gtgacacatgtttaacg

SEQ ID NO: 66141 - DNA, 44 bp, Homo sapiens; identical to SEQ ID NO: 64907

SEQ ID NO: 66142 - DNA, 34 bp, Homo sapiens; identical to SEQ ID NO: 64640

SEQ ID NO: 66143 - DNA, 41 bp, Homo sapiens; identical to SEQ ID NO: 64475

SEQ ID NO: 66144 - DNA, 29 bp, Homo sapiens
tagccacacccccacgggaaacagcagtg

SEQ ID NO: 66145 - DNA, 36 bp, Homo sapiens; identical to SEQ ID NO: 63730

SEQ ID NO: 66146 - DNA, 46 bp, Homo sapiens; identical to SEQ ID NO: 65085

SEQ ID NO: 66147 - DNA, 36 bp, Homo sapiens; identical to SEQ ID NO: 64755

SEQ ID NO: 66148 - DNA, 17 bp, Homo sapiens
tgcgtcagattaaaaca

SEQ ID NO: 66149 - DNA, 32 bp, Homo sapiens; identical to SEQ ID NO: 64170

SEQ ID NO: 66150 - DNA, 18 bp, Homo sapiens
tccccggcatctccacca

SEQ ID NO: 66151 - DNA, 18 bp, Homo sapiens
tccccggcacctccacca

SEQ ID NO: 66152 - DNA, 33 bp, Homo sapiens
gcccggctagctcagtcggtagagcatgagact

SEQ ID NO: 66153 - DNA, 17 bp, Homo sapiens
ccccggcatctccacca

SEQ ID NO: 66154 - DNA, 18 bp, Homo sapiens
atcccaccgctgccacca

SEQ ID NO: 66155 - DNA, 18 bp, Homo sapiens
tccccagtacctccacca

SEQ ID NO: 66156 - DNA, 17 bp, Homo sapiens
accgggcggaaacacca

SEQ ID NO: 66157 - DNA, 32 bp, Homo sapiens
gcccggctagctcagtcggtagagcatgagac

SEQ ID NO: 66158 - DNA, 33 bp, Homo sapiens
accggagatgaaaacctttttccaaggacacca

SEQ ID NO: 66159 - DNA, 33 bp, Homo sapiens
gcccggctagctcagtcggtagagcatgggact

SEQ ID NO: 66160 - DNA, 17 bp, Homo sapiens
tccgggtgccccctcca

SEQ ID NO: 66161 - DNA, 31 bp, Homo sapiens
gcccggctagctcagtcggtagagcatgaga

SEQ ID NO: 66162 - DNA, 33 bp, Homo sapiens
gcccggatagctcagtcggtagagcatcagact

SEQ ID NO: 66163 - DNA, 17 bp, Homo sapiens
ccccggcacctccacca

SEQ ID NO: 66164 - DNA, 33 bp, Homo sapiens
gcgccgctggtgtagtggtatcatgcaagattc

SEQ ID NO: 66165 - DNA, 31 bp, Homo sapiens
gcccggctagctcagtcggtagagcatggga

SEQ ID NO: 66166 - DNA, 31 bp, Homo sapiens
gcccggatagctcagtcggtagagcatcaga

SEQ ID NO: 66167 - DNA, 16 bp, Homo sapiens
ccgggcggaaacacca

SEQ ID NO: 66168 - DNA, 19 bp, Homo sapiens
catcaccccataaacacca

SEQ ID NO: 66169 - DNA, 30 bp, Homo sapiens
ggagatgaaaacctttttccaaggacacca

SEQ ID NO: 66170 - DNA, 34 bp, Homo sapiens
aaccggagatgaaaacctttttccaaggacacca

SEQ ID NO: 66171 - DNA, 18 bp, Homo sapiens
atccgggtgccccctcca

SEQ ID NO: 66172 - DNA, 31 bp, Homo sapiens
cggagatgaaaacctttttccaaggacacca

SEQ ID NO: 66173 - DNA, 22 bp, Homo sapiens
tcaatccccggcacctccacca

SEQ ID NO: 66174 - DNA, 32 bp, Homo sapiens
gcccggctagctcagtcggtagagcatgggac

SEQ ID NO: 66175 - DNA, 32 bp, Homo sapiens
gcccggatagctcagtcggtagagcatcagac

SEQ ID NO: 66176 - DNA, 25 bp, Homo sapiens
ggctcacatcaccccataaacacca

SEQ ID NO: 66177 - DNA, 18 bp, Homo sapiens
aaccgggcggaaacacca

SEQ ID NO: 66178 - DNA, 36 bp, Homo sapiens
catgcccccatgtctaacaacatggctttctcacca

SEQ ID NO: 66179 - DNA, 33 bp, Homo sapiens
tccctggtggtctagtggttaggattcggcgct

SEQ ID NO: 66180 - DNA, 35 bp, Homo sapiens
atgcccccatgtctaacaacatggctttctcacca

SEQ ID NO: 66181 - DNA, 17 bp, Homo sapiens
tccggctcgaaggacca

SEQ ID NO: 66182 - DNA, 42 bp, Homo sapiens
acacgcagaaggtcctgggttcgagccccagtggaaccacca

SEQ ID NO: 66183 - DNA, 34 bp, Homo sapiens
gcccggctagctcagtcggtagagcatgagactc

SEQ ID NO: 66184 - DNA, 32 bp, Homo sapiens
ccggagatgaaaacctttttccaaggacacca

SEQ ID NO: 66185 - DNA, 21 bp, Homo sapiens
aacacctctttacagtgacca

SEQ ID NO: 66186 - DNA, 17 bp, Homo sapiens
tcccaccgctgccacca

SEQ ID NO: 66187 - DNA, 34 bp, Homo sapiens
tgcccccatgtctaacaacatggctttctcacca

SEQ ID NO: 66188 - DNA, 34 bp, Homo sapiens
gcccggctagctcagtcggtagagcatgggactc

SEQ ID NO: 66189 - DNA, 18 bp, Homo sapiens
atcccagcggggcctcca

SEQ ID NO: 66190 - DNA, 39 bp, Homo sapiens
acgcgggagaccggggttcgattccccgacggggagcca

SEQ ID NO: 66191 - DNA, 34 bp, Homo sapiens
gcccggatagctcagtcggtagagcatcagactt

SEQ ID NO: 66192 - DNA, 20 bp, Homo sapiens
acacctctttacagtgacca

SEQ ID NO: 66193 - DNA, 16 bp, Homo sapiens
cccggccaacgcacca

SEQ ID NO: 66194 - DNA, 17 bp, Homo sapiens
accgggcagaagcacca

SEQ ID NO: 66195 - DNA, 28 bp, Homo sapiens
cggctagctcagtcggtagagcatggga

SEQ ID NO: 66196 - DNA, 32 bp, Homo sapiens
cgcgggagaccggggttcgattccccgacggg

SEQ ID NO: 66197 - DNA, 17 bp, Homo sapiens
cctctttacagtgacca

SEQ ID NO: 66198 - DNA, 18 bp, Homo sapiens
tccccgacacctccacca

SEQ ID NO: 66199 - DNA, 17 bp, Homo sapiens
cccgggcggaaacacca

SEQ ID NO: 66200 - DNA, 33 bp, Homo sapiens
acgcgggagaccggggttcgattccccgacggg

SEQ ID NO: 66201 - DNA, 18 bp, Homo sapiens
atcctgccgactacgcca

SEQ ID NO: 66202 - DNA, 16 bp, Homo sapiens
ccgggtgccccctcca

SEQ ID NO: 66203 - DNA, 40 bp, Homo sapiens
acgcagaaggtcctgggttcgagccccagtggaaccacca

SEQ ID NO: 66204 - DNA, 18 bp, Homo sapiens
atcaccccataaacacca

SEQ ID NO: 66205 - DNA, 33 bp, Homo sapiens
gcccccatgtctaacaacatggctttctcacca

SEQ ID NO: 66206 - DNA, 17 bp, Homo sapiens
atcccaccgctgccacc

SEQ ID NO: 66207 - DNA, 22 bp, Homo sapiens
tcgattcccggccaacgcacca

SEQ ID NO: 66208 - DNA, 38 bp, Homo sapiens
cgcgggagaccggggttcgattccccgacggggagcca

SEQ ID NO: 66209 - DNA, 41 bp, Homo sapiens
tcacgcgggagaccggggttcgattccccgacggggagcca

SEQ ID NO: 66210 - DNA, 35 bp, Homo sapiens
catgcccccatgtctaacaacatggctttctcacc

SEQ ID NO: 66211 - DNA, 21 bp, Homo sapiens
cacatcaccccataaacacca

SEQ ID NO: 66212 - DNA, 33 bp, Homo sapiens
gcatgggtggttcagtggtagaattctcgcctg

SEQ ID NO: 66213 - DNA, 24 bp, Homo sapiens
gctcacatcaccccataaacacca

SEQ ID NO: 66214 - DNA, 22 bp, Homo sapiens
tcgattcccggcccatgcacca

SEQ ID NO: 66215 - DNA, 34 bp, Homo sapiens
cgcgggagaccggggttcgattccccgacgggga

SEQ ID NO: 66216 - DNA, 18 bp, Homo sapiens
cccccggctcctccacca

SEQ ID NO: 66217 - DNA, 34 bp, Homo sapiens
atgcccccatgtctaacaacatggctttctcacc

SEQ ID NO: 66218 - DNA, 18 bp, Homo sapiens
accccgtccgtgcctcca

SEQ ID NO: 66219 - DNA, 43 bp, Homo sapiens
tgtcacgcgggagaccggggttcgattccccgacggggagcca

SEQ ID NO: 66220 - DNA, 22 bp, Homo sapiens
tcgatccccagtacctccacca

SEQ ID NO: 66221 - DNA, 17 bp, Homo sapiens
tcccgggcggcgcacca

SEQ ID NO: 66222 - DNA, 32 bp, Homo sapiens
gcatgggtggttcagtggtagaattctcgcct

SEQ ID NO: 66223 - DNA, 18 bp, Homo sapiens
tgcccgcatcctccacca

SEQ ID NO: 66224 - DNA, 18 bp, Homo sapiens
gtcccacccggggtacca

SEQ ID NO: 66225 - DNA, 33 bp, Homo sapiens
tgcccccatgtctaacaacatggctttctcacc

SEQ ID NO: 66226 - DNA, 18 bp, Homo sapiens
acctctttacagtgacca

SEQ ID NO: 66227 - DNA, 22 bp, Homo sapiens
tcgactcccggtatgggaacca

SEQ ID NO: 66228 - DNA, 18 bp, Homo sapiens
tcccgggcggaaacacca

SEQ ID NO: 66229 - DNA, 19 bp, Homo sapiens
atccccggcacctccacca

SEQ ID NO: 66230 - DNA, 28 bp, Homo sapiens
cggctagctcagtcggtagagcatgaga

SEQ ID NO: 66231 - DNA, 18 bp, Homo sapiens
atcccagcggtgcctcca

SEQ ID NO: 66232 - DNA, 22 bp, Homo sapiens
tcgattcccggccaatgcacca

SEQ ID NO: 66233 - DNA, 44 bp, Homo sapiens
acttacacttaggagatttcaacttaacttgaccgctctgacca

SEQ ID NO: 66234 - DNA, 20 bp, Homo sapiens
acatcaccccataaacacca

SEQ ID NO: 66235 - DNA, 19 bp, Homo sapiens
atccccagtacctccacca

SEQ ID NO: 66236 - DNA, 34 bp, Homo sapiens
gacaacagaggcttacgaccccttatttacccca

SEQ ID NO: 66237 - DNA, 19 bp, Homo sapiens
atccccggcatctccacca

SEQ ID NO: 66238 - DNA, 16 bp, Homo sapiens
ccgggcagaagcacca

SEQ ID NO: 66239 - DNA, 17 bp, Homo sapiens
ccccagtacctccacca

SEQ ID NO: 66240 - DNA, 31 bp, Homo sapiens
tccctggtggtctagtggttaggattcggcg

SEQ ID NO: 66241 - DNA, 17 bp, Homo sapiens
gcccgcattctccacca

SEQ ID NO: 66242 - DNA, 46 bp, Homo sapiens
gcctgtcacgcgggagaccggggttcgattccccgacggggagcca

SEQ ID NO: 66243 - DNA, 18 bp, Homo sapiens
atccggctcgaaggacca

SEQ ID NO: 66244 - DNA, 34 bp, Homo sapiens
tccctggtggtctagtggttaggattcggcgctc

SEQ ID NO: 66245 - DNA, 16 bp, Homo sapiens
cccgggcggcgcacca

SEQ ID NO: 66246 - DNA, 32 bp, Homo sapiens
tccctggtggtctagtggttaggattcggcgc

SEQ ID NO: 66247 - DNA, 23 bp, Homo sapiens
cctgtcacgcgggagaccggggt

SEQ ID NO: 66248 - DNA, 46 bp, Homo sapiens
caacttacacttaggagatttcaacttaacttgaccgctctgacca

SEQ ID NO: 66249 - DNA, 22 bp, Homo sapiens
ctgtcacgcgggagaccggggt

SEQ ID NO: 66250 - DNA, 17 bp, Homo sapiens
tcctgccgactacgcca

SEQ ID NO: 66251 - DNA, 22 bp, Homo sapiens
tcgatccccggcatctccacca

SEQ ID NO: 66252 - DNA, 16 bp, Homo sapiens
ctcggtggaacctcca

SEQ ID NO: 66253 - DNA, 16 bp, Homo sapiens
ccggctcgaaggacca

SEQ ID NO: 66254 - DNA, 30 bp, Homo sapiens
gcccggctagctcagtcggtagagcatggg

SEQ ID NO: 66255 - DNA, 29 bp, Homo sapiens
cggctagctcagtcggtagagcatgggac

SEQ ID NO: 66256 - DNA, 39 bp, Homo sapiens
acgcgggagaccggggttcaattccccgacggggagcca

SEQ ID NO: 66257 - DNA, 29 bp, Homo sapiens
gagatgaaaacctttttccaaggacacca

SEQ ID NO: 66258 - DNA, 25 bp, Homo sapiens
ggttcgattccccgacggggagcca

SEQ ID NO: 66259 - DNA, 32 bp, Homo sapiens
gcccccatgtctaacaacatggctttctcacc

SEQ ID NO: 66260 - DNA, 30 bp, Homo sapiens
gcgccgctggtgtagtggtatcatgcaaga

SEQ ID NO: 66261 - DNA, 43 bp, Homo sapiens
gctaactcatgcccccatgtctaacaacatggctttctcacca

SEQ ID NO: 66262 - DNA, 31 bp, Homo sapiens
gcgggagaccggggttcgattccccgacggg

SEQ ID NO: 66263 - DNA, 32 bp, Homo sapiens
gcgccgctggtgtagtggtatcatgcaagatt

SEQ ID NO: 66264 - DNA, 40 bp, Homo sapiens
acacttaggagatttcaacttaacttgaccgctctgacca

SEQ ID NO: 66265 - DNA, 22 bp, Homo sapiens
tcgattcccgggcggcgcacca

SEQ ID NO: 66266 - DNA, 39 bp, Homo sapiens
cgcagaaggtcctgggttcgagccccagtggaaccacca

SEQ ID NO: 66267 - DNA, 34 bp, Homo sapiens
ggagaccggggttcgattccccgacggggagcca

SEQ ID NO: 66268 - DNA, 37 bp, Homo sapiens
gtaaaccggagatgaaaacctttttccaaggacacca

SEQ ID NO: 66269 - DNA, 28 bp, Homo sapiens
ggagaccggggttcgattccccgacggg

SEQ ID NO: 66270 - DNA, 35 bp, Homo sapiens
tccctggtggtctagtggttaggattcggcgctct

SEQ ID NO: 66271 - DNA, 29 bp, Homo sapiens
cggctagctcagtcggtagagcatgagac

SEQ ID NO: 66272 - DNA, 17 bp, Homo sapiens
accccttatttacccca

SEQ ID NO: 66273 - DNA, 39 bp, Homo sapiens
actaagtgtttgtgggtttaagtcccattggtctagcca

SEQ ID NO: 66274 - DNA, 35 bp, Homo sapiens
gcccggatagctcagtcggtagagcatcagacttt

SEQ ID NO: 66275 - DNA, 18 bp, Homo sapiens
ttcccgggcggcgcacca

SEQ ID NO: 66276 - DNA, 31 bp, Homo sapiens
ggttccatagtgtagtggttatcacgtctgc

SEQ ID NO: 66277 - DNA, 25 bp, Homo sapiens
caacttaacttgaccgctctgacca

SEQ ID NO: 66278 - DNA, 18 bp, Homo sapiens
atcccaccagagtcgcca

SEQ ID NO: 66279 - DNA, 18 bp, Homo sapiens
atcccagtagagcctcca

SEQ ID NO: 66280 - DNA, 26 bp, Homo sapiens
gggctcacatcaccccataaacacca

SEQ ID NO: 66281 - DNA, 17 bp, Homo sapiens
ccccgacacctccacca

SEQ ID NO: 66282 - DNA, 27 bp, Homo sapiens
gtggttgtagtccgtgcgagaatacca

SEQ ID NO: 66283 - DNA, 18 bp, Homo sapiens
gtccgtgcgagaatacca

SEQ ID NO: 66284 - DNA, 32 bp, Homo sapiens
acgcgggagaccggggttcgattccccgacgg

SEQ ID NO: 66285 - DNA, 33 bp, Homo sapiens
gagaccggggttcgattccccgacggggagcca

SEQ ID NO: 66286 - DNA, 22 bp, Homo sapiens
tcaatccccagcacctccacca

SEQ ID NO: 66287 - DNA, 17 bp, Homo sapiens
tccccggcacctccacc

SEQ ID NO: 66288 - DNA, 24 bp, Homo sapiens
gacaacattcaaaaaagagtacca

SEQ ID NO: 66289 - DNA, 22 bp, Homo sapiens
tcaaatcccggacgagccccca

SEQ ID NO: 66290 - DNA, 32 bp, Homo sapiens
agcagagtggcgcagcggaagcgtgctgggcc

SEQ ID NO: 66291 - DNA, 29 bp, Homo sapiens
gacgggctcacatcaccccataaacacca

SEQ ID NO: 66292 - DNA, 32 bp, Homo sapiens
cccccatgtctaacaacatggctttctcacca

SEQ ID NO: 66293 - DNA, 38 bp, Homo sapiens
gcagaaggtcctgggttcgagccccagtggaaccacca

SEQ ID NO: 66294 - DNA, 41 bp, Homo sapiens
tgaatctgacaacagaggcttacgaccccttatttacccca

SEQ ID NO: 66295 - DNA, 30 bp, Homo sapiens
cgggagaccggggttcgattccccgacggg

SEQ ID NO: 66296 - DNA, 39 bp, Homo sapiens
actcatgcccccatgtctaacaacatggctttctcacca

SEQ ID NO: 66297 - DNA, 33 bp, Homo sapiens
cgcgggagaccggggttcgattccccgacgggg

SEQ ID NO: 66298 - DNA, 33 bp, Homo sapiens
agcagagtggcgcagcggaagcgtgctgggccc

SEQ ID NO: 66299 - DNA, 22 bp, Homo sapiens
tcaatccccggcatctccacca

SEQ ID NO: 66300 - DNA, 30 bp, Homo sapiens
cggctagctcagtcggtagagcatgggact

SEQ ID NO: 66301 - DNA, 33 bp, Homo sapiens
gcgggagaccggggttcgattccccgacgggga

SEQ ID NO: 66302 - DNA, 41 bp, Homo sapiens
tacacttaggagatttcaacttaacttgaccgctctgacca

SEQ ID NO: 66303 - DNA, 27 bp, Homo sapiens
gaggcttacgaccccttatttacccca

SEQ ID NO: 66304 - DNA, 36 bp, Homo sapiens
gcccggatagctcagtcggtagagcatcagactttt

SEQ ID NO: 66305 - DNA, 36 bp, Homo sapiens
ctgacaacagaggcttacgaccccttatttacccca

SEQ ID NO: 66306 - DNA, 42 bp, Homo sapiens
gtcacgcgggagaccggggttcgattccccgacggggagcca

SEQ ID NO: 66307 - DNA, 18 bp, Homo sapiens
atccaggtgccccctcca

SEQ ID NO: 66308 - DNA, 40 bp, Homo sapiens
cacgcgggagaccggggttcgattccccgacggggagcca

SEQ ID NO: 66309 - DNA, 17 bp, Homo sapiens
tccccagtacctccacc

SEQ ID NO: 66310 - DNA, 45 bp, Homo sapiens
ggcccataccccgaaaatgttggttatacccttcccgtactacca

SEQ ID NO: 66311 - DNA, 39 bp, Homo sapiens
taccccgaaaatgttggttatacccttcccgtactacca

SEQ ID NO: 66312 - DNA, 36 bp, Homo sapiens
gcccggctagctcagtcggtagagcatgagactctt

SEQ ID NO: 66313 - DNA, 37 bp, Homo sapiens
gcgggagaccggggttcgattccccgacggggagcca

SEQ ID NO: 66314 - DNA, 34 bp, Homo sapiens
gcatgggtggttcagtggtagaattctcgcctgc

SEQ ID NO: 66315 - DNA, 31 bp, Homo sapiens
cgcgggagaccggggttcgattccccgacgg

SEQ ID NO: 66316 - DNA, 32 bp, Homo sapiens
cgggagaccggggttcgattccccgacgggga

SEQ ID NO: 66317 - DNA, 18 bp, Homo sapiens
gtcccaccagagtcgcca

SEQ ID NO: 66318 - DNA, 22 bp, Homo sapiens
tcgatccccggcacctccacca

SEQ ID NO: 66319 - DNA, 18 bp, Homo sapiens
atcccatcctcgtcgcca

SEQ ID NO: 66320 - DNA, 21 bp, Homo sapiens
caatccccggcacctccacca

SEQ ID NO: 66321 - DNA, 16 bp, Homo sapiens
ctctttacagtgacca

SEQ ID NO: 66322 - DNA, 18 bp, Homo sapiens
gagcccggtaatcgcata

SEQ ID NO: 66323 - DNA, 18 bp, Homo sapiens
acctcagagggggcacca

SEQ ID NO: 66324 - DNA, 45 bp, Homo sapiens
aacttacacttaggagatttcaacttaacttgaccgctctgacca

SEQ ID NO: 66325 - DNA, 42 bp, Homo sapiens
gctaactcatgcccccatgtctaacaacatggctttctcacc

SEQ ID NO: 66326 - DNA, 17 bp, Homo sapiens
tccccggcatctccacc

SEQ ID NO: 66327 - DNA, 36 bp, Homo sapiens
gcccggctagctcagtcggtagagcatgggactctt

SEQ ID NO: 66328 - DNA, 29 bp, Homo sapiens
caaagcaatacactgaaaatgtttagacg

SEQ ID NO: 66329 - DNA, 36 bp, Homo sapiens
atctaaagacaggggttaggcctctttttaccacca

SEQ ID NO: 66330 - DNA, 26 bp, Homo sapiens
gagcttaaacccccttatttctacca

SEQ ID NO: 66331 - DNA, 37 bp, Homo sapiens
tccctggtggtctagtggttaggattcggcgctctca

SEQ ID NO: 66332 - DNA, 16 bp, Homo sapiens
cctgccgactacgcca

SEQ ID NO: 66333 - DNA, 36 bp, Homo sapiens
tccctggtggtctagtggttaggattcggcgctctc

SEQ ID NO: 66334 - DNA, 27 bp, Homo sapiens
agaaccaacacctctttacagtgacca

SEQ ID NO: 66335 - DNA, 22 bp, Homo sapiens
tcgagccccagtggaaccacca

SEQ ID NO: 66336 - DNA, 34 bp, Homo sapiens
gcgccgctggtgtagtggtatcatgcaagattcc

SEQ ID NO: 66337 - DNA, 30 bp, Homo sapiens
agacgggctcacatcaccccataaacacca

SEQ ID NO: 66338 - DNA, 34 bp, Homo sapiens
gacccagtggcctaatggataaggcatcagcctc

SEQ ID NO: 66339 - DNA, 39 bp, Homo sapiens
tgcacgaggccccgggttcaatccccggcacctccacca

SEQ ID NO: 66340 - DNA, 29 bp, Homo sapiens
ccggctagctcagtcggtagagcatggga

SEQ ID NO: 66341 - DNA, 18 bp, Homo sapiens
aaccgggcagaagcacca

SEQ ID NO: 66342 - DNA, 25 bp, Homo sapiens
gcccggctagctcagtcggtagagc

SEQ ID NO: 66343 - DNA, 29 bp, Homo sapiens
ccggctagctcagtcggtagagcatgaga

SEQ ID NO: 66344 - DNA, 18 bp, Homo sapiens
ttcccggccaacgcacca

SEQ ID NO: 66345 - DNA, 21 bp, Homo sapiens
cgatccccggcatctccacca

SEQ ID NO: 66346 - DNA, 19 bp, Homo sapiens
agtccgtgcgagaatacca

SEQ ID NO: 66347 - DNA, 31 bp, Homo sapiens
cctggtggtctagtggttaggattcggcgct

SEQ ID NO: 66348 - DNA, 36 bp, Homo sapiens
cgggagaccggggttcgattccccgacggggagcca

SEQ ID NO: 66349 - DNA, 24 bp, Homo sapiens
ggctcacatcaccccataaacacc

SEQ ID NO: 66350 - DNA, 32 bp, Homo sapiens
agaccggggttcgattccccgacggggagcca

SEQ ID NO: 66351 - DNA, 22 bp, Homo sapiens
tcacatcaccccataaacacca

SEQ ID NO: 66352 - DNA, 24 bp, Homo sapiens
accaacacctctttacagtgacca

SEQ ID NO: 66353 - DNA, 23 bp, Homo sapiens
tcccacatggtctagcggttagg

SEQ ID NO: 66354 - DNA, 34 bp, Homo sapiens
gattgtgaatctgacaacagaggcttacgacccc

SEQ ID NO: 66355 - DNA, 37 bp, Homo sapiens
tcatgcccccatgtctaacaacatggctttctcacca

SEQ ID NO: 66356 - DNA, 23 bp, Homo sapiens
ccaacacctctttacagtgacca

SEQ ID NO: 66357 - DNA, 26 bp, Homo sapiens
gcccggctagctcagtcggtagagca

SEQ ID NO: 66358 - DNA, 30 bp, Homo sapiens
gcccggctagctcagtcggtagagcatgag

SEQ ID NO: 66359 - DNA, 33 bp, Homo sapiens
gtttccgtagtgtagcggttatcacattcgcct

SEQ ID NO: 66360 - DNA, 16 bp, Homo sapiens
gagcccggtaatcgca

SEQ ID NO: 66361 - DNA, 40 bp, Homo sapiens
gaaaatgtttagacgggctcacatcaccccataaacacca

SEQ ID NO: 66362 - DNA, 17 bp, Homo sapiens
ccccgtccgtgcctcca

SEQ ID NO: 66363 - DNA, 22 bp, Homo sapiens
tcgaatcccagcggtgcctcca

SEQ ID NO: 66364 - DNA, 22 bp, Homo sapiens
tcgaatcccactcctgacacca

SEQ ID NO: 66365 - DNA, 33 bp, Homo sapiens
gcttctgtagtgtagtggttatcacgttcgcct

SEQ ID NO: 66366 - DNA, 36 bp, Homo sapiens
agtggttaggattcggcgctctcaccgccgcggccc

SEQ ID NO: 66367 - DNA, 26 bp, Homo sapiens
gaaccaacacctctttacagtgacca

SEQ ID NO: 66368 - DNA, 21 bp, Homo sapiens
tacgaccccttatttacccca

SEQ ID NO: 66369 - DNA, 40 bp, Homo sapiens
aactcatgcccccatgtctaacaacatggctttctcacca

SEQ ID NO: 66370 - DNA, 29 bp, Homo sapiens
gcccggctagctcagtcggtagagcatga

SEQ ID NO: 66371 - DNA, 35 bp, Homo sapiens
tgacaacagaggcttacgaccccttatttacccca

SEQ ID NO: 66372 - DNA, 30 bp, Homo sapiens
gggggtgtagctcagtggtagagcgcgtgc

SEQ ID NO: 66373 - DNA, 38 bp, Homo sapiens
ttcagttgatgcagagtggggttttgcagtccttacca

SEQ ID NO: 66374 - DNA, 34 bp, Homo sapiens
acgcgggagaccggggttcgattccccgacgggg

SEQ ID NO: 66375 - DNA, 24 bp, Homo sapiens
gttgtagtccgtgcgagaatacca

SEQ ID NO: 66376 - DNA, 36 bp, Homo sapiens
cagttgatgcagagtggggttttgcagtccttacca

SEQ ID NO: 66377 - DNA, 29 bp, Homo sapiens
gtccttgtagtataaactaatacaccagt

SEQ ID NO: 66378 - DNA, 18 bp, Homo sapiens
gaccccttatttacccca

SEQ ID NO: 66379 - DNA, 23 bp, Homo sapiens
acaacattcaaaaaagagtacca

SEQ ID NO: 66380 - DNA, 32 bp, Homo sapiens
gcgggagaccggggttcgattccccgacgggg

SEQ ID NO: 66381 - DNA, 44 bp, Homo sapiens
gactgtaaatctaaagacaggggttaggcctctttttaccacca

SEQ ID NO: 66382 - DNA, 25 bp, Homo sapiens
tccattggggtttccccgcgcaggt

SEQ ID NO: 66383 - DNA, 40 bp, Homo sapiens
gaatccagcgatccgagttcaaatctcggtggaacctcca

SEQ ID NO: 66384 - DNA, 36 bp, Homo sapiens
gagaaagctcacaagaactgctaactcatgccccca

SEQ ID NO: 66385 - DNA, 18 bp, Homo sapiens
gtccctgtccaggcgcca

SEQ ID NO: 66386 - DNA, 45 bp, Homo sapiens
gagcccggtaatcgcataaaacttaaaactttacagtcagaggtt

SEQ ID NO: 66387 - DNA, 20 bp, Homo sapiens
aacacctctttacagtgacc

SEQ ID NO: 66388 - DNA, 28 bp, Homo sapiens
cggatagctcagtcggtagagcatcaga

SEQ ID NO: 66389 - DNA, 23 bp, Homo sapiens
ctcacatcaccccataaacacca

SEQ ID NO: 66390 - DNA, 19 bp, Homo sapiens
atccccagcacctccacca

SEQ ID NO: 66391 - DNA, 24 bp, Homo sapiens
gtcgtggttgtagtccgtgcgaga

SEQ ID NO: 66392 - DNA, 22 bp, Homo sapiens
tcgactcccggtgtgggaacca

SEQ ID NO: 66393 - DNA, 17 bp, Homo sapiens
acgcgggagaccggggt

SEQ ID NO: 66394 - DNA, 33 bp, Homo sapiens
gtttccgtagtgtagtggtcatcacgttcgcct

SEQ ID NO: 66395 - DNA, 31 bp, Homo sapiens
gatgcagagtggggttttgcagtccttacca

SEQ ID NO: 66396 - DNA, 28 bp, Homo sapiens
accggagatgaaaacctttttccaagga

SEQ ID NO: 66397 - DNA, 30 bp, Homo sapiens
ccggctagctcagtcggtagagcatgagac

SEQ ID NO: 66398 - DNA, 18 bp, Homo sapiens
tcccacccagggacgcca

SEQ ID NO: 66399 - DNA, 24 bp, Homo sapiens
agttgcaatacttaatttctgcca

SEQ ID NO: 66400 - DNA, 22 bp, Homo sapiens
tcgaatcccagcggggcctcca

SEQ ID NO: 66401 - DNA, 18 bp, Homo sapiens
catcaccccataaacacc

SEQ ID NO: 66402 - DNA, 19 bp, Homo sapiens
cgaccccttatttacccca

SEQ ID NO: 66403 - DNA, 44 bp, Homo sapiens
ctgtcacgcgggagaccggggttcgattccccgacggggagcca

SEQ ID NO: 66404 - DNA, 16 bp, Homo sapiens
tccgggtgccccctcc

SEQ ID NO: 66405 - DNA, 45 bp, Homo sapiens
cctgtcacgcgggagaccggggttcgattccccgacggggagcca

SEQ ID NO: 66406 - DNA, 30 bp, Homo sapiens
cggctagctcagtcggtagagcatgagact

SEQ ID NO: 66407 - DNA, 23 bp, Homo sapiens
acttaacttgaccgctctgacca

SEQ ID NO: 66408 - DNA, 38 bp, Homo sapiens
ctcatgcccccatgtctaacaacatggctttctcacca

SEQ ID NO: 66409 - DNA, 35 bp, Homo sapiens
gcatgggtggttcagtggtagaattctcgcctgcc

SEQ ID NO: 66410 - DNA, 43 bp, Homo sapiens
cttacacttaggagatttcaacttaacttgaccgctctgacca

SEQ ID NO: 66411 - DNA, 31 bp, Homo sapiens
agatttcaacttaacttgaccgctctgacca

SEQ ID NO: 66412 - DNA, 41 bp, Homo sapiens
cacgcagaaggtcctgggttcgagccccagtggaaccacca

SEQ ID NO: 66413 - DNA, 31 bp, Homo sapiens
gccgctggtgtagtggtatcatgcaagattc

SEQ ID NO: 66414 - DNA, 16 bp, Homo sapiens
ccgtgcgagaatacca

SEQ ID NO: 66415 - DNA, 37 bp, Homo sapiens
tctgacaacagaggcttacgaccccttatttacccca

SEQ ID NO: 66416 - DNA, 20 bp, Homo sapiens
gcaatacttaatttctgcca

SEQ ID NO: 66417 - DNA, 33 bp, Homo sapiens
gacccagtggcctaatggataaggcatcagcct

SEQ ID NO: 66418 - DNA, 42 bp, Homo sapiens
ttacacttaggagatttcaacttaacttgaccgctctgacca

SEQ ID NO: 66419 - DNA, 29 bp, Homo sapiens
gcgccgctggtgtagtggtatcatgcaag

SEQ ID NO: 66420 - DNA, 22 bp, Homo sapiens
gagaaagctcacaagaactgct

SEQ ID NO: 66421 - DNA, 17 bp, Homo sapiens
tccgtgcgagaatacca

SEQ ID NO: 66422 - DNA, 25 bp, Homo sapiens
ggggttaggcctctttttaccacca

SEQ ID NO: 66423 - DNA, 33 bp, Homo sapiens
tcccacatggtctagcggttaggattcctggtt

SEQ ID NO: 66424 - DNA, 22 bp, Homo sapiens
tcgaatcccacttctgacacca

SEQ ID NO: 66425 - DNA, 18 bp, Homo sapiens
ttccggctcgaaggacca

SEQ ID NO: 66426 - DNA, 30 bp, Homo sapiens
ccggctagctcagtcggtagagcatgggac

SEQ ID NO: 66427 - DNA, 45 bp, Homo sapiens
ggactgtaaatctaaagacaggggttaggcctctttttaccacca

SEQ ID NO: 66428 - DNA, 28 bp, Homo sapiens
acgggctcacatcaccccataaacacca

SEQ ID NO: 66429 - DNA, 37 bp, Homo sapiens
cttaggagatttcaacttaacttgaccgctctgacca

SEQ ID NO: 66430 - DNA, 20 bp, Homo sapiens
acgaccccttatttacccca

SEQ ID NO: 66431 - DNA, 20 bp, Homo sapiens
acattcaaaaaagagtacca

SEQ ID NO: 66432 - DNA, 35 bp, Homo sapiens
gcccggctagctcagtcggtagagcatgggactct

SEQ ID NO: 66433 - DNA, 26 bp, Homo sapiens
aggcttacgaccccttatttacccca

SEQ ID NO: 66434 - DNA, 18 bp, Homo sapiens
tgcccgcattctccacca

SEQ ID NO: 66435 - DNA, 30 bp, Homo sapiens
gagcccggtaatcgcataaaacttaaaact

SEQ ID NO: 66436 - DNA, 35 bp, Homo sapiens
agattaagagaaccaacacctctttacagtgacca

SEQ ID NO: 66437 - DNA, 19 bp, Homo sapiens
gagaaagctcacaagaact

SEQ ID NO: 66438 - DNA, 18 bp, Homo sapiens
ggcctctttttaccacca

SEQ ID NO: 66439 - DNA, 33 bp, Homo sapiens
gcccggctagctcagtcggtagagcatgagacc

SEQ ID NO: 66440 - DNA, 21 bp, Homo sapiens
tgtcacgcgggagaccggggt

SEQ ID NO: 66441 - DNA, 38 bp, Homo sapiens
actcatgcccccatgtctaacaacatggctttctcacc

SEQ ID NO: 66442 - DNA, 33 bp, Homo sapiens
gattgtgaatctgacaacagaggcttacgaccc

SEQ ID NO: 66443 - DNA, 46 bp, Homo sapiens
gcgccgctggtgtagtggtatcatgcaagattcccattcttgcgac

SEQ ID NO: 66444 - DNA, 22 bp, Homo sapiens
tcgatccccgacacctccacca

SEQ ID NO: 66445 - DNA, 39 bp, Homo sapiens
gagcccggtaatcgcataaaacttaaaactttacagtca

SEQ ID NO: 66446 - DNA, 42 bp, Homo sapiens
ctaactcatgcccccatgtctaacaacatggctttctcacca

SEQ ID NO: 66447 - DNA, 17 bp, Homo sapiens
tcccggcggagtcgcca

SEQ ID NO: 66448 - DNA, 24 bp, Homo sapiens
gttcgattccccgacggggagcca

SEQ ID NO: 66449 - DNA, 18 bp, Homo sapiens
accctgctcgctgcgcca

SEQ ID NO: 66450 - DNA, 18 bp, Homo sapiens
atccggctcggaggacca

SEQ ID NO: 66451 - DNA, 27 bp, Homo sapiens
cgggctcacatcaccccataaacacca

SEQ ID NO: 66452 - DNA, 24 bp, Homo sapiens
gggttaggcctctttttaccacca

SEQ ID NO: 66453 - DNA, 24 bp, Homo sapiens
aacttaacttgaccgctctgacca

SEQ ID NO: 66454 - DNA, 18 bp, Homo sapiens
atcccaccctcgtcgcca

SEQ ID NO: 66455 - DNA, 41 bp, Homo sapiens
tcacgcgggagaccggggttcaattccccgacggggagcca

SEQ ID NO: 66456 - DNA, 31 bp, Homo sapiens
gcatgggtggttcagtggtagaattctcgcc

SEQ ID NO: 66457 - DNA, 19 bp, Homo sapiens
aggcctctttttaccacca

SEQ ID NO: 66458 - DNA, 38 bp, Homo sapiens
cgcgggagaccggggttcaattccccgacggggagcca

SEQ ID NO: 66459 - DNA, 29 bp, Homo sapiens
gcccggctagctcagtcggtagagcatgg

SEQ ID NO: 66460 - DNA, 31 bp, Homo sapiens
gcctggatagctcagtcggtagagcatcaga

SEQ ID NO: 66461 - DNA, 31 bp, Homo sapiens
gtttccgtagtgtagtggtcatcacgttcgc

SEQ ID NO: 66462 - DNA, 22 bp, Homo sapiens
tcaagtccctgttcgggcgcca

SEQ ID NO: 66463 - DNA, 31 bp, Homo sapiens
tagacgggctcacatcaccccataaacacca

SEQ ID NO: 66464 - DNA, 17 bp, Homo sapiens
agcccggtaatcgcata

SEQ ID NO: 66465 - DNA, 18 bp, Homo sapiens
tcctcgctggggcctcca

SEQ ID NO: 66466 - DNA, 34 bp, Homo sapiens
agcagagtggcgcagcggaagcgtgctgggccca

SEQ ID NO: 66467 - DNA, 23 bp, Homo sapiens
ctgtcacgcgggagaccggggtt

SEQ ID NO: 66468 - DNA, 33 bp, Homo sapiens
gcctggatagctcagtcggtagagcatcagact

SEQ ID NO: 66469 - DNA, 40 bp, Homo sapiens
gagaaagctcacaagaactgctaactcatgcccccatgtc

SEQ ID NO: 66470 - DNA, 41 bp, Homo sapiens
cgcctgtcacgcgggagaccggggttcgattccccgacggg

SEQ ID NO: 66471 - DNA, 16 bp, Homo sapiens
accgggcggaaacacc

SEQ ID NO: 66472 - DNA, 18 bp, Homo sapiens
atcccaccttcgtcgcca

SEQ ID NO: 66473 - DNA, 32 bp, Homo sapiens
accggagatgaaaacctttttccaaggacacc

SEQ ID NO: 66474 - DNA, 32 bp, Homo sapiens
gtgagcatagctgccttccaagcagttgaccc

SEQ ID NO: 66475 - DNA, 25 bp, Homo sapiens
aaccaacacctctttacagtgacca

SEQ ID NO: 66476 - DNA, 23 bp, Homo sapiens
gttgcaatacttaatttctgcca

SEQ ID NO: 66477 - DNA, 31 bp, Homo sapiens
aagtgtttgtgggtttaagtcccattggtct

SEQ ID NO: 66478 - DNA, 31 bp, Homo sapiens
gaaaatgtttagacgggctcacatcacccca

SEQ ID NO: 66479 - DNA, 25 bp, Homo sapiens
ggttcaatccccggcacctccacca

SEQ ID NO: 66480 - DNA, 35 bp, Homo sapiens
cgcgggagaccggggttcgattccccgacggggag

SEQ ID NO: 66481 - DNA, 21 bp, Homo sapiens
aacaacatggctttctcacca

SEQ ID NO: 66482 - DNA, 22 bp, Homo sapiens
tcaaatccgggtgccccctcca

SEQ ID NO: 66483 - DNA, 18 bp, Homo sapiens
gtcccggcggagtcgcca

SEQ ID NO: 66484 - DNA, 23 bp, Homo sapiens
agaccggggttcgattccccgac

SEQ ID NO: 66485 - DNA, 25 bp, Homo sapiens
ggcttacgaccccttatttacccca

SEQ ID NO: 66486 - DNA, 42 bp, Homo sapiens
gtgaatctgacaacagaggcttacgaccccttatttacccca

SEQ ID NO: 66487 - DNA, 37 bp, Homo sapiens
aatctaaagacaggggttaggcctctttttaccacca

SEQ ID NO: 66488 - DNA, 18 bp, Homo sapiens
ctcccggtatgggaacca

SEQ ID NO: 66489 - DNA, 22 bp, Homo sapiens
caacacctctttacagtgacca

SEQ ID NO: 66490 - DNA, 18 bp, Homo sapiens
aggggtatgattctcggt

SEQ ID NO: 66491 - DNA, 32 bp, Homo sapiens
gcctggatagctcagtcggtagagcatcagac

SEQ ID NO: 66492 - DNA, 29 bp, Homo sapiens
aaccggagatgaaaacctttttccaagga

SEQ ID NO: 66493 - DNA, 37 bp, Homo sapiens
accagctttggggggttcgattccttccttttttgcc

SEQ ID NO: 66494 - DNA, 16 bp, Homo sapiens
accggagatgaaaacc

SEQ ID NO: 66495 - DNA, 18 bp, Homo sapiens
gtcacgtcggggtcacca

SEQ ID NO: 66496 - DNA, 23 bp, Homo sapiens
gtcgtggttgtagtccgtgcgag

SEQ ID NO: 66497 - DNA, 19 bp, Homo sapiens
gccccagtggcctaatgga

SEQ ID NO: 66498 - DNA, 16 bp, Homo sapiens
ccgagcggaaacacca

SEQ ID NO: 66499 - DNA, 24 bp, Homo sapiens
gcttacgaccccttatttacccca

SEQ ID NO: 66500 - DNA, 18 bp, Homo sapiens
acgcgaaaggtccccggt

SEQ ID NO: 66501 - DNA, 21 bp, Homo sapiens
cgatccccagtacctccacca

SEQ ID NO: 66502 - DNA, 31 bp, Homo sapiens
cggctagctcagtcggtagagcatgggactc

SEQ ID NO: 66503 - DNA, 40 bp, Homo sapiens
gcccggctagctcagtcggtagagcatgagactcttaatc

SEQ ID NO: 66504 - DNA, 38 bp, Homo sapiens
tgtaaaccggagatgaaaacctttttccaaggacacca

SEQ ID NO: 66505 - DNA, 17 bp, Homo sapiens
atcatatttaccaacca

SEQ ID NO: 66506 - DNA, 39 bp, Homo sapiens
aatctgacaacagaggcttacgaccccttatttacccca

SEQ ID NO: 66507 - DNA, 22 bp, Homo sapiens
tcgatccccgtacgggccacca

SEQ ID NO: 66508 - DNA, 34 bp, Homo sapiens
tcccacatggtctagcggttaggattcctggttt

SEQ ID NO: 66509 - DNA, 35 bp, Homo sapiens
tcctcgttagtatagtggtgagtatccccgcctgt

SEQ ID NO: 66510 - DNA, 29 bp, Homo sapiens
ccgaaaatgttggttatacccttcccgta

SEQ ID NO: 66511 - DNA, 38 bp, Homo sapiens
gcacgaggccccgggttcaatccccggcacctccacca

SEQ ID NO: 66512 - DNA, 31 bp, Homo sapiens
ggttccatagtgtagtggttatcacatctgc

SEQ ID NO: 66513 - DNA, 21 bp, Homo sapiens
gtagtccgtgcgagaatacca

SEQ ID NO: 66514 - DNA, 30 bp, Homo sapiens
tcctcgttagtatagtggtgagtatccccg

SEQ ID NO: 66515 - DNA, 40 bp, Homo sapiens
agagtaaataataggagcttaaacccccttatttctacca

SEQ ID NO: 66516 - DNA, 32 bp, Homo sapiens
gtttgtgggtttaagtcccattggtctagcca

SEQ ID NO: 66517 - DNA, 32 bp, Homo sapiens
ccctggtggtctagtggttaggattcggcgct

SEQ ID NO: 66518 - DNA, 46 bp, Homo sapiens
gattgtgaatctgacaacagaggcttacgaccccttatttacccca

SEQ ID NO: 66519 - DNA, 30 bp, Homo sapiens
gcgggagaccggggttcgattccccgacgg

SEQ ID NO: 66520 - DNA, 37 bp, Homo sapiens
caaagcaatacactgaaaatgtttagacgggctcaca

SEQ ID NO: 66521 - DNA, 27 bp, Homo sapiens
atgtctaacaacatggctttctcacca

SEQ ID NO: 66522 - DNA, 18 bp, Homo sapiens
ctcccagtggggcctcca

SEQ ID NO: 66523 - DNA, 18 bp, Homo sapiens
acgcgggagaccggggtt

SEQ ID NO: 66524 - DNA, 31 bp, Homo sapiens
cgggagaccggggttcgattccccgacgggg

SEQ ID NO: 66525 - DNA, 46 bp, Homo sapiens
actgctaactcatgcccccatgtctaacaacatggctttctcacca

SEQ ID NO: 66526 - DNA, 26 bp, Homo sapiens
gagaaagctcacaagaactgctaact

SEQ ID NO: 66527 - DNA, 34 bp, Homo sapiens
gtttccgtagtgtagcggttatcacattcgcctc

SEQ ID NO: 66528 - DNA, 45 bp, Homo sapiens
caacttacacttaggagatttcaacttaacttgaccgctctgacc

SEQ ID NO: 66529 - DNA, 36 bp, Homo sapiens
ggtttttcatatcattggtcgtggttgtagtccgtg

SEQ ID NO: 66530 - DNA, 31 bp, Homo sapiens
cccccatgtctaacaacatggctttctcacc

SEQ ID NO: 66531 - DNA, 32 bp, Homo sapiens
cgcgggagaccggggttcaattccccgacggg

SEQ ID NO: 66532 - DNA, 36 bp, Homo sapiens
tcatgcccccatgtctaacaacatggctttctcacc

SEQ ID NO: 66533 - DNA, 29 bp, Homo sapiens
ccgtgatcgtatagtggttagtactctgc

SEQ ID NO: 66534 - DNA, 42 bp, Homo sapiens
acacgcagaaggtcctgggttcaagccccagtggaaccacca

SEQ ID NO: 66535 - DNA, 41 bp, Homo sapiens
ggtttttcatatcattggtcgtggttgtagtccgtgcgaga

SEQ ID NO: 66536 - DNA, 36 bp, Homo sapiens
cagaccaagagccttcaaagccctcagtaagttgca

SEQ ID NO: 66537 - DNA, 34 bp, Homo sapiens
gcttctgtagtgtagtggttatcacgttcgcctc

SEQ ID NO: 66538 - DNA, 19 bp, Homo sapiens
ccttccaagcagttgaccc

SEQ ID NO: 66539 - DNA, 43 bp, Homo sapiens
acttacacttaggagatttcaacttaacttgaccgctctgacc

SEQ ID NO: 66540 - DNA, 27 bp, Homo sapiens
ggctagctcagtcggtagagcatggga

SEQ ID NO: 66541 - DNA, 30 bp, Homo sapiens
agtgtttgtgggtttaagtcccattggtct

SEQ ID NO: 66542 - DNA, 41 bp, Homo sapiens
gagaaagctcacaagaactgctaactcatgcccccatgtct

SEQ ID NO: 66543 - DNA, 40 bp, Homo sapiens
gaatccagcgatccgagttcaagtctcggtggaacctcca

SEQ ID NO: 66544 - DNA, 24 bp, Homo sapiens
ccttccaagcagttgacccgggtt

SEQ ID NO: 66545 - DNA, 34 bp, Homo sapiens
agctttggggggttcgattccttccttttttgcc

SEQ ID NO: 66546 - DNA, 16 bp, Homo sapiens
atcccaccgctgccac

SEQ ID NO: 66547 - DNA, 18 bp, Homo sapiens
atcccagcgaggcctcca

SEQ ID NO: 66548 - DNA, 26 bp, Homo sapiens
tggttgtagtccgtgcgagaatacca

SEQ ID NO: 66549 - DNA, 37 bp, Homo sapiens
ctcatgcccccatgtctaacaacatggctttctcacc

SEQ ID NO: 66550 - DNA, 18 bp, Homo sapiens
agtggttagtatccccgc

SEQ ID NO: 66551 - DNA, 30 bp, Homo sapiens
gtcgtggttgtagtccgtgcgagaatacca

SEQ ID NO: 66552 - DNA, 27 bp, Homo sapiens
ggagaccggggttcgattccccgacgg

SEQ ID NO: 66553 - DNA, 35 bp, Homo sapiens
gcttctgtagtgtagtggttatcacgttcgcctca

SEQ ID NO: 66554 - DNA, 22 bp, Homo sapiens
tcgagcccacccagggacgcca

SEQ ID NO: 66555 - DNA, 30 bp, Homo sapiens
accggagatgaaaacctttttccaaggaca

SEQ ID NO: 66556 - DNA, 25 bp, Homo sapiens
ggttcgatccccggcatctccacca

SEQ ID NO: 66557 - DNA, 25 bp, Homo sapiens
ggttgtagtccgtgcgagaatacca

SEQ ID NO: 66558 - DNA, 43 bp, Homo sapiens
actgtaaatctaaagacaggggttaggcctctttttaccacca

SEQ ID NO: 66559 - DNA, 35 bp, Homo sapiens
gacccagtggcctaatggataaggcatcagcctcc

SEQ ID NO: 66560 - DNA, 30 bp, Homo sapiens
caaagcaatacactgaaaatgtttagacgg

SEQ ID NO: 66561 - DNA, 28 bp, Homo sapiens
gcccggctagctcagtcggtagagcatg

SEQ ID NO: 66562 - DNA, 45 bp, Homo sapiens
gagaaagctcacaagaactgctaactcatgcccccatgtctaaca

SEQ ID NO: 66563 - DNA, 30 bp, Homo sapiens
aagtgtttgtgggtttaagtcccattggtc

SEQ ID NO: 66564 - DNA, 37 bp, Homo sapiens
ccccgaaaatgttggttatacccttcccgtactacca

SEQ ID NO: 66565 - DNA, 38 bp, Homo sapiens
acttaggagatttcaacttaacttgaccgctctgacca

SEQ ID NO: 66566 - DNA, 21 bp, Homo sapiens
cgattccccgacggggagcca

SEQ ID NO: 66567 - DNA, 17 bp, Homo sapiens
gcccggctagctcagtc

SEQ ID NO: 66568 - DNA, 31 bp, Homo sapiens
tcccacatggtctagcggttaggattcctgg

SEQ ID NO: 66569 - DNA, 19 bp, Homo sapiens
gcccggatagctcagtcgg

SEQ ID NO: 66570 - DNA, 33 bp, Homo sapiens
ggagatttcaacttaacttgaccgctctgacca

SEQ ID NO: 66571 - DNA, 21 bp, Homo sapiens
cgattcccggccaacgcacca

SEQ ID NO: 66572 - DNA, 20 bp, Homo sapiens
gtcacgcgggagaccggggt

SEQ ID NO: 66573 - DNA, 35 bp, Homo sapiens
acgcgggagaccggggttcgattccccgacgggga

SEQ ID NO: 66574 - DNA, 16 bp, Homo sapiens
ccccttatttacccca

SEQ ID NO: 66575 - DNA, 38 bp, Homo sapiens
accagctttggggggttcgattccttccttttttgcca

SEQ ID NO: 66576 - DNA, 30 bp, Homo sapiens
gatttcaacttaacttgaccgctctgacca

SEQ ID NO: 66577 - DNA, 24 bp, Homo sapiens
ggttatacccttcccgtactacca

SEQ ID NO: 66578 - DNA, 40 bp, Homo sapiens
tgaatctgacaacagaggcttacgaccccttatttacccc

SEQ ID NO: 66579 - DNA, 16 bp, Homo sapiens
gggtatgattctcggt

SEQ ID NO: 66580 - DNA, 26 bp, Homo sapiens
tcaacttaacttgaccgctctgacca

SEQ ID NO: 66581 - DNA, 45 bp, Homo sapiens
attgtgaatctgacaacagaggcttacgaccccttatttacccca

SEQ ID NO: 66582 - DNA, 22 bp, Homo sapiens
tcgatgcccgcatcctccacca

SEQ ID NO: 66583 - DNA, 22 bp, Homo sapiens
tcgactcccagcggggcctcca

SEQ ID NO: 66584 - DNA, 19 bp, Homo sapiens
caatacttaatttctgcca

SEQ ID NO: 66585 - DNA, 29 bp, Homo sapiens
ggagatgaaaacctttttccaaggacacc

SEQ ID NO: 66586 - DNA, 17 bp, Homo sapiens
tcccggccaacgcacca

SEQ ID NO: 66587 - DNA, 18 bp, Homo sapiens
acttgaccgctctgacca

SEQ ID NO: 66588 - DNA, 31 bp, Homo sapiens
gcctgggtagctcagtcggtagagcatcaga

SEQ ID NO: 66589 - DNA, 34 bp, Homo sapiens
gattaagagaaccaacacctctttacagtgacca

SEQ ID NO: 66590 - DNA, 17 bp, Homo sapiens
agtggttagtatccccg

SEQ ID NO: 66591 - DNA, 27 bp, Homo sapiens
ggagcttaaacccccttatttctacca

SEQ ID NO: 66592 - DNA, 35 bp, Homo sapiens
agctttggggggttcgattccttccttttttgcca

SEQ ID NO: 66593 - DNA, 34 bp, Homo sapiens
aggagatttcaacttaacttgaccgctctgacca

SEQ ID NO: 66594 - DNA, 28 bp, Homo sapiens
ggattcggcgctctcaccgccgcggccc

SEQ ID NO: 66595 - DNA, 35 bp, Homo sapiens
gcgccgctggtgtagtggtatcatgcaagattccc

SEQ ID NO: 66596 - DNA, 17 bp, Homo sapiens
tctcggtggaacctcca

SEQ ID NO: 66597 - DNA, 22 bp, Homo sapiens
caacattcaaaaaagagtacca

SEQ ID NO: 66598 - DNA, 44 bp, Homo sapiens
tgctaactcatgcccccatgtctaacaacatggctttctcacca

SEQ ID NO: 66599 - DNA, 19 bp, Homo sapiens
acacctctttacagtgacc

SEQ ID NO: 66600 - DNA, 28 bp, Homo sapiens
gagaaccaacacctctttacagtgacca

SEQ ID NO: 66601 - DNA, 25 bp, Homo sapiens
gagcccggtaatcgcataaaactta

SEQ ID NO: 66602 - DNA, 40 bp, Homo sapiens
gcctgtcacgcgggagaccggggttcgattccccgacggg

SEQ ID NO: 66603 - DNA, 26 bp, Homo sapiens
gcccggatagctcagtcggtagagca

SEQ ID NO: 66604 - DNA, 44 bp, Homo sapiens
gagcccggtaatcgcataaaacttaaaactttacagtcagaggt

SEQ ID NO: 66605 - DNA, 32 bp, Homo sapiens
gtttccgtagtgtagtggtcatcacgttcgcc

SEQ ID NO: 66606 - DNA, 16 bp, Homo sapiens
ggtagcgtggccgagc

SEQ ID NO: 66607 - DNA, 35 bp, Homo sapiens
gaaggtcctgggttcgagccccagtggaaccacca

SEQ ID NO: 66608 - DNA, 28 bp, Homo sapiens
cgtggttgtagtccgtgcgagaatacca

SEQ ID NO: 66609 - DNA, 43 bp, Homo sapiens
tgtcacgcgggagaccggggttcaattccccgacggggagcca

SEQ ID NO: 66610 - DNA, 22 bp, Homo sapiens
tcgagtcccatctggggtgcca

SEQ ID NO: 66611 - DNA, 41 bp, Homo sapiens
ctaactcatgcccccatgtctaacaacatggctttctcacc

SEQ ID NO: 66612 - DNA, 24 bp, Homo sapiens
caacttaacttgaccgctctgacc

SEQ ID NO: 66613 - DNA, 20 bp, Homo sapiens
acacgcgaaaggtccccggt

SEQ ID NO: 66614 - DNA, 35 bp, Homo sapiens
agccctcagtaagttgcaatacttaatttctgcca

SEQ ID NO: 66615 - DNA, 22 bp, Homo sapiens
tcgagtcccttcgtggtcgcca

SEQ ID NO: 66616 - DNA, 19 bp, Homo sapiens
aacccccttatttctacca

SEQ ID NO: 66617 - DNA, 33 bp, Homo sapiens
tcctcgttagtatagtggtgagtatccccgcct

SEQ ID NO: 66618 - DNA, 36 bp, Homo sapiens
ccccgaaaatgttggttatacccttcccgtactacc

SEQ ID NO: 66619 - DNA, 21 bp, Homo sapiens
cgaatcccagcggtgcctcca

SEQ ID NO: 66620 - DNA, 27 bp, Homo sapiens
cggctagctcagtcggtagagcatggg

SEQ ID NO: 66621 - DNA, 33 bp, Homo sapiens
gacaacagaggcttacgaccccttatttacccc

SEQ ID NO: 66622 - DNA, 35 bp, Homo sapiens
actaagtgtttgtgggtttaagtcccattggtcta

SEQ ID NO: 66623 - DNA, 38 bp, Homo sapiens
tggtgagtatccccgcctgtcacgcgggagaccggggt

SEQ ID NO: 66624 - DNA, 26 bp, Homo sapiens
cattggtcgtggttgtagtccgtgcg

SEQ ID NO: 66625 - DNA, 27 bp, Homo sapiens
gatgaaaacctttttccaaggacacca

SEQ ID NO: 66626 - DNA, 29 bp, Homo sapiens
ggctagctcagtcggtagagcatgggact

SEQ ID NO: 66627 - DNA, 30 bp, Homo sapiens
ccgctggtgtagtggtatcatgcaagattc

SEQ ID NO: 66628 - DNA, 25 bp, Homo sapiens
gagcttaaacccccttatttctacc

SEQ ID NO: 66629 - DNA, 23 bp, Homo sapiens
gttatacccttcccgtactacca

SEQ ID NO: 66630 - DNA, 22 bp, Homo sapiens
agaccggggttcgattccccga

SEQ ID NO: 66631 - DNA, 35 bp, Homo sapiens
ctcagggatgggttcgattctcatagtcctagcca

SEQ ID NO: 66632 - DNA, 31 bp, Homo sapiens
gaccggggttcgattccccgacggggagcca

SEQ ID NO: 66633 - DNA, 22 bp, Homo sapiens
tcacacgcgaaaggtccccggt

SEQ ID NO: 66634 - DNA, 35 bp, Homo sapiens
cagctttggggggttcgattccttccttttttgcc

SEQ ID NO: 66635 - DNA, 37 bp, Homo sapiens
ccagctttggggggttcgattccttccttttttgcca

SEQ ID NO: 66636 - DNA, 30 bp, Homo sapiens
gcatgggtggttcagtggtagaattctcgc

SEQ ID NO: 66637 - DNA, 18 bp, Homo sapiens
atccccggcacctccacc

SEQ ID NO: 66638 - DNA, 42 bp, Homo sapiens
atagagtaaataataggagcttaaacccccttatttctacca

SEQ ID NO: 66639 - DNA, 16 bp, Homo sapiens
atccgggtgccccctc

SEQ ID NO: 66640 - DNA, 29 bp, Homo sapiens
ccggatagctcagtcggtagagcatcaga

SEQ ID NO: 66641 - DNA, 29 bp, Homo sapiens
gtgtttgtgggtttaagtcccattggtct

SEQ ID NO: 66642 - DNA, 16 bp, Homo sapiens
tccccggcacctccac

SEQ ID NO: 66643 - DNA, 28 bp, Homo sapiens
cattggtcgtggttgtagtccgtgcgag

SEQ ID NO: 66644 - DNA, 30 bp, Homo sapiens
cccatgtctaacaacatggctttctcacca

SEQ ID NO: 66645 - DNA, 29 bp, Homo sapiens
agtgtttgtgggtttaagtcccattggtc

SEQ ID NO: 66646 - DNA, 35 bp, Homo sapiens
gcccggctagctcagtcggtagagcatgagactct

SEQ ID NO: 66647 - DNA, 42 bp, Homo sapiens
ggtttttcatatcattggtcgtggttgtagtccgtgcgagaa

SEQ ID NO: 66648 - DNA, 28 bp, Homo sapiens
agatgaaaacctttttccaaggacacca

SEQ ID NO: 66649 - DNA, 40 bp, Homo sapiens
acgcagaaggtcctgggttcaagccccagtggaaccacca

SEQ ID NO: 66650 - DNA, 37 bp, Homo sapiens
tcagttgatgcagagtggggttttgcagtccttacca

SEQ ID NO: 66651 - DNA, 24 bp, Homo sapiens
cctgtcacgcgggagaccggggtt

SEQ ID NO: 66652 - DNA, 40 bp, Homo sapiens
gaatccagcgatccgagttcaaatctcggtgggacctcca

SEQ ID NO: 66653 - DNA, 45 bp, Homo sapiens
ctgctaactcatgcccccatgtctaacaacatggctttctcacca

SEQ ID NO: 66654 - DNA, 39 bp, Homo sapiens
tgcatgaggtcccgggttcgatccccagcatctccacca

SEQ ID NO: 66655 - DNA, 34 bp, Homo sapiens
gccctcagtaagttgcaatacttaatttctgcca

SEQ ID NO: 66656 - DNA, 41 bp, Homo sapiens
taactcatgcccccatgtctaacaacatggctttctcacca

SEQ ID NO: 66657 - DNA, 21 bp, Homo sapiens
cgattcccggcccatgcacca

SEQ ID NO: 66658 - DNA, 36 bp, Homo sapiens
gtagaattctcgcctgccacgcgggaggcccgggtt

SEQ ID NO: 66659 - DNA, 38 bp, Homo sapiens
attctcagggatgggttcgattctcatagtcctagcca

SEQ ID NO: 66660 - DNA, 29 bp, Homo sapiens
ggagaccggggttcgattccccgacgggg

SEQ ID NO: 66661 - DNA, 39 bp, Homo sapiens
aactcatgcccccatgtctaacaacatggctttctcacc

SEQ ID NO: 66662 - DNA, 28 bp, Homo sapiens
gcagagtggggttttgcagtccttacca

SEQ ID NO: 66663 - DNA, 17 bp, Homo sapiens
catcaccccataaacac

SEQ ID NO: 66664 - DNA, 44 bp, Homo sapiens
ggcccataccccgaaaatgttggttatacccttcccgtactacc

SEQ ID NO: 66665 - DNA, 17 bp, Homo sapiens
aaccggagatgaaaacc

SEQ ID NO: 66666 - DNA, 23 bp, Homo sapiens
gaaaatgtttagacgggctcaca

SEQ ID NO: 66667 - DNA, 34 bp, Homo sapiens
gttgatgcagagtggggttttgcagtccttacca

SEQ ID NO: 66668 - DNA, 38 bp, Homo sapiens
atctgacaacagaggcttacgaccccttatttacccca

SEQ ID NO: 66669 - DNA, 21 bp, Homo sapiens
caactccaaataaaagtacca

SEQ ID NO: 66670 - DNA, 18 bp, Homo sapiens
acccttcccgtactacca

SEQ ID NO: 66671 - DNA, 17 bp, Homo sapiens
tccccgacggggagcca

SEQ ID NO: 66672 - DNA, 39 bp, Homo sapiens
acgcgggaggcccgggttcgattcccggccaatgcacca

SEQ ID NO: 66673 - DNA, 29 bp, Homo sapiens
gacaggggttaggcctctttttaccacca

SEQ ID NO: 66674 - DNA, 33 bp, Homo sapiens
caaagcaatacactgaaaatgtttagacgggct

SEQ ID NO: 66675 - DNA, 31 bp, Homo sapiens
tccctggtggtctagtggctaggattcggcg

SEQ ID NO: 66676 - DNA, 36 bp, Homo sapiens
cagctttggggggttcgattccttccttttttgcca

SEQ ID NO: 66677 - DNA, 18 bp, Homo sapiens
ttccccgacggggagcca

SEQ ID NO: 66678 - DNA, 36 bp, Homo sapiens
aagattaagagaaccaacacctctttacagtgacca

SEQ ID NO: 66679 - DNA, 46 bp, Homo sapiens
tggactgtaaatctaaagacaggggttaggcctctttttaccacca

SEQ ID NO: 66680 - DNA, 17 bp, Homo sapiens
cccccttatttctacca

SEQ ID NO: 66681 - DNA, 17 bp, Homo sapiens
tcctgccgcggtcgcca

SEQ ID NO: 66682 - DNA, 33 bp, Homo sapiens
acaacagaggcttacgaccccttatttacccca

SEQ ID NO: 66683 - DNA, 17 bp, Homo sapiens
acgcgggaggcccgggt

SEQ ID NO: 66684 - DNA, 29 bp, Homo sapiens
gcatgggtggttcagtggtagaattctcg

SEQ ID NO: 66685 - DNA, 25 bp, Homo sapiens
agcttaaacccccttatttctacca

SEQ ID NO: 66686 - DNA, 29 bp, Homo sapiens
cattggtcgtggttgtagtccgtgcgaga

SEQ ID NO: 66687 - DNA, 28 bp, Homo sapiens
ggctagctcagtcggtagagcatgggac

SEQ ID NO: 66688 - DNA, 17 bp, Homo sapiens
tccaggtgccccttcca

SEQ ID NO: 66689 - DNA, 17 bp, Homo sapiens
ccctgctcgctgcgcca

SEQ ID NO: 66690 - DNA, 31 bp, Homo sapiens
ccggctagctcagtcggtagagcatgggact

SEQ ID NO: 66691 - DNA, 30 bp, Homo sapiens
cggagatgaaaacctttttccaaggacacc

SEQ ID NO: 66692 - DNA, 16 bp, Homo sapiens
accgggcagaagcacc

SEQ ID NO: 66693 - DNA, 33 bp, Homo sapiens
gctttggggggttcgattccttccttttttgcc

SEQ ID NO: 66694 - DNA, 33 bp, Homo sapiens
gaaaatgtttagacgggctcacatcaccccata

SEQ ID NO: 66695 - DNA, 26 bp, Homo sapiens
gaggcttacgaccccttatttacccc

SEQ ID NO: 66696 - DNA, 20 bp, Homo sapiens
aatccccggcacctccacca

SEQ ID NO: 66697 - DNA, 34 bp, Homo sapiens
cgaagaagcagcttcaaacctgccggggcttcca

SEQ ID NO: 66698 - DNA, 20 bp, Homo sapiens
ctaagccagggattgtgggt

SEQ ID NO: 66699 - DNA, 16 bp, Homo sapiens
ggtgagtatccccgcc

SEQ ID NO: 66700 - DNA, 19 bp, Homo sapiens
gtgagtatccccgcctgtc

SEQ ID NO: 66701 - DNA, 36 bp, Homo sapiens
aaagcaatacactgaaaatgtttagacgggctcaca

SEQ ID NO: 66702 - DNA, 18 bp, Homo sapiens
acccccttatttctacca

SEQ ID NO: 66703 - DNA, 46 bp, Homo sapiens
ctcaaagcaatacactgaaaatgtttagacgggctcacatcacccc

SEQ ID NO: 66704 - DNA, 28 bp, Homo sapiens
gtgtttgtgggtttaagtcccattggtc

SEQ ID NO: 66705 - DNA, 27 bp, Homo sapiens
gagaccggggttcgattccccgacggg

SEQ ID NO: 66706 - DNA, 29 bp, Homo sapiens
agcatagctgccttccaagcagttgaccc

SEQ ID NO: 66707 - DNA, 39 bp, Homo sapiens
aaagcaatacactgaaaatgtttagacgggctcacatca

SEQ ID NO: 66708 - DNA, 35 bp, Homo sapiens
caaagcaatacactgaaaatgtttagacgggctca

SEQ ID NO: 66709 - DNA, 35 bp, Homo sapiens
gcgttggtggtatagtggtaagcatagctgccttc

SEQ ID NO: 66710 - DNA, 33 bp, Homo sapiens
acgcgggagaccggggttcaattccccgacggg

SEQ ID NO: 66711 - DNA, 23 bp, Homo sapiens
ccttccaagcagttgacccgggt

SEQ ID NO: 66712 - DNA, 30 bp, Homo sapiens
gtccttgtagtataaactaatacaccagtc

SEQ ID NO: 66713 - DNA, 39 bp, Homo sapiens
tccctggtggtctagtggttaggattcggcgctctcacc

SEQ ID NO: 66714 - DNA, 32 bp, Homo sapiens
caacagaggcttacgaccccttatttacccca

SEQ ID NO: 66715 - DNA, 18 bp, Homo sapiens
aatcatatttaccaacca

SEQ ID NO: 66716 - DNA, 32 bp, Homo sapiens
gattgtgaatctgacaacagaggcttacgacc

SEQ ID NO: 66717 - DNA, 27 bp, Homo sapiens
ttcaacttaacttgaccgctctgacca

SEQ ID NO: 66718 - DNA, 30 bp, Homo sapiens
cccggctagctcagtcggtagagcatggga

SEQ ID NO: 66719 - DNA, 41 bp, Homo sapiens
gagcccggtaatcgcataaaacttaaaactttacagtcaga

SEQ ID NO: 66720 - DNA, 22 bp, Homo sapiens
tcgggtgcgagaggtcccgggt

SEQ ID NO: 66721 - DNA, 20 bp, Homo sapiens
atacccttcccgtactacca

SEQ ID NO: 66722 - DNA, 31 bp, Homo sapiens
gcttctgtagtgtagtggttatcacgttcgc

SEQ ID NO: 66723 - DNA, 30 bp, Homo sapiens
agacaggggttaggcctctttttaccacca

SEQ ID NO: 66724 - DNA, 23 bp, Homo sapiens
gctcacatcaccccataaacacc

SEQ ID NO: 66725 - DNA, 37 bp, Homo sapiens
tccctggtggtctagtggctaggattcggcgctttca

SEQ ID NO: 66726 - DNA, 18 bp, Homo sapiens
ctcccggtgtgggaacca

SEQ ID NO: 66727 - DNA, 28 bp, Homo sapiens
ggctagctcagtcggtagagcatgagac

SEQ ID NO: 66728 - DNA, 16 bp, Homo sapiens
cccatcctcgtcgcca

SEQ ID NO: 66729 - DNA, 21 bp, Homo sapiens
caaatcccggacgagccccca

SEQ ID NO: 66730 - DNA, 16 bp, Homo sapiens
ccccttatttctacca

SEQ ID NO: 66731 - DNA, 40 bp, Homo sapiens
gaatctgacaacagaggcttacgaccccttatttacccca

SEQ ID NO: 66732 - DNA, 18 bp, Homo sapiens
atctcggtggaacctcca

SEQ ID NO: 66733 - DNA, 30 bp, Homo sapiens
tcccacatggtctagcggttaggattcctg

SEQ ID NO: 66734 - DNA, 39 bp, Homo sapiens
gtggtgagtatccccgcctgtcacgcgggagaccggggt

SEQ ID NO: 66735 - DNA, 34 bp, Homo sapiens
actaagtgtttgtgggtttaagtcccattggtct

SEQ ID NO: 66736 - DNA, 39 bp, Homo sapiens
cacttaggagatttcaacttaacttgaccgctctgacca

SEQ ID NO: 66737 - DNA, 40 bp, Homo sapiens
ggtttttcatatcattggtcgtggttgtagtccgtgcgag

SEQ ID NO: 66738 - DNA, 17 bp, Homo sapiens
accgagcggaaacacca

SEQ ID NO: 66739 - DNA, 38 bp, Homo sapiens
agcccggtaatcgcataaaacttaaaactttacagtca

SEQ ID NO: 66740 - DNA, 31 bp, Homo sapiens
cggctagctcagtcggtagagcatgagactc

SEQ ID NO: 66741 - DNA, 23 bp, Homo sapiens
ggttaggcctctttttaccacca

SEQ ID NO: 66742 - DNA, 39 bp, Homo sapiens
gagaaagctcacaagaactgctaactcatgcccccatgt

SEQ ID NO: 66743 - DNA, 37 bp, Homo sapiens
cagaaggtcctgggttcgagccccagtggaaccacca

SEQ ID NO: 66744 - DNA, 38 bp, Homo sapiens
accccgaaaatgttggttatacccttcccgtactacca

SEQ ID NO: 66745 - DNA, 18 bp, Homo sapiens
gtcctgccgcggtcgcca

SEQ ID NO: 66746 - DNA, 28 bp, Homo sapiens
tcccacatggtctagcggttaggattcc

SEQ ID NO: 66747 - DNA, 35 bp, Homo sapiens
atctaaagacaggggttaggcctctttttaccacc

SEQ ID NO: 66748 - DNA, 36 bp, Homo sapiens
ccagctttggggggttcgattccttccttttttgcc

SEQ ID NO: 66749 - DNA, 35 bp, Homo sapiens
taccccgaaaatgttggttatacccttcccgtact

SEQ ID NO: 66750 - DNA, 30 bp, Homo sapiens
ggctagctcagtcggtagagcatgagactc

SEQ ID NO: 66751 - DNA, 18 bp, Homo sapiens
aaccgagcggaaacacca

SEQ ID NO: 66752 - DNA, 18 bp, Homo sapiens
accccgtacgggccacca

SEQ ID NO: 66753 - DNA, 45 bp, Homo sapiens
aacttccaattaactagttttgacaacattcaaaaaagagtacca

SEQ ID NO: 66754 - DNA, 30 bp, Homo sapiens
acagaggcttacgaccccttatttacccca

SEQ ID NO: 66755 - DNA, 31 bp, Homo sapiens
gacccagtggcctaatggataaggcatcagc

SEQ ID NO: 66756 - DNA, 37 bp, Homo sapiens
ggtttttcatatcattggtcgtggttgtagtccgtgc

SEQ ID NO: 66757 - DNA, 31 bp, Homo sapiens
aaccggagatgaaaacctttttccaaggaca

SEQ ID NO: 66758 - DNA, 35 bp, Homo sapiens
aagcaatacactgaaaatgtttagacgggctcaca

SEQ ID NO: 66759 - DNA, 28 bp, Homo sapiens
gtttccgtagtgtagtggtcatcacgtt

SEQ ID NO: 66760 - DNA, 34 bp, Homo sapiens
taccccgaaaatgttggttatacccttcccgtac

SEQ ID NO: 66761 - DNA, 22 bp, Homo sapiens
tcgagtcccacctggggtacca

SEQ ID NO: 66762 - DNA, 36 bp, Homo sapiens
tcctcgttagtatagtggtgagtatccccgcctgtc

SEQ ID NO: 66763 - DNA, 20 bp, Homo sapiens
acaacatggctttctcacca

SEQ ID NO: 66764 - DNA, 17 bp, Homo sapiens
atcctgccgactacgcc

SEQ ID NO: 66765 - DNA, 38 bp, Homo sapiens
ggtttttcatatcattggtcgtggttgtagtccgtgcg

SEQ ID NO: 66766 - DNA, 21 bp, Homo sapiens
cgattcccgggcggcgcacca

SEQ ID NO: 66767 - DNA, 29 bp, Homo sapiens
atttcaacttaacttgaccgctctgacca

SEQ ID NO: 66768 - DNA, 36 bp, Homo sapiens
gacccagtggcctaatggataaggcatcagcctccg

SEQ ID NO: 66769 - DNA, 27 bp, Homo sapiens
aagcaatacactgaaaatgtttagacg

SEQ ID NO: 66770 - DNA, 29 bp, Homo sapiens
cagtaagttgcaatacttaatttctgcca

SEQ ID NO: 66771 - DNA, 25 bp, Homo sapiens
ggagaccggggttcgattccccgac

SEQ ID NO: 66772 - DNA, 24 bp, Homo sapiens
gcctgtcacgcgggagaccggggt

SEQ ID NO: 66773 - DNA, 19 bp, Homo sapiens
gaccacgtggcctaatgga

SEQ ID NO: 66774 - DNA, 33 bp, Homo sapiens
aaccggagatgaaaacctttttccaaggacacc

SEQ ID NO: 66775 - DNA, 16 bp, Homo sapiens
gcgaaaggtccccggt

SEQ ID NO: 66776 - DNA, 17 bp, Homo sapiens
acctctttacagtgacc

SEQ ID NO: 66777 - DNA, 37 bp, Homo sapiens
agtggtgagtatccccgcctgtcacgcgggagaccgg

SEQ ID NO: 66778 - DNA, 40 bp, Homo sapiens
agtggtgagtatccccgcctgtcacgcgggagaccggggt

SEQ ID NO: 66779 - DNA, 40 bp, Homo sapiens
cacgcgggagaccggggttcaattccccgacggggagcca

SEQ ID NO: 66780 - DNA, 30 bp, Homo sapiens
cccggatagctcagtcggtagagcatcaga

SEQ ID NO: 66781 - DNA, 32 bp, Homo sapiens
gacaacagaggcttacgaccccttatttaccc

SEQ ID NO: 66782 - DNA, 22 bp, Homo sapiens
ctgccacgcgggaggcccgggt

SEQ ID NO: 66783 - DNA, 31 bp, Homo sapiens
ggtcgtggttgtagtccgtgcgagaatacca

SEQ ID NO: 66784 - DNA, 16 bp, Homo sapiens
ccggctcggaggacca

SEQ ID NO: 66785 - DNA, 30 bp, Homo sapiens
ctggtggtctagtggttaggattcggcgct

SEQ ID NO: 66786 - DNA, 32 bp, Homo sapiens
tccctggtggtctagtggctaggattcggcgc

SEQ ID NO: 66787 - DNA, 25 bp, Homo sapiens
aggcttacgaccccttatttacccc

SEQ ID NO: 66788 - DNA, 30 bp, Homo sapiens
cgggagaccggggttcaattccccgacggg

SEQ ID NO: 66789 - DNA, 32 bp, Homo sapiens
gcctgggtagctcagtcggtagagcatcagac

SEQ ID NO: 66790 - DNA, 33 bp, Homo sapiens
gaagaagcagcttcaaacctgccggggcttcca

SEQ ID NO: 66791 - DNA, 17 bp, Homo sapiens
ggggtatgattctcggt

SEQ ID NO: 66792 - DNA, 36 bp, Homo sapiens
tcccacatggtctagcggttaggattcctggttttc

SEQ ID NO: 66793 - DNA, 17 bp, Homo sapiens
actgggcggaaacacca

SEQ ID NO: 66794 - DNA, 37 bp, Homo sapiens
acagaccaagagccttcaaagccctcagtaagttgca

SEQ ID NO: 66795 - DNA, 16 bp, Homo sapiens
accccttatttacccc

SEQ ID NO: 66796 - DNA, 19 bp, Homo sapiens
cacctctttacagtgacca

SEQ ID NO: 66797 - DNA, 16 bp, Homo sapiens
ctgggcggaaacacca

SEQ ID NO: 66798 - DNA, 19 bp, Homo sapiens
gaccgcgtggcctaatgga

SEQ ID NO: 66799 - DNA, 25 bp, Homo sapiens
tgacaacattcaaaaaagagtacca

SEQ ID NO: 66800 - DNA, 29 bp, Homo sapiens
agcccggtaatcgcataaaacttaaaact

SEQ ID NO: 66801 - DNA, 20 bp, Homo sapiens
ctgtcacgcgggagaccggg

SEQ ID NO: 66802 - DNA, 44 bp, Homo sapiens
gcccataccccgaaaatgttggttatacccttcccgtactacca

SEQ ID NO: 66803 - DNA, 20 bp, Homo sapiens
gatccccggcatctccacca

SEQ ID NO: 66804 - DNA, 33 bp, Homo sapiens
ggtttttcatatcattggtcgtggttgtagtcc

SEQ ID NO: 66805 - DNA, 46 bp, Homo sapiens
gcctgtcacgcgggagaccggggttcaattccccgacggggagcca

SEQ ID NO: 66806 - DNA, 19 bp, Homo sapiens
actcccggtgtgggaacca

SEQ ID NO: 66807 - DNA, 26 bp, Homo sapiens
gaaaatgtttagacgggctcacatca

SEQ ID NO: 66808 - DNA, 24 bp, Homo sapiens
gcttaaacccccttatttctacca

SEQ ID NO: 66809 - DNA, 37 bp, Homo sapiens
tagtggtatgattctcgctttgggtgcgagaggtccc

SEQ ID NO: 66810 - DNA, 28 bp, Homo sapiens
attggtcgtggttgtagtccgtgcgaga

SEQ ID NO: 66811 - DNA, 30 bp, Homo sapiens
cccggctagctcagtcggtagagcatgaga

SEQ ID NO: 66812 - DNA, 17 bp, Homo sapiens
tggttaggattcggcgc

SEQ ID NO: 66813 - DNA, 36 bp, Homo sapiens
ggttagcactctggactctgaatccagcgatccgag

SEQ ID NO: 66814 - DNA, 35 bp, Homo sapiens
agttgatgcagagtggggttttgcagtccttacca

SEQ ID NO: 66815 - DNA, 27 bp, Homo sapiens
ggctagctcagtcggtagagcatgaga

SEQ ID NO: 66816 - DNA, 29 bp, Homo sapiens
gggagaccggggttcgattccccgacggg

SEQ ID NO: 66817 - DNA, 32 bp, Homo sapiens
tcccacatggtctagcggttaggattcctggt

SEQ ID NO: 66818 - DNA, 22 bp, Homo sapiens
tcgatccccagcatctccacca

SEQ ID NO: 66819 - DNA, 28 bp, Homo sapiens
catgtctaacaacatggctttctcacca

SEQ ID NO: 66820 - DNA, 44 bp, Homo sapiens
ctgctaactcatgcccccatgtctaacaacatggctttctcacc

SEQ ID NO: 66821 - DNA, 32 bp, Homo sapiens
tcctcgttagtatagtggtgagtatccccgcc

SEQ ID NO: 66822 - DNA, 18 bp, Homo sapiens
cttccaagcagttgaccc

SEQ ID NO: 66823 - DNA, 20 bp, Homo sapiens
cacatcaccccataaacacc

SEQ ID NO: 66824 - DNA, 37 bp, Homo sapiens
tgtcacgcgggagaccggggttcgattccccgacggg

SEQ ID NO: 66825 - DNA, 42 bp, Homo sapiens
gagaaagctcacaagaactgctaactcatgcccccatgtcta

SEQ ID NO: 66826 - DNA, 28 bp, Homo sapiens
gtttccgtagtgtagcggttatcacatt

SEQ ID NO: 66827 - DNA, 22 bp, Homo sapiens
tcaagtccctgttcaggcgcca

SEQ ID NO: 66828 - DNA, 17 bp, Homo sapiens
tggttagtactctgcgt

SEQ ID NO: 66829 - DNA, 17 bp, Homo sapiens
aggggtatgattctcgg

SEQ ID NO: 66830 - DNA, 32 bp, Homo sapiens
cctggtggtctagtggttaggattcggcgctc

SEQ ID NO: 66831 - DNA, 37 bp, Homo sapiens
ggtgagtatccccgcctgtcacgcgggagaccggggt

SEQ ID NO: 66832 - DNA, 27 bp, Homo sapiens
cgcataaaacttaaaactttacagtca

SEQ ID NO: 66833 - DNA, 16 bp, Homo sapiens
gcccgcattctccacc

SEQ ID NO: 66834 - DNA, 36 bp, Homo sapiens
gcgccgctggtgtagtggtatcatgcaagattccca

SEQ ID NO: 66835 - DNA, 19 bp, Homo sapiens
gagcccggtaatcgcataa

SEQ ID NO: 66836 - DNA, 29 bp, Homo sapiens
aggattcggcgctctcaccgccgcggccc

SEQ ID NO: 66837 - DNA, 17 bp, Homo sapiens
ctcccggtgtgggaacc

SEQ ID NO: 66838 - DNA, 42 bp, Homo sapiens
ataacccagaggtcgatggatcgaaaccatcctctgctacca

SEQ ID NO: 66839 - DNA, 22 bp, Homo sapiens
tcgaatcctgccgactacgcca

SEQ ID NO: 66840 - DNA, 40 bp, Homo sapiens
ccaattaactagttttgacaacattcaaaaaagagtacca

SEQ ID NO: 66841 - DNA, 16 bp, Homo sapiens
tccggctcgaaggacc

SEQ ID NO: 66842 - DNA, 31 bp, Homo sapiens; identical to SEQ ID NO: 66166

SEQ ID NO: 66843 - DNA, 33 bp, Homo sapiens; identical to SEQ ID NO: 66162

SEQ ID NO: 66844 - DNA, 32 bp, Homo sapiens; identical to SEQ ID NO: 66157

SEQ ID NO: 66845 - DNA, 18 bp, Homo sapiens
atcccaccgctgccacca

SEQ ID NO: 66846 - DNA, 18 bp, Homo sapiens
tccccggcatctccacca

SEQ ID NO: 66847 - DNA, 31 bp, Homo sapiens; identical to SEQ ID NO: 66161

SEQ ID NO: 66848 - DNA, 18 bp, Homo sapiens
tccccggcacctccacca

SEQ ID NO: 66849 - DNA, 31 bp, Homo sapiens; identical to SEQ ID NO: 66165

SEQ ID NO: 66850 - DNA, 17 bp, Homo sapiens
tccgggtgccccctcca

SEQ ID NO: 66851 - DNA, 18 bp, Homo sapiens
tccccagtacctccacca

SEQ ID NO: 66852 - DNA, 33 bp, Homo sapiens; identical to SEQ ID NO: 66152

SEQ ID NO: 66853 - DNA, 17 bp, Homo sapiens
ccccggcatctccacca

SEQ ID NO: 66854 - DNA, 17 bp, Homo sapiens
accgggcggaaacacca

SEQ ID NO: 66855 - DNA, 33 bp, Homo sapiens; identical to SEQ ID NO: 66159

SEQ ID NO: 66856 - DNA, 41 bp, Homo sapiens; identical to SEQ ID NO: 66209

SEQ ID NO: 66857 - DNA, 32 bp, Homo sapiens; identical to SEQ ID NO: 66174

SEQ ID NO: 66858 - DNA, 33 bp, Homo sapiens; identical to SEQ ID NO: 66164

SEQ ID NO: 66859 - DNA, 17 bp, Homo sapiens
ccccggcacctccacca

SEQ ID NO: 66860 - DNA, 18 bp, Homo sapiens
atccgggtgccccctcca

SEQ ID NO: 66861 - DNA, 32 bp, Homo sapiens; identical to SEQ ID NO: 66175

SEQ ID NO: 66862 - DNA, 16 bp, Homo sapiens
ccgggcggaaacacca

SEQ ID NO: 66863 - DNA, 22 bp, Homo sapiens
tcaatccccggcacctccacca

SEQ ID NO: 66864 - DNA, 34 bp, Homo sapiens; identical to SEQ ID NO: 66188

SEQ ID NO: 66865 - DNA, 33 bp, Homo sapiens; identical to SEQ ID NO: 66179

SEQ ID NO: 66866 - DNA, 34 bp, Homo sapiens; identical to SEQ ID NO: 66183

SEQ ID NO: 66867 - DNA, 17 bp, Homo sapiens
tcccaccgctgccacca

SEQ ID NO: 66868 - DNA, 34 bp, Homo sapiens; identical to SEQ ID NO: 66191

SEQ ID NO: 66869 - DNA, 18 bp, Homo sapiens
aaccgggcggaaacacca

SEQ ID NO: 66870 - DNA, 33 bp, Homo sapiens; identical to SEQ ID NO: 66158

SEQ ID NO: 66871 - DNA, 22 bp, Homo sapiens
ctgtcacgcgggagaccggggt

SEQ ID NO: 66872 - DNA, 39 bp, Homo sapiens; identical to SEQ ID NO: 66190

SEQ ID NO: 66873 - DNA, 18 bp, Homo sapiens
atcaccccataaacacca

SEQ ID NO: 66874 - DNA, 17 bp, Homo sapiens
tccggctcgaaggacca

SEQ ID NO: 66875 - DNA, 32 bp, Homo sapiens; identical to SEQ ID NO: 66222

SEQ ID NO: 66876 - DNA, 16 bp, Homo sapiens
ccgggtgccccctcca

SEQ ID NO: 66877 - DNA, 23 bp, Homo sapiens
cctgtcacgcgggagaccggggt

SEQ ID NO: 66878 - DNA, 41 bp, Homo sapiens; identical to SEQ ID NO: 66294

SEQ ID NO: 66879 - DNA, 28 bp, Homo sapiens
cggctagctcagtcggtagagcatggga

SEQ ID NO: 66880 - DNA, 36 bp, Homo sapiens; identical to SEQ ID NO: 66329

SEQ ID NO: 66881 - DNA, 18 bp, Homo sapiens
atcctgccgactacgcca

SEQ ID NO: 66882 - DNA, 18 bp, Homo sapiens
atcccagcggggcctcca

SEQ ID NO: 66883 - DNA, 36 bp, Homo sapiens; identical to SEQ ID NO: 66312

SEQ ID NO: 66884 - DNA, 31 bp, Homo sapiens; identical to SEQ ID NO: 66276

SEQ ID NO: 66885 - DNA, 17 bp, Homo sapiens
accgggcagaagcacca

SEQ ID NO: 66886 - DNA, 43 bp, Homo sapiens; identical to SEQ ID NO: 66219

SEQ ID NO: 66887 - DNA, 25 bp, Homo sapiens
ggttcgattccccgacggggagcca

SEQ ID NO: 66888 - DNA, 17 bp, Homo sapiens
cccgggcggaaacacca

SEQ ID NO: 66889 - DNA, 18 bp, Homo sapiens
tccccgacacctccacca

SEQ ID NO: 66890 - DNA, 33 bp, Homo sapiens; identical to SEQ ID NO: 66212

SEQ ID NO: 66891 - DNA, 40 bp, Homo sapiens; identical to SEQ ID NO: 66203

SEQ ID NO: 66892 - DNA, 40 bp, Homo sapiens; identical to SEQ ID NO: 66308

SEQ ID NO: 66893 - DNA, 36 bp, Homo sapiens; identical to SEQ ID NO: 66366

SEQ ID NO: 66894 - DNA, 31 bp, Homo sapiens; identical to SEQ ID NO: 66172

SEQ ID NO: 66895 - DNA, 22 bp, Homo sapiens
tcgactcccggtgtgggaacca

SEQ ID NO: 66896 - DNA, 39 bp, Homo sapiens; identical to SEQ ID NO: 66273

SEQ ID NO: 66897 - DNA, 30 bp, Homo sapiens; identical to SEQ ID NO: 66169

SEQ ID NO: 66898 - DNA, 42 bp, Homo sapiens; identical to SEQ ID NO: 66182

SEQ ID NO: 66899 - DNA, 38 bp, Homo sapiens; identical to SEQ ID NO: 66208

SEQ ID NO: 66900 - DNA, 39 bp, Homo sapiens; identical to SEQ ID NO: 66256

SEQ ID NO: 66901 - DNA, 41 bp, Homo sapiens; identical to SEQ ID NO: 66455

SEQ ID NO: 66902 - DNA, 36 bp, Homo sapiens; identical to SEQ ID NO: 66333

SEQ ID NO: 66903 - DNA, 34 bp, Homo sapiens; identical to SEQ ID NO: 66170

SEQ ID NO: 66904 - DNA, 22 bp, Homo sapiens
tcgactcccggtatgggaacca

SEQ ID NO: 66905 - DNA, 18 bp, Homo sapiens
gtcccacccggggtacca

SEQ ID NO: 66906 - DNA, 34 bp, Homo sapiens; identical to SEQ ID NO: 66244

SEQ ID NO: 66907 - DNA, 30 bp, Homo sapiens; identical to SEQ ID NO: 66260

SEQ ID NO: 66908 - DNA, 22 bp, Homo sapiens
tcgatccccggcatctccacca

SEQ ID NO: 66909 - DNA, 36 bp, Homo sapiens; identical to SEQ ID NO: 66327

SEQ ID NO: 66910 - DNA, 36 bp, Homo sapiens; identical to SEQ ID NO: 66304

SEQ ID NO: 66911 - DNA, 28 bp, Homo sapiens
cggctagctcagtcggtagagcatgaga

SEQ ID NO: 66912 - DNA, 29 bp, Homo sapiens
ccggatagctcagtcggtagagcatcaga

SEQ ID NO: 66913 - DNA, 31 bp, Homo sapiens; identical to SEQ ID NO: 66460

SEQ ID NO: 66914 - DNA, 32 bp, Homo sapiens; identical to SEQ ID NO: 66263

SEQ ID NO: 66915 - DNA, 17 bp, Homo sapiens
atcccaccgctgccacc

SEQ ID NO: 66916 - DNA, 30 bp, Homo sapiens; identical to SEQ ID NO: 66397

SEQ ID NO: 66917 - DNA, 31 bp, Homo sapiens; identical to SEQ ID NO: 66512

SEQ ID NO: 66918 - DNA, 29 bp, Homo sapiens
gacgggctcacatcaccccataaacacca

SEQ ID NO: 66919 - DNA, 40 bp, Homo sapiens; identical to SEQ ID NO: 66264

SEQ ID NO: 66920 - DNA, 18 bp, Homo sapiens
tcccgggcggaaacacca

SEQ ID NO: 66921 - DNA, 32 bp, Homo sapiens; identical to SEQ ID NO: 66246

SEQ ID NO: 66922 - DNA, 30 bp, Homo sapiens; identical to SEQ ID NO: 66254

SEQ ID NO: 66923 - DNA, 18 bp, Homo sapiens
accccgtccgtgcctcca

SEQ ID NO: 66924 - DNA, 29 bp, Homo sapiens
ccggctagctcagtcggtagagcatgaga

SEQ ID NO: 66925 - DNA, 34 bp, Homo sapiens; identical to SEQ ID NO: 66267

SEQ ID NO: 66926 - DNA, 17 bp, Homo sapiens
tcccgggcggcgcacca

SEQ ID NO: 66927 - DNA, 29 bp, Homo sapiens
ccggctagctcagtcggtagagcatggga

SEQ ID NO: 66928 - DNA, 19 bp, Homo sapiens
atccccggcacctccacca

SEQ ID NO: 66929 - DNA, 28 bp, Homo sapiens
cggatagctcagtcggtagagcatcaga

SEQ ID NO: 66930 - DNA, 23 bp, Homo sapiens
ctgtcacgcgggagaccggggtt

SEQ ID NO: 66931 - DNA, 30 bp, Homo sapiens; identical to SEQ ID NO: 66358

SEQ ID NO: 66932 - DNA, 23 bp, Homo sapiens
tcccacatggtctagcggttagg

SEQ ID NO: 66933 - DNA, 32 bp, Homo sapiens; identical to SEQ ID NO: 66184

SEQ ID NO: 66934 - DNA, 35 bp, Homo sapiens; identical to SEQ ID NO: 66270

SEQ ID NO: 66935 - DNA, 35 bp, Homo sapiens; identical to SEQ ID NO: 66274

SEQ ID NO: 66936 - DNA, 42 bp, Homo sapiens; identical to SEQ ID NO: 66306

SEQ ID NO: 66937 - DNA, 31 bp, Homo sapiens; identical to SEQ ID NO: 66461

SEQ ID NO: 66938 - DNA, 37 bp, Homo sapiens; identical to SEQ ID NO: 66313

SEQ ID NO: 66939 - DNA, 17 bp, Homo sapiens
ccccagtacctccacca

SEQ ID NO: 66940 - DNA, 18 bp, Homo sapiens
atcccaccagagtcgcca

SEQ ID NO: 66941 - DNA, 25 bp, Homo sapiens
gcccggctagctcagtcggtagagc

SEQ ID NO: 66942 - DNA, 40 bp, Homo sapiens; identical to SEQ ID NO: 66515

SEQ ID NO: 66943 - DNA, 44 bp, Homo sapiens; identical to SEQ ID NO: 66403

SEQ ID NO: 66944 - DNA, 33 bp, Homo sapiens; identical to SEQ ID NO: 66285

SEQ ID NO: 66945 - DNA, 18 bp, Homo sapiens
tgcccgcatcctccacca

SEQ ID NO: 66946 - DNA, 29 bp, Homo sapiens
cggctagctcagtcggtagagcatgagac

SEQ ID NO: 66947 - DNA, 24 bp, Homo sapiens
gtcgtggttgtagtccgtgcgaga

SEQ ID NO: 66948 - DNA, 18 bp, Homo sapiens
atcccagtagagcctcca

SEQ ID NO: 66949 - DNA, 31 bp, Homo sapiens; identical to SEQ ID NO: 66240

SEQ ID NO: 66950 - DNA, 22 bp, Homo sapiens
tcgatccccagtacctccacca

SEQ ID NO: 66951 - DNA, 33 bp, Homo sapiens; identical to SEQ ID NO: 66468

SEQ ID NO: 66952 - DNA, 16 bp, Homo sapiens
ccgggcagaagcacca

SEQ ID NO: 66953 - DNA, 31 bp, Homo sapiens; identical to SEQ ID NO: 66411

SEQ ID NO: 66954 - DNA, 38 bp, Homo sapiens; identical to SEQ ID NO: 66373

SEQ ID NO: 66955 - DNA, 30 bp, Homo sapiens; identical to SEQ ID NO: 66426

SEQ ID NO: 66956 - DNA, 18 bp, Homo sapiens
gtcccaccagagtcgcca

SEQ ID NO: 66957 - DNA, 28 bp, Homo sapiens
ggattcggcgctttcaccgccgcggccc

SEQ ID NO: 66958 - DNA, 22 bp, Homo sapiens
tcaatccccagcacctccacca

SEQ ID NO: 66959 - DNA, 18 bp, Homo sapiens
cccccggctcctccacca

SEQ ID NO: 66960 - DNA, 17 bp, Homo sapiens
tggttaggattcggcgc

SEQ ID NO: 66961 - DNA, 17 bp, Homo sapiens
gcccgcattctccacca

SEQ ID NO: 66962 - DNA, 26 bp, Homo sapiens
gcccggctagctcagtcggtagagca

SEQ ID NO: 66963 - DNA, 18 bp, Homo sapiens
atcccagcggtgcctcca

SEQ ID NO: 66964 - DNA, 17 bp, Homo sapiens
tcctgccgactacgcca

SEQ ID NO: 66965 - DNA, 22 bp, Homo sapiens
tcgattcccggccaacgcacca

SEQ ID NO: 66966 - DNA, 16 bp, Homo sapiens
cccgggcggcgcacca

SEQ ID NO: 66967 - DNA, 17 bp, Homo sapiens
tccccggcacctccacc

SEQ ID NO: 66968 - DNA, 41 bp, Homo sapiens; identical to SEQ ID NO: 66302

SEQ ID NO: 66969 - DNA, 16 bp, Homo sapiens
cccggccaacgcacca

SEQ ID NO: 66970 - DNA, 19 bp, Homo sapiens
atccccagtacctccacca

SEQ ID NO: 66971 - DNA, 29 bp, Homo sapiens
cggctagctcagtcggtagagcatgggac

SEQ ID NO: 66972 - DNA, 18 bp, Homo sapiens
atccaggtgccccctcca

SEQ ID NO: 66973 - DNA, 18 bp, Homo sapiens
acctctttacagtgacca

SEQ ID NO: 66974 - DNA, 33 bp, Homo sapiens; identical to SEQ ID NO: 66365

SEQ ID NO: 66975 - DNA, 34 bp, Homo sapiens; identical to SEQ ID NO: 66508

SEQ ID NO: 66976 - DNA, 36 bp, Homo sapiens; identical to SEQ ID NO: 66348

SEQ ID NO: 66977 - DNA, 18 bp, Homo sapiens
accctgctcgctgcgcca

SEQ ID NO: 66978 - DNA, 18 bp, Homo sapiens
acctcagagggggcacca

SEQ ID NO: 66979 - DNA, 34 bp, Homo sapiens; identical to SEQ ID NO: 66314

SEQ ID NO: 66980 - DNA, 39 bp, Homo sapiens; identical to SEQ ID NO: 66506

SEQ ID NO: 66981 - DNA, 35 bp, Homo sapiens; identical to SEQ ID NO: 66622

SEQ ID NO: 66982 - DNA, 22 bp, Homo sapiens
tcgattccccgacggggagcca

SEQ ID NO: 66983 - DNA, 21 bp, Homo sapiens
tgtcacgcgggagaccggggt

SEQ ID NO: 66984 - DNA, 18 bp, Homo sapiens
ttcccgggcggcgcacca

SEQ ID NO: 66985 - DNA, 19 bp, Homo sapiens
atccccggcatctccacca

SEQ ID NO: 66986 - DNA, 32 bp, Homo sapiens; identical to SEQ ID NO: 66292

SEQ ID NO: 66987 - DNA, 26 bp, Homo sapiens
gcccggatagctcagtcggtagagca

SEQ ID NO: 66988 - DNA, 32 bp, Homo sapiens; identical to SEQ ID NO: 66350

SEQ ID NO: 66989 - DNA, 40 bp, Homo sapiens; identical to SEQ ID NO: 66578

SEQ ID NO: 66990 - DNA, 35 bp, Homo sapiens; identical to SEQ ID NO: 66480

SEQ ID NO: 66991 - DNA, 22 bp, Homo sapiens
tcaatccccggcatctccacca

SEQ ID NO: 66992 - DNA, 44 bp, Homo sapiens; identical to SEQ ID NO: 66233

SEQ ID NO: 66993 - DNA, 22 bp, Homo sapiens
tcgatccccggcacctccacca

SEQ ID NO: 66994 - DNA, 16 bp, Homo sapiens
ctcggtggaacctcca

SEQ ID NO: 66995 - DNA, 33 bp, Homo sapiens; identical to SEQ ID NO: 66423

SEQ ID NO: 66996 - DNA, 45 bp, Homo sapiens; identical to SEQ ID NO: 66405

SEQ ID NO: 66997 - DNA, 38 bp, Homo sapiens; identical to SEQ ID NO: 66565

SEQ ID NO: 66998 - DNA, 45 bp, Homo sapiens; identical to SEQ ID NO: 66386

SEQ ID NO: 66999 - DNA, 19 bp, Homo sapiens
catcaccccataaacacca

SEQ ID NO: 67000 - DNA, 23 bp, Homo sapiens
agaccggggttcgattccccgac

SEQ ID NO: 67001 - DNA, 22 bp, Homo sapiens
tcaaatcccggacgagccccca

SEQ ID NO: 67002 - DNA, 18 bp, Homo sapiens
ctcccggtgtgggaacca

SEQ ID NO: 67003 - DNA, 37 bp, Homo sapiens
tagtggttaggattcggcgctctcaccgccgcggccc

SEQ ID NO: 67004 - DNA, 21 bp, Homo sapiens
caatccccggcacctccacca

SEQ ID NO: 67005 - DNA, 18 bp, Homo sapiens
atccggctcgaaggacca

SEQ ID NO: 67006 - DNA, 18 bp, Homo sapiens
ttccccgacggggagcca

SEQ ID NO: 67007 - DNA, 22 bp, Homo sapiens
tcgattcccgggcggcgcacca

SEQ ID NO: 67008 - DNA, 18 bp, Homo sapiens
agtcggtagagcatcaga

SEQ ID NO: 67009 - DNA, 46 bp, Homo sapiens; identical to SEQ ID NO: 66248

SEQ ID NO: 67010 - DNA, 17 bp, Homo sapiens
gtcggtagagcatcaga

SEQ ID NO: 67011 - DNA, 18 bp, Homo sapiens
gtccctgtccaggcgcca

SEQ ID NO: 67012 - DNA, 42 bp, Homo sapiens; identical to SEQ ID NO: 66638

SEQ ID NO: 67013 - DNA, 31 bp, Homo sapiens; identical to SEQ ID NO: 66588

SEQ ID NO: 67014 - DNA, 24 bp, Homo sapiens
gttcgattccccgacggggagcca

SEQ ID NO: 67015 - DNA, 37 bp, Homo sapiens; identical to SEQ ID NO: 66268

SEQ ID NO: 67016 - DNA, 40 bp, Homo sapiens; identical to SEQ ID NO: 66779

SEQ ID NO: 67017 - DNA, 33 bp, Homo sapiens
ggtatgattctcgctttgggtgcgagaggtccc

SEQ ID NO: 67018 - DNA, 29 bp, Homo sapiens
gcccggctagctcagtcggtagagcatga

SEQ ID NO: 67019 - DNA, 41 bp, Homo sapiens
ggactgtaaatctaaagacaggggttaggcctctttttacc

SEQ ID NO: 67020 - DNA, 18 bp, Homo sapiens
agtggttagtatccccgc

SEQ ID NO: 67021 - DNA, 19 bp, Homo sapiens
ccttccaagcagttgaccc

SEQ ID NO: 67022 - DNA, 22 bp, Homo sapiens
tcgattcccggcccatgcacca

SEQ ID NO: 67023 - DNA, 25 bp, Homo sapiens
tccattggggtttccccgcgcaggt

SEQ ID NO: 67024 - DNA, 33 bp, Homo sapiens; identical to SEQ ID NO: 66359

SEQ ID NO: 67025 - DNA, 28 bp, Homo sapiens
ggattcggcgctctcaccgccgcggccc

SEQ ID NO: 67026 - DNA, 25 bp, Homo sapiens
ggctcacatcaccccataaacacca

SEQ ID NO: 67027 - DNA, 17 bp, Homo sapiens
gcccggctagctcagtc

SEQ ID NO: 67028 - DNA, 24 bp, Homo sapiens
gacaacattcaaaaaagagtacca

SEQ ID NO: 67029 - DNA, 29 bp, Homo sapiens
ggagatgaaaacctttttccaaggacacc

SEQ ID NO: 67030 - DNA, 17 bp, Homo sapiens
ccccgacacctccacca

SEQ ID NO: 67031 - DNA, 42 bp, Homo sapiens
ggactgtaaatctaaagacaggggttaggcctctttttacca

SEQ ID NO: 67032 - DNA, 36 bp, Homo sapiens; identical to SEQ ID NO: 66305

SEQ ID NO: 67033 - DNA, 18 bp, Homo sapiens
tcctcgctggggcctcca

SEQ ID NO: 67034 - DNA, 18 bp, Homo sapiens
aaccgggcagaagcacca

SEQ ID NO: 67035 - DNA, 24 bp, Homo sapiens
cctgtcacgcgggagaccggggtt

SEQ ID NO: 67036 - DNA, 23 bp, Homo sapiens
gtcgtggttgtagtccgtgcgag

SEQ ID NO: 67037 - DNA, 19 bp, Homo sapiens
tagtggttagtatccccgc

SEQ ID NO: 67038 - DNA, 33 bp, Homo sapiens
gcctgggtagctcagtcggtagagcatcagact

SEQ ID NO: 67039 - DNA, 18 bp, Homo sapiens
tcccacccagggacgcca

SEQ ID NO: 67040 - DNA, 32 bp, Homo sapiens; identical to SEQ ID NO: 66473

SEQ ID NO: 67041 - DNA, 22 bp, Homo sapiens
tcgaatcccagcggtgcctcca

SEQ ID NO: 67042 - DNA, 34 bp, Homo sapiens; identical to SEQ ID NO: 66236

SEQ ID NO: 67043 - DNA, 18 bp, Homo sapiens
tggttaggattcggcgct

SEQ ID NO: 67044 - DNA, 38 bp, Homo sapiens; identical to SEQ ID NO: 66623

SEQ ID NO: 67045 - DNA, 37 bp, Homo sapiens
acgcagaaggtcctgggttcgagccccagtggaacca

SEQ ID NO: 67046 - DNA, 33 bp, Homo sapiens
ggttccatagtgtagtggttatcacgtctgctt

SEQ ID NO: 67047 - DNA, 22 bp, Homo sapiens
tcgactcccagcggggcctcca

SEQ ID NO: 67048 - DNA, 32 bp, Homo sapiens; identical to SEQ ID NO: 66474

SEQ ID NO: 67049 - DNA, 17 bp, Homo sapiens
cctctttacagtgacca

SEQ ID NO: 67050 - DNA, 39 bp, Homo sapiens
agagtaaataataggagcttaaacccccttatttctacc

SEQ ID NO: 67051 - DNA, 17 bp, Homo sapiens
tcccggcggagtcgcca

SEQ ID NO: 67052 - DNA, 22 bp, Homo sapiens
tcgaatcccactcctgacacca

SEQ ID NO: 67053 - DNA, 36 bp, Homo sapiens
agtggctaggattcggcgctttcaccgccgcggccc

SEQ ID NO: 67054 - DNA, 18 bp, Homo sapiens
aggggtatgattctcggt

SEQ ID NO: 67055 - DNA, 31 bp, Homo sapiens; identical to SEQ ID NO: 66395

SEQ ID NO: 67056 - DNA, 31 bp, Homo sapiens; identical to SEQ ID NO: 66315

SEQ ID NO: 67057 - DNA, 30 bp, Homo sapiens; identical to SEQ ID NO: 66337

SEQ ID NO: 67058 - DNA, 17 bp, Homo sapiens
tggtgagtatccccgcc

SEQ ID NO: 67059 - DNA, 22 bp, Homo sapiens
tcacacgcgaaaggtccccggt

SEQ ID NO: 67060 - DNA, 38 bp, Homo sapiens; identical to SEQ ID NO: 66511

SEQ ID NO: 67061 - DNA, 18 bp, Homo sapiens
atcccaccctcgtcgcca

SEQ ID NO: 67062 - DNA, 25 bp, Homo sapiens
gtcgtggttgtagtccgtgcgagaa

SEQ ID NO: 67063 - DNA, 30 bp, Homo sapiens; identical to SEQ ID NO: 66691

SEQ ID NO: 67064 - DNA, 37 bp, Homo sapiens; identical to SEQ ID NO: 66331

SEQ ID NO: 67065 - DNA, 31 bp, Homo sapiens; identical to SEQ ID NO: 66675

SEQ ID NO: 67066 - DNA, 30 bp, Homo sapiens; identical to SEQ ID NO: 66636

SEQ ID NO: 67067 - DNA, 16 bp, Homo sapiens
ccggctcgaaggacca

SEQ ID NO: 67068 - DNA, 16 bp, Homo sapiens
gggtatgattctcggt

SEQ ID NO: 67069 - DNA, 28 bp, Homo sapiens
ggctagctcagtcggtagagcatgagac

SEQ ID NO: 67070 - DNA, 28 bp, Homo sapiens
gcccggctagctcagtcggtagagcatg

SEQ ID NO: 67071 - DNA, 35 bp, Homo sapiens; identical to SEQ ID NO: 66509

SEQ ID NO: 67072 - DNA, 17 bp, Homo sapiens
tccccagtacctccacc

SEQ ID NO: 67073 - DNA, 46 bp, Homo sapiens; identical to SEQ ID NO: 66242

SEQ ID NO: 67074 - DNA, 24 bp, Homo sapiens
gctcacatcaccccataaacacca

SEQ ID NO: 67075 - DNA, 28 bp, Homo sapiens
ggctagctcagtcggtagagcatgggac

SEQ ID NO: 67076 - DNA, 38 bp, Homo sapiens; identical to SEQ ID NO: 66293

SEQ ID NO: 67077 - DNA, 22 bp, Homo sapiens
tcaagtccctgttcgggcgcca

SEQ ID NO: 67078 - DNA, 34 bp, Homo sapiens; identical to SEQ ID NO: 66527

SEQ ID NO: 67079 - DNA, 17 bp, Homo sapiens
acgcgggagaccggggt

SEQ ID NO: 67080 - DNA, 34 bp, Homo sapiens; identical to SEQ ID NO: 66537

SEQ ID NO: 67081 - DNA, 22 bp, Homo sapiens
tcgaatcccagcggggcctcca

SEQ ID NO: 67082 - DNA, 39 bp, Homo sapiens
tgaatctgacaacagaggcttacgaccccttatttaccc

SEQ ID NO: 67083 - DNA, 38 bp, Homo sapiens
acgcagaaggtcctgggttcgagccccagtggaaccac

SEQ ID NO: 67084 - DNA, 46 bp, Homo sapiens; identical to SEQ ID NO: 66443

SEQ ID NO: 67085 - DNA, 17 bp, Homo sapiens
tccccggcatctccacc

SEQ ID NO: 67086 - DNA, 40 bp, Homo sapiens
gttaaagattaagagaaccaacacctctttacagtgacca

SEQ ID NO: 67087 - DNA, 34 bp, Homo sapiens
ggttccatagtgtagtggttatcacgtctgcttt

SEQ ID NO: 67088 - DNA, 21 bp, Homo sapiens
aacacctctttacagtgacca

SEQ ID NO: 67089 - DNA, 29 bp, Homo sapiens
gagatgaaaacctttttccaaggacacca

SEQ ID NO: 67090 - DNA, 42 bp, Homo sapiens; identical to SEQ ID NO: 66418

SEQ ID NO: 67091 - DNA, 17 bp, Homo sapiens
agtggttagtatccccg

SEQ ID NO: 67092 - DNA, 32 bp, Homo sapiens; identical to SEQ ID NO: 66491

SEQ ID NO: 67093 - DNA, 33 bp, Homo sapiens; identical to SEQ ID NO: 66394

SEQ ID NO: 67094 - DNA, 19 bp, Homo sapiens
atccccagcacctccacca

SEQ ID NO: 67095 - DNA, 18 bp, Homo sapiens
cttccaagcagttgaccc

SEQ ID NO: 67096 - DNA, 18 bp, Homo sapiens
ctcccagtggggcctcca

SEQ ID NO: 67097 - DNA, 37 bp, Homo sapiens; identical to SEQ ID NO: 66831

SEQ ID NO: 67098 - DNA, 23 bp, Homo sapiens
ccttccaagcagttgacccgggt

SEQ ID NO: 67099 - DNA, 32 bp, Homo sapiens; identical to SEQ ID NO: 66605

SEQ ID NO: 67100 - DNA, 35 bp, Homo sapiens
tggtgagtatccccgcctgtcacgcgggagaccgg

SEQ ID NO: 67101 - DNA, 32 bp, Homo sapiens; identical to SEQ ID NO: 66714

SEQ ID NO: 67102 - DNA, 16 bp, Homo sapiens
cctgccgactacgcca

SEQ ID NO: 67103 - DNA, 18 bp, Homo sapiens
agtggctaggattcggcg

SEQ ID NO: 67104 - DNA, 40 bp, Homo sapiens; identical to SEQ ID NO: 66383

SEQ ID NO: 67105 - DNA, 22 bp, Homo sapiens
tcgaatcccacttctgacacca

SEQ ID NO: 67106 - DNA, 17 bp, Homo sapiens
tccggctcggaggacca

SEQ ID NO: 67107 - DNA, 16 bp, Homo sapiens
tggttagtatccccgc

SEQ ID NO: 67108 - DNA, 20 bp, Homo sapiens
acatcaccccataaacacca

SEQ ID NO: 67109 - DNA, 35 bp, Homo sapiens; identical to SEQ ID NO: 66747

SEQ ID NO: 67110 - DNA, 17 bp, Homo sapiens
tccaggtgccccttcca

SEQ ID NO: 67111 - DNA, 40 bp, Homo sapiens; identical to SEQ ID NO: 66361

SEQ ID NO: 67112 - DNA, 28 bp, Homo sapiens
ggattcctggttttcacccaggcggccc

SEQ ID NO: 67113 - DNA, 29 bp, Homo sapiens
aggattcggcgctttcaccgccgcggccc

SEQ ID NO: 67114 - DNA, 22 bp, Homo sapiens
tcgattcccggccaatgcacca

SEQ ID NO: 67115 - DNA, 32 bp, Homo sapiens; identical to SEQ ID NO: 66516

SEQ ID NO: 67116 - DNA, 20 bp, Homo sapiens
ctaagccagggattgtgggt

SEQ ID NO: 67117 - DNA, 39 bp, Homo sapiens; identical to SEQ ID NO: 66339

SEQ ID NO: 67118 - DNA, 43 bp, Homo sapiens; identical to SEQ ID NO: 66410

SEQ ID NO: 67119 - DNA, 46 bp, Homo sapiens
ccaaaacatcagattgtgaatctgacaacagaggcttacgacccct

SEQ ID NO: 67120 - DNA, 18 bp, Homo sapiens
atcccatcctcgtcgcca

SEQ ID NO: 67121 - DNA, 18 bp, Homo sapiens
tagtggtatgattctcgc

SEQ ID NO: 67122 - DNA, 19 bp, Homo sapiens
actcccggtgtgggaacca

SEQ ID NO: 67123 - DNA, 22 bp, Homo sapiens
tcgagccccagtggaaccacca

SEQ ID NO: 67124 - DNA, 22 bp, Homo sapiens
tcgggtgcgagaggtcccgggt

SEQ ID NO: 67125 - DNA, 19 bp, Homo sapiens
agtggttaggattcggcgc

SEQ ID NO: 67126 - DNA, 34 bp, Homo sapiens; identical to SEQ ID NO: 66735

SEQ ID NO: 67127 - DNA, 19 bp, Homo sapiens
gtgagtatccccgcctgtc

SEQ ID NO: 67128 - DNA, 34 bp, Homo sapiens; identical to SEQ ID NO: 66336

SEQ ID NO: 67129 - DNA, 37 bp, Homo sapiens; identical to SEQ ID NO: 66809

SEQ ID NO: 67130 - DNA, 38 bp, Homo sapiens; identical to SEQ ID NO: 66458

SEQ ID NO: 67131 - DNA, 18 bp, Homo sapiens
tagtggttagtatccccg

SEQ ID NO: 67132 - DNA, 38 bp, Homo sapiens
tgaatctgacaacagaggcttacgaccccttatttacc

SEQ ID NO: 67133 - DNA, 18 bp, Homo sapiens
tcgggtgcgagaggtccc

SEQ ID NO: 67134 - DNA, 45 bp, Homo sapiens; identical to SEQ ID NO: 66324

SEQ ID NO: 67135 - DNA, 34 bp, Homo sapiens; identical to SEQ ID NO: 66338

SEQ ID NO: 67136 - DNA, 38 bp, Homo sapiens
gcatgggtggttcagtggtagaattctcgcctgccacg

SEQ ID NO: 67137 - DNA, 18 bp, Homo sapiens
agtggttaggattcggcg

SEQ ID NO: 67138 - DNA, 43 bp, Homo sapiens; identical to SEQ ID NO: 66609

SEQ ID NO: 67139 - DNA, 32 bp, Homo sapiens; identical to SEQ ID NO: 66290

SEQ ID NO: 67140 - DNA, 31 bp, Homo sapiens; identical to SEQ ID NO: 66477

SEQ ID NO: 67141 - DNA, 23 bp, Homo sapiens
cttataatgccgaggttgtgagt

SEQ ID NO: 67142 - DNA, 18 bp, Homo sapiens
ttccggctcgaaggacca

SEQ ID NO: 67143 - DNA, 24 bp, Homo sapiens
accaacacctctttacagtgacca

SEQ ID NO: 67144 - DNA, 18 bp, Homo sapiens
acgcgaaaggtccccggt

SEQ ID NO: 67145 - DNA, 35 bp, Homo sapiens; identical to SEQ ID NO: 66409

SEQ ID NO: 67146 - DNA, 36 bp, Homo sapiens; identical to SEQ ID NO: 66178

SEQ ID NO: 67147 - DNA, 31 bp, Homo sapiens
ccggagatgaaaacctttttccaaggacacc

SEQ ID NO: 67148 - DNA, 17 bp, Homo sapiens
ccccgtccgtgcctcca

SEQ ID NO: 67149 - DNA, 21 bp, Homo sapiens
cgatccccggcatctccacca

SEQ ID NO: 67150 - DNA, 17 bp, Homo sapiens
tggttagtactctgcgt

SEQ ID NO: 67151 - DNA, 22 bp, Homo sapiens
agaccggggttcgattccccga

SEQ ID NO: 67152 - DNA, 20 bp, Homo sapiens
gtaaaccaggggtcgcgagt

SEQ ID NO: 67153 - DNA, 31 bp, Homo sapiens; identical to SEQ ID NO: 66456

SEQ ID NO: 67154 - DNA, 30 bp, Homo sapiens; identical to SEQ ID NO: 66514

SEQ ID NO: 67155 - DNA, 44 bp, Homo sapiens
acttccaattaactagttttgacaacattcaaaaaagagtacca

SEQ ID NO: 67156 - DNA, 40 bp, Homo sapiens; identical to SEQ ID NO: 66503

SEQ ID NO: 67157 - DNA, 35 bp, Homo sapiens
gtggctaggattcggcgctttcaccgccgcggccc

SEQ ID NO: 67158 - DNA, 32 bp, Homo sapiens
tgaatctgacaacagaggcttacgacccctta

SEQ ID NO: 67159 - DNA, 38 bp, Homo sapiens
tagtggtgagtatccccgcctgtcacgcgggagaccgg

SEQ ID NO: 67160 - DNA, 31 bp, Homo sapiens; identical to SEQ ID NO: 66632

SEQ ID NO: 67161 - DNA, 18 bp, Homo sapiens
gtcccggcggagtcgcca

SEQ ID NO: 67162 - DNA, 33 bp, Homo sapiens
gtgagtatccccgcctgtcacgcgggagaccgg

SEQ ID NO: 67163 - DNA, 43 bp, Homo sapiens
tggactgtaaatctaaagacaggggttaggcctctttttacca

SEQ ID NO: 67164 - DNA, 34 bp, Homo sapiens; identical to SEQ ID NO: 66215

SEQ ID NO: 67165 - DNA, 24 bp, Homo sapiens
ccttccaagcagttgacccgggtt

SEQ ID NO: 67166 - DNA, 38 bp, Homo sapiens
actaagtgtttgtgggtttaagtcccattggtctagcc

SEQ ID NO: 67167 - DNA, 34 bp, Homo sapiens; identical to SEQ ID NO: 66655

SEQ ID NO: 67168 - DNA, 35 bp, Homo sapiens; identical to SEQ ID NO: 66432

SEQ ID NO: 67169 - DNA, 35 bp, Homo sapiens; identical to SEQ ID NO: 66371

SEQ ID NO: 67170 - DNA, 20 bp, Homo sapiens
ctgaatccagcgatccgagt

SEQ ID NO: 67171 - DNA, 35 bp, Homo sapiens; identical to SEQ ID NO: 66595

SEQ ID NO: 67172 - DNA, 19 bp, Homo sapiens
cattcaaaaaagagtacca

SEQ ID NO: 67173 - DNA, 20 bp, Homo sapiens
gtcacgcgggagaccggggt

SEQ ID NO: 67174 - DNA, 42 bp, Homo sapiens
gtcacgcgggagaccggggttcaattccccgacggggagcca

SEQ ID NO: 67175 - DNA, 20 bp, Homo sapiens
acacctctttacagtgacca

SEQ ID NO: 67176 - DNA, 27 bp, Homo sapiens
agcccggatagctcagtcggtagagca

SEQ ID NO: 67177 - DNA, 21 bp, Homo sapiens
cgattccccgacggggagcca

SEQ ID NO: 67178 - DNA, 23 bp, Homo sapiens
tggtgagtatccccgcctgtcac

SEQ ID NO: 67179 - DNA, 37 bp, Homo sapiens; identical to SEQ ID NO: 66777

SEQ ID NO: 67180 - DNA, 18 bp, Homo sapiens
atcccaccttcgtcgcca

SEQ ID NO: 67181 - DNA, 36 bp, Homo sapiens
acgcgggagaccggggttcgattccccgacggggag

SEQ ID NO: 67182 - DNA, 41 bp, Homo sapiens; identical to SEQ ID NO: 66412

SEQ ID NO: 67183 - DNA, 25 bp, Homo sapiens
gtcaggatggccgagtggtctaagg

SEQ ID NO: 67184 - DNA, 22 bp, Homo sapiens
tcgatccccgtacgggccacca

SEQ ID NO: 67185 - DNA, 16 bp, Homo sapiens
agtcggtagagcatca

SEQ ID NO: 67186 - DNA, 35 bp, Homo sapiens
tcccacatggtctagcggttaggattcctggtttt

SEQ ID NO: 67187 - DNA, 38 bp, Homo sapiens
ctagtggttaggattcggcgctctcaccgccgcggccc

SEQ ID NO: 67188 - DNA, 29 bp, Homo sapiens
aggattcctggttttcacccaggcggccc

SEQ ID NO: 67189 - DNA, 30 bp, Homo sapiens; identical to SEQ ID NO: 66555

SEQ ID NO: 67190 - DNA, 24 bp, Homo sapiens
gcttacgaccccttatttacccca

SEQ ID NO: 67191 - DNA, 28 bp, Homo sapiens
gggtatagctcagcggtagagcgcgtgc

SEQ ID NO: 67192 - DNA, 33 bp, Homo sapiens; identical to SEQ ID NO: 66682

SEQ ID NO: 67193 - DNA, 32 bp, Homo sapiens; identical to SEQ ID NO: 66517

SEQ ID NO: 67194 - DNA, 42 bp, Homo sapiens
ctgaatccagcgatccgagttcaaatctcggtggaacctcca

SEQ ID NO: 67195 - DNA, 16 bp, Homo sapiens
tccgggtgccccctcc

SEQ ID NO: 67196 - DNA, 33 bp, Homo sapiens; identical to SEQ ID NO: 66298

SEQ ID NO: 67197 - DNA, 18 bp, Homo sapiens
ctcccggtatgggaacca

SEQ ID NO: 67198 - DNA, 37 bp, Homo sapiens
tagtggctaggattcggcgctttcaccgccgcggccc

SEQ ID NO: 67199 - DNA, 36 bp, Homo sapiens
agtggtatgattctcgctttgggtgcgagaggtccc

SEQ ID NO: 67200 - DNA, 17 bp, Homo sapiens
acgcgggaggcccgggt

SEQ ID NO: 67201 - DNA, 22 bp, Homo sapiens
tcgatccccgacacctccacca

SEQ ID NO: 67202 - DNA, 30 bp, Homo sapiens; identical to SEQ ID NO: 66576

SEQ ID NO: 67203 - DNA, 39 bp, Homo sapiens; identical to SEQ ID NO: 66736

SEQ ID NO: 67204 - DNA, 16 bp, Homo sapiens
tggttaggattcggcg

SEQ ID NO: 67205 - DNA, 33 bp, Homo sapiens
ggtatgattctcgcttcgggtgcgagaggtccc

SEQ ID NO: 67206 - DNA, 35 bp, Homo sapiens; identical to SEQ ID NO: 66592

SEQ ID NO: 67207 - DNA, 17 bp, Homo sapiens
tccctgtccaggcgcca

SEQ ID NO: 67208 - DNA, 32 bp, Homo sapiens; identical to SEQ ID NO: 66284

SEQ ID NO: 67209 - DNA, 29 bp, Homo sapiens
gcactctggactctgaatccagcgatccg

SEQ ID NO: 67210 - DNA, 42 bp, Homo sapiens; identical to SEQ ID NO: 66486

SEQ ID NO: 67211 - DNA, 33 bp, Homo sapiens; identical to SEQ ID NO: 66774

SEQ ID NO: 67212 - DNA, 23 bp, Homo sapiens
agaccggggttcaattccccgac

SEQ ID NO: 67213 - DNA, 19 bp, Homo sapiens
tggttaggattcggcgctc

SEQ ID NO: 67214 - DNA, 33 bp, Homo sapiens
tccctggtggtctagtggctaggattcggcgct

SEQ ID NO: 67215 - DNA, 23 bp, Homo sapiens
gcccggctagctcagtcggtaga

SEQ ID NO: 67216 - DNA, 23 bp, Homo sapiens
ccaacacctctttacagtgacca

SEQ ID NO: 67217 - DNA, 18 bp, Homo sapiens
atccggctcggaggacca

SEQ ID NO: 67218 - DNA, 45 bp, Homo sapiens; identical to SEQ ID NO: 66427

SEQ ID NO: 67219 - DNA, 18 bp, Homo sapiens
acgcgggaggcccgggtt

SEQ ID NO: 67220 - DNA, 30 bp, Homo sapiens; identical to SEQ ID NO: 66541

SEQ ID NO: 67221 - DNA, 32 bp, Homo sapiens; identical to SEQ ID NO: 66789

SEQ ID NO: 67222 - DNA, 19 bp, Homo sapiens
gcccggatagctcagtcgg

SEQ ID NO: 67223 - DNA, 16 bp, Homo sapiens
ggtgagtatccccgcc

SEQ ID NO: 67224 - DNA, 22 bp, Homo sapiens
tgtcacgcgggagaccggggtt

SEQ ID NO: 67225 - DNA, 21 bp, Homo sapiens
cgattcccggccaacgcacca

SEQ ID NO: 67226 - DNA, 19 bp, Homo sapiens
tagtggttaggattcggcg

SEQ ID NO: 67227 - DNA, 27 bp, Homo sapiens
gtcgtggttgtagtccgtgcgagaata

SEQ ID NO: 67228 - DNA, 33 bp, Homo sapiens
ggtgagcatagctgccttccaagcagttgaccc

SEQ ID NO: 67229 - DNA, 19 bp, Homo sapiens
agtcggtagagcatcagac

SEQ ID NO: 67230 - DNA, 22 bp, Homo sapiens
tggttaggattcggcgctctca

SEQ ID NO: 67231 - DNA, 37 bp, Homo sapiens; identical to SEQ ID NO: 66429

SEQ ID NO: 67232 - DNA, 22 bp, Homo sapiens
tcgagcccacccagggacgcca

SEQ ID NO: 67233 - DNA, 34 bp, Homo sapiens; identical to SEQ ID NO: 66187

SEQ ID NO: 67234 - DNA, 18 bp, Homo sapiens
acgcgggagaccggggtt

SEQ ID NO: 67235 - DNA, 30 bp, Homo sapiens
ggctagctcagtcggtagagcatgggactc

SEQ ID NO: 67236 - DNA, 33 bp, Homo sapiens; identical to SEQ ID NO: 66570

SEQ ID NO: 67237 - DNA, 17 bp, Homo sapiens
cctcagagggggcacca

SEQ ID NO: 67238 - DNA, 39 bp, Homo sapiens
gagtaaataataggagcttaaacccccttatttctacca

SEQ ID NO: 67239 - DNA, 40 bp, Homo sapiens; identical to SEQ ID NO: 66731

SEQ ID NO: 67240 - DNA, 22 bp, Homo sapiens
tcaattccccgacggggagcca

SEQ ID NO: 67241 - DNA, 29 bp, Homo sapiens
cggatagctcagtcggtagagcatcagac

SEQ ID NO: 67242 - DNA, 25 bp, Homo sapiens
gtctcataatctgaaggtcgtgagt

SEQ ID NO: 67243 - DNA, 21 bp, Homo sapiens
tggtgagtatccccgcctgtc

SEQ ID NO: 67244 - DNA, 23 bp, Homo sapiens
ctcacatcaccccataaacacca

SEQ ID NO: 67245 - DNA, 19 bp, Homo sapiens
ctgtcacgcgggagaccgg

SEQ ID NO: 67246 - DNA, 17 bp, Homo sapiens
tccccgacggggagcca

SEQ ID NO: 67247 - DNA, 16 bp, Homo sapiens
accgggcggaaacacc

SEQ ID NO: 67248 - DNA, 31 bp, Homo sapiens
gcctggatagctcagttggtagagcatcaga

SEQ ID NO: 67249 - DNA, 30 bp, Homo sapiens
agcactctggactttgaatccagcgatccg

SEQ ID NO: 67250 - DNA, 29 bp, Homo sapiens
agcatagctgccttccaagcagttgaccc

SEQ ID NO: 67251 - DNA, 36 bp, Homo sapiens
gtggtgagtatccccgcctgtcacgcgggagaccgg

SEQ ID NO: 67252 - DNA, 18 bp, Homo sapiens
gtcacgtcggggtcacca

SEQ ID NO: 67253 - DNA, 35 bp, Homo sapiens; identical to SEQ ID NO: 66646

SEQ ID NO: 67254 - DNA, 29 bp, Homo sapiens
aggattcggcgctctcaccgccgcggccc

SEQ ID NO: 67255 - DNA, 20 bp, Homo sapiens
agtggttaggattcggcgct

SEQ ID NO: 67256 - DNA, 29 bp, Homo sapiens
gcatgggtggttcagtggtagaattctcg

SEQ ID NO: 67257 - DNA, 27 bp, Homo sapiens
ggctagctcagtcggtagagcatgaga

SEQ ID NO: 67258 - DNA, 19 bp, Homo sapiens
tagtggttagtactctgcg

SEQ ID NO: 67259 - DNA, 27 bp, Homo sapiens
ggctagctcagtcggtagagcatggga

SEQ ID NO: 67260 - DNA, 35 bp, Homo sapiens; identical to SEQ ID NO: 66180

SEQ ID NO: 67261 - DNA, 19 bp, Homo sapiens
taggggtatgattctcggt

SEQ ID NO: 67262 - DNA, 26 bp, Homo sapiens
gggctcacatcaccccataaacacca

SEQ ID NO: 67263 - DNA, 16 bp, Homo sapiens
tccccggcacctccac

SEQ ID NO: 67264 - DNA, 45 bp, Homo sapiens; identical to SEQ ID NO: 66581

SEQ ID NO: 67265 - DNA, 29 bp, Homo sapiens
gcccggctagctcagtcggtagagcatgg

SEQ ID NO: 67266 - DNA, 41 bp, Homo sapiens
aacatcagattgtgaatctgacaacagaggcttacgacccc

SEQ ID NO: 67267 - DNA, 40 bp, Homo sapiens; identical to SEQ ID NO: 66840

SEQ ID NO: 67268 - DNA, 31 bp, Homo sapiens; identical to SEQ ID NO: 66502

SEQ ID NO: 67269 - DNA, 18 bp, Homo sapiens
tgcccgcattctccacca

SEQ ID NO: 67270 - DNA, 34 bp, Homo sapiens
ggtgagtatccccgcctgtcacgcgggagaccgg

SEQ ID NO: 67271 - DNA, 26 bp, Homo sapiens
tcgcctgccacgcgggaggcccgggt

SEQ ID NO: 67272 - DNA, 33 bp, Homo sapiens
tggtagaattctcgcctgccacgcgggaggccc

SEQ ID NO: 67273 - DNA, 39 bp, Homo sapiens; identical to SEQ ID NO: 66266

SEQ ID NO: 67274 - DNA, 21 bp, Homo sapiens
cgatccccagtacctccacca

SEQ ID NO: 67275 - DNA, 24 bp, Homo sapiens
tagtggtgagtatccccgcctgtc

SEQ ID NO: 67276 - DNA, 33 bp, Homo sapiens; identical to SEQ ID NO: 66158

SEQ ID NO: 67277 - DNA, 18 bp, Homo sapiens
tccccggcacctccacca

SEQ ID NO: 67278 - DNA, 17 bp, Homo sapiens
ccccggcatctccacca

SEQ ID NO: 67279 - DNA, 18 bp, Homo sapiens
tccccggcatctccacca

SEQ ID NO: 67280 - DNA, 33 bp, Homo sapiens; identical to SEQ ID NO: 66152

SEQ ID NO: 67281 - DNA, 33 bp, Homo sapiens; identical to SEQ ID NO: 66159

SEQ ID NO: 67282 - DNA, 18 bp, Homo sapiens
atcccaccgctgccacca

SEQ ID NO: 67283 - DNA, 17 bp, Homo sapiens
accgggcggaaacacca

SEQ ID NO: 67284 - DNA, 31 bp, Homo sapiens; identical to SEQ ID NO: 66166

SEQ ID NO: 67285 - DNA, 17 bp, Homo sapiens
tccgggtgccccctcca

SEQ ID NO: 67286 - DNA, 17 bp, Homo sapiens
ccccggcacctccacca

SEQ ID NO: 67287 - DNA, 32 bp, Homo sapiens; identical to SEQ ID NO: 66157

SEQ ID NO: 67288 - DNA, 30 bp, Homo sapiens; identical to SEQ ID NO: 66169

SEQ ID NO: 67289 - DNA, 33 bp, Homo sapiens; identical to SEQ ID NO: 66162

SEQ ID NO: 67290 - DNA, 31 bp, Homo sapiens; identical to SEQ ID NO: 66161

SEQ ID NO: 67291 - DNA, 31 bp, Homo sapiens; identical to SEQ ID NO: 66165

SEQ ID NO: 67292 - DNA, 19 bp, Homo sapiens
catcaccccataaacacca

SEQ ID NO: 67293 - DNA, 33 bp, Homo sapiens; identical to SEQ ID NO: 66164

SEQ ID NO: 67294 - DNA, 31 bp, Homo sapiens; identical to SEQ ID NO: 66172

SEQ ID NO: 67295 - DNA, 18 bp, Homo sapiens
tccccagtacctccacca

SEQ ID NO: 67296 - DNA, 34 bp, Homo sapiens; identical to SEQ ID NO: 66170

SEQ ID NO: 67297 - DNA, 16 bp, Homo sapiens
ccgggcggaaacacca

SEQ ID NO: 67298 - DNA, 32 bp, Homo sapiens; identical to SEQ ID NO: 66175

SEQ ID NO: 67299 - DNA, 32 bp, Homo sapiens; identical to SEQ ID NO: 66174

SEQ ID NO: 67300 - DNA, 18 bp, Homo sapiens
atccgggtgccccctcca

SEQ ID NO: 67301 - DNA, 35 bp, Homo sapiens; identical to SEQ ID NO: 66180

SEQ ID NO: 67302 - DNA, 17 bp, Homo sapiens
tccggctcgaaggacca

SEQ ID NO: 67303 - DNA, 17 bp, Homo sapiens
tcccaccgctgccacca

SEQ ID NO: 67304 - DNA, 36 bp, Homo sapiens; identical to SEQ ID NO: 66178

SEQ ID NO: 67305 - DNA, 39 bp, Homo sapiens; identical to SEQ ID NO: 66190

SEQ ID NO: 67306 - DNA, 21 bp, Homo sapiens
aacacctctttacagtgacca

SEQ ID NO: 67307 - DNA, 22 bp, Homo sapiens
tcaatccccggcacctccacca

SEQ ID NO: 67308 - DNA, 32 bp, Homo sapiens; identical to SEQ ID NO: 66184

SEQ ID NO: 67309 - DNA, 17 bp, Homo sapiens
cctctttacagtgacca

SEQ ID NO: 67310 - DNA, 25 bp, Homo sapiens
ggctcacatcaccccataaacacca

SEQ ID NO: 67311 - DNA, 34 bp, Homo sapiens; identical to SEQ ID NO: 66183

SEQ ID NO: 67312 - DNA, 34 bp, Homo sapiens; identical to SEQ ID NO: 66187

SEQ ID NO: 67313 - DNA, 20 bp, Homo sapiens
acacctctttacagtgacca

SEQ ID NO: 67314 - DNA, 34 bp, Homo sapiens; identical to SEQ ID NO: 66188

SEQ ID NO: 67315 - DNA, 33 bp, Homo sapiens; identical to SEQ ID NO: 66179

SEQ ID NO: 67316 - DNA, 18 bp, Homo sapiens
aaccgggcggaaacacca

SEQ ID NO: 67317 - DNA, 18 bp, Homo sapiens
atcaccccataaacacca

SEQ ID NO: 67318 - DNA, 18 bp, Homo sapiens
atcccagcggggcctcca

SEQ ID NO: 67319 - DNA, 16 bp, Homo sapiens
cccggccaacgcacca

SEQ ID NO: 67320 - DNA, 28 bp, Homo sapiens
cggctagctcagtcggtagagcatggga

SEQ ID NO: 67321 - DNA, 35 bp, Homo sapiens; identical to SEQ ID NO: 66210

SEQ ID NO: 67322 - DNA, 33 bp, Homo sapiens; identical to SEQ ID NO: 66205

SEQ ID NO: 67323 - DNA, 18 bp, Homo sapiens
atcctgccgactacgcca

SEQ ID NO: 67324 - DNA, 16 bp, Homo sapiens
ccgggtgccccctcca

SEQ ID NO: 67325 - DNA, 18 bp, Homo sapiens
acctctttacagtgacca

SEQ ID NO: 67326 - DNA, 34 bp, Homo sapiens; identical to SEQ ID NO: 66217

SEQ ID NO: 67327 - DNA, 34 bp, Homo sapiens; identical to SEQ ID NO: 66191

SEQ ID NO: 67328 - DNA, 21 bp, Homo sapiens
cacatcaccccataaacacca

SEQ ID NO: 67329 - DNA, 17 bp, Homo sapiens
cccgggcggaaacacca

SEQ ID NO: 67330 - DNA, 17 bp, Homo sapiens
tcccgggcggcgcacca

SEQ ID NO: 67331 - DNA, 18 bp, Homo sapiens
tccccgacacctccacca

SEQ ID NO: 67332 - DNA, 18 bp, Homo sapiens
gtcccacccggggtacca

SEQ ID NO: 67333 - DNA, 22 bp, Homo sapiens
tcgactcccggtatgggaacca

SEQ ID NO: 67334 - DNA, 28 bp, Homo sapiens
cggctagctcagtcggtagagcatgaga

SEQ ID NO: 67335 - DNA, 33 bp, Homo sapiens; identical to SEQ ID NO: 66225

SEQ ID NO: 67336 - DNA, 29 bp, Homo sapiens
gagatgaaaacctttttccaaggacacca

SEQ ID NO: 67337 - DNA, 34 bp, Homo sapiens; identical to SEQ ID NO: 66236

SEQ ID NO: 67338 - DNA, 24 bp, Homo sapiens
gctcacatcaccccataaacacca

SEQ ID NO: 67339 - DNA, 39 bp, Homo sapiens; identical to SEQ ID NO: 66256

SEQ ID NO: 67340 - DNA, 41 bp, Homo sapiens; identical to SEQ ID NO: 66209

SEQ ID NO: 67341 - DNA, 40 bp, Homo sapiens; identical to SEQ ID NO: 66203

SEQ ID NO: 67342 - DNA, 18 bp, Homo sapiens
accccgtccgtgcctcca

SEQ ID NO: 67343 - DNA, 18 bp, Homo sapiens
cccccggctcctccacca

SEQ ID NO: 67344 - DNA, 18 bp, Homo sapiens
atcccagcggtgcctcca

SEQ ID NO: 67345 - DNA, 18 bp, Homo sapiens
tgcccgcatcctccacca

SEQ ID NO: 67346 - DNA, 17 bp, Homo sapiens
gcccgcattctccacca

SEQ ID NO: 67347 - DNA, 25 bp, Homo sapiens
caacttaacttgaccgctctgacca

SEQ ID NO: 67348 - DNA, 20 bp, Homo sapiens
acatcaccccataaacacca

SEQ ID NO: 67349 - DNA, 19 bp, Homo sapiens
atccccggcacctccacca

SEQ ID NO: 67350 - DNA, 17 bp, Homo sapiens
atcccaccgctgccacc

SEQ ID NO: 67351 - DNA, 42 bp, Homo sapiens; identical to SEQ ID NO: 66182

SEQ ID NO: 67352 - DNA, 17 bp, Homo sapiens
accccttatttacccca

SEQ ID NO: 67353 - DNA, 16 bp, Homo sapiens
ctctttacagtgacca

SEQ ID NO: 67354 - DNA, 16 bp, Homo sapiens
cccgggcggcgcacca

SEQ ID NO: 67355 - DNA, 18 bp, Homo sapiens
atccggctcgaaggacca

SEQ ID NO: 67356 - DNA, 27 bp, Homo sapiens
gaggcttacgaccccttatttacccca

SEQ ID NO: 67357 - DNA, 32 bp, Homo sapiens; identical to SEQ ID NO: 66292

SEQ ID NO: 67358 - DNA, 23 bp, Homo sapiens
cctgtcacgcgggagaccggggt

SEQ ID NO: 67359 - DNA, 32 bp, Homo sapiens; identical to SEQ ID NO: 66222

SEQ ID NO: 67360 - DNA, 32 bp, Homo sapiens; identical to SEQ ID NO: 66259

SEQ ID NO: 67361 - DNA, 17 bp, Homo sapiens
tcctgccgactacgcca

SEQ ID NO: 67362 - DNA, 33 bp, Homo sapiens; identical to SEQ ID NO: 66212

SEQ ID NO: 67363 - DNA, 29 bp, Homo sapiens
cggctagctcagtcggtagagcatgggac

SEQ ID NO: 67364 - DNA, 17 bp, Homo sapiens
accgggcagaagcacca

SEQ ID NO: 67365 - DNA, 32 bp, Homo sapiens; identical to SEQ ID NO: 66246

SEQ ID NO: 67366 - DNA, 18 bp, Homo sapiens
tcccgggcggaaacacca

SEQ ID NO: 67367 - DNA, 22 bp, Homo sapiens
ctgtcacgcgggagaccggggt

SEQ ID NO: 67368 - DNA, 31 bp, Homo sapiens; identical to SEQ ID NO: 66240

SEQ ID NO: 67369 - DNA, 34 bp, Homo sapiens; identical to SEQ ID NO: 66244

SEQ ID NO: 67370 - DNA, 37 bp, Homo sapiens; identical to SEQ ID NO: 66268

SEQ ID NO: 67371 - DNA, 22 bp, Homo sapiens
tcgattcccggcccatgcacca

SEQ ID NO: 67372 - DNA, 35 bp, Homo sapiens; identical to SEQ ID NO: 66274

SEQ ID NO: 67373 - DNA, 16 bp, Homo sapiens
ctcggtggaacctcca

SEQ ID NO: 67374 - DNA, 22 bp, Homo sapiens
tcgattcccggccaacgcacca

SEQ ID NO: 67375 - DNA, 18 bp, Homo sapiens
gagcccggtaatcgcata

SEQ ID NO: 67376 - DNA, 34 bp, Homo sapiens; identical to SEQ ID NO: 66267

SEQ ID NO: 67377 - DNA, 22 bp, Homo sapiens
tcgatccccggcatctccacca

SEQ ID NO: 67378 - DNA, 22 bp, Homo sapiens
tcgattcccggccaatgcacca

SEQ ID NO: 67379 - DNA, 24 bp, Homo sapiens
gacaacattcaaaaaagagtacca

SEQ ID NO: 67380 - DNA, 29 bp, Homo sapiens
cggctagctcagtcggtagagcatgagac

SEQ ID NO: 67381 - DNA, 28 bp, Homo sapiens
accggagatgaaaacctttttccaagga

SEQ ID NO: 67382 - DNA, 22 bp, Homo sapiens
tcgattcccgggcggcgcacca

SEQ ID NO: 67383 - DNA, 30 bp, Homo sapiens; identical to SEQ ID NO: 66254

SEQ ID NO: 67384 - DNA, 36 bp, Homo sapiens; identical to SEQ ID NO: 66384

SEQ ID NO: 67385 - DNA, 18 bp, Homo sapiens
ttcccgggcggcgcacca

SEQ ID NO: 67386 - DNA, 30 bp, Homo sapiens; identical to SEQ ID NO: 66260

SEQ ID NO: 67387 - DNA, 16 bp, Homo sapiens
ccggctcgaaggacca

SEQ ID NO: 67388 - DNA, 25 bp, Homo sapiens
ggttcgattccccgacggggagcca

SEQ ID NO: 67389 - DNA, 32 bp, Homo sapiens; identical to SEQ ID NO: 66290

SEQ ID NO: 67390 - DNA, 40 bp, Homo sapiens; identical to SEQ ID NO: 66308

SEQ ID NO: 67391 - DNA, 26 bp, Homo sapiens
gggctcacatcaccccataaacacca

SEQ ID NO: 67392 - DNA, 16 bp, Homo sapiens
gagcccggtaatcgca

SEQ ID NO: 67393 - DNA, 29 bp, Homo sapiens
caaagcaatacactgaaaatgtttagacg

SEQ ID NO: 67394 - DNA, 18 bp, Homo sapiens
atcccagtagagcctcca

SEQ ID NO: 67395 - DNA, 18 bp, Homo sapiens
gtccgtgcgagaatacca

SEQ ID NO: 67396 - DNA, 19 bp, Homo sapiens
atccccggcatctccacca

SEQ ID NO: 67397 - DNA, 34 bp, Homo sapiens; identical to SEQ ID NO: 66354

SEQ ID NO: 67398 - DNA, 18 bp, Homo sapiens
atcccaccagagtcgcca

SEQ ID NO: 67399 - DNA, 27 bp, Homo sapiens
gtggttgtagtccgtgcgagaatacca

SEQ ID NO: 67400 - DNA, 34 bp, Homo sapiens; identical to SEQ ID NO: 66215

SEQ ID NO: 67401 - DNA, 36 bp, Homo sapiens; identical to SEQ ID NO: 66304

SEQ ID NO: 67402 - DNA, 17 bp, Homo sapiens
tccccggcacctccacc

SEQ ID NO: 67403 - DNA, 18 bp, Homo sapiens
atcccatcctcgtcgcca

SEQ ID NO: 67404 - DNA, 18 bp, Homo sapiens
atccaggtgccccctcca

SEQ ID NO: 67405 - DNA, 38 bp, Homo sapiens; identical to SEQ ID NO: 66208

SEQ ID NO: 67406 - DNA, 39 bp, Homo sapiens; identical to SEQ ID NO: 66296

SEQ ID NO: 67407 - DNA, 39 bp, Homo sapiens; identical to SEQ ID NO: 66311

SEQ ID NO: 67408 - DNA, 29 bp, Homo sapiens
ccggctagctcagtcggtagagcatggga

SEQ ID NO: 67409 - DNA, 36 bp, Homo sapiens; identical to SEQ ID NO: 66305

SEQ ID NO: 67410 - DNA, 43 bp, Homo sapiens; identical to SEQ ID NO: 66261

SEQ ID NO: 67411 - DNA, 26 bp, Homo sapiens
gagcttaaacccccttatttctacca

SEQ ID NO: 67412 - DNA, 17 bp, Homo sapiens
ccccgacacctccacca

SEQ ID NO: 67413 - DNA, 37 bp, Homo sapiens; identical to SEQ ID NO: 66429

SEQ ID NO: 67414 - DNA, 18 bp, Homo sapiens
gaccccttatttacccca

SEQ ID NO: 67415 - DNA, 22 bp, Homo sapiens
tcaaatcccggacgagccccca

SEQ ID NO: 67416 - DNA, 17 bp, Homo sapiens
ccccagtacctccacca

SEQ ID NO: 67417 - DNA, 43 bp, Homo sapiens; identical to SEQ ID NO: 66219

SEQ ID NO: 67418 - DNA, 32 bp, Homo sapiens; identical to SEQ ID NO: 66263

SEQ ID NO: 67419 - DNA, 16 bp, Homo sapiens
accggagatgaaaacc

SEQ ID NO: 67420 - DNA, 40 bp, Homo sapiens; identical to SEQ ID NO: 66264

SEQ ID NO: 67421 - DNA, 18 bp, Homo sapiens
ttcccggccaacgcacca

SEQ ID NO: 67422 - DNA, 28 bp, Homo sapiens
cggatagctcagtcggtagagcatcaga

SEQ ID NO: 67423 - DNA, 35 bp, Homo sapiens; identical to SEQ ID NO: 66270

SEQ ID NO: 67424 - DNA, 41 bp, Homo sapiens; identical to SEQ ID NO: 66302

SEQ ID NO: 67425 - DNA, 19 bp, Homo sapiens
atccccagtacctccacca

SEQ ID NO: 67426 - DNA, 18 bp, Homo sapiens
gtcccaccagagtcgcca

SEQ ID NO: 67427 - DNA, 23 bp, Homo sapiens
acttaacttgaccgctctgacca

SEQ ID NO: 67428 - DNA, 30 bp, Homo sapiens; identical to SEQ ID NO: 66337

SEQ ID NO: 67429 - DNA, 40 bp, Homo sapiens; identical to SEQ ID NO: 66361

SEQ ID NO: 67430 - DNA, 31 bp, Homo sapiens; identical to SEQ ID NO: 66395

SEQ ID NO: 67431 - DNA, 24 bp, Homo sapiens
accaacacctctttacagtgacca

SEQ ID NO: 67432 - DNA, 16 bp, Homo sapiens
cctgccgactacgcca

SEQ ID NO: 67433 - DNA, 16 bp, Homo sapiens
ccgggcagaagcacca

SEQ ID NO: 67434 - DNA, 18 bp, Homo sapiens
accctgctcgctgcgcca

SEQ ID NO: 67435 - DNA, 19 bp, Homo sapiens
gagaaagctcacaagaact

SEQ ID NO: 67436 - DNA, 29 bp, Homo sapiens
ccggctagctcagtcggtagagcatgaga

SEQ ID NO: 67437 - DNA, 26 bp, Homo sapiens
gagaaagctcacaagaactgctaact

SEQ ID NO: 67438 - DNA, 23 bp, Homo sapiens
ccaacacctctttacagtgacca

SEQ ID NO: 67439 - DNA, 35 bp, Homo sapiens; identical to SEQ ID NO: 66371

SEQ ID NO: 67440 - DNA, 44 bp, Homo sapiens; identical to SEQ ID NO: 66233

SEQ ID NO: 67441 - DNA, 33 bp, Homo sapiens; identical to SEQ ID NO: 66298

SEQ ID NO: 67442 - DNA, 22 bp, Homo sapiens
tcaatccccggcatctccacca

SEQ ID NO: 67443 - DNA, 20 bp, Homo sapiens
aacacctctttacagtgacc

SEQ ID NO: 67444 - DNA, 37 bp, Homo sapiens; identical to SEQ ID NO: 66355

SEQ ID NO: 67445 - DNA, 22 bp, Homo sapiens
gagaaagctcacaagaactgct

SEQ ID NO: 67446 - DNA, 34 bp, Homo sapiens; identical to SEQ ID NO: 66336

SEQ ID NO: 67447 - DNA, 24 bp, Homo sapiens
gttgtagtccgtgcgagaatacca

SEQ ID NO: 67448 - DNA, 24 bp, Homo sapiens
ggctcacatcaccccataaacacc

SEQ ID NO: 67449 - DNA, 18 bp, Homo sapiens
catcaccccataaacacc

SEQ ID NO: 67450 - DNA, 26 bp, Homo sapiens
gaaccaacacctctttacagtgacca

SEQ ID NO: 67451 - DNA, 19 bp, Homo sapiens
cgaccccttatttacccca

SEQ ID NO: 67452 - DNA, 17 bp, Homo sapiens
agcccggtaatcgcata

SEQ ID NO: 67453 - DNA, 27 bp, Homo sapiens
agaaccaacacctctttacagtgacca

SEQ ID NO: 67454 - DNA, 33 bp, Homo sapiens; identical to SEQ ID NO: 66285

SEQ ID NO: 67455 - DNA, 34 bp, Homo sapiens; identical to SEQ ID NO: 66314

SEQ ID NO: 67456 - DNA, 19 bp, Homo sapiens
gccccagtggcctaatgga

SEQ ID NO: 67457 - DNA, 38 bp, Homo sapiens; identical to SEQ ID NO: 66373

SEQ ID NO: 67458 - DNA, 20 bp, Homo sapiens
acattcaaaaaagagtacca

SEQ ID NO: 67459 - DNA, 25 bp, Homo sapiens
gcccggctagctcagtcggtagagc

SEQ ID NO: 67460 - DNA, 20 bp, Homo sapiens
gcaatacttaatttctgcca

SEQ ID NO: 67461 - DNA, 17 bp, Homo sapiens
tccccggcatctccacc

SEQ ID NO: 67462 - DNA, 21 bp, Homo sapiens
caatccccggcacctccacca

SEQ ID NO: 67463 - DNA, 23 bp, Homo sapiens
acaacattcaaaaaagagtacca

SEQ ID NO: 67464 - DNA, 22 bp, Homo sapiens
tcgatccccagtacctccacca

SEQ ID NO: 67465 - DNA, 32 bp, Homo sapiens; identical to SEQ ID NO: 66196

SEQ ID NO: 67466 - DNA, 33 bp, Homo sapiens; identical to SEQ ID NO: 66442

SEQ ID NO: 67467 - DNA, 18 bp, Homo sapiens
acctcagagggggcacca

SEQ ID NO: 67468 - DNA, 36 bp, Homo sapiens; identical to SEQ ID NO: 66366

SEQ ID NO: 67469 - DNA, 17 bp, Homo sapiens
ccccgtccgtgcctcca

SEQ ID NO: 67470 - DNA, 37 bp, Homo sapiens; identical to SEQ ID NO: 66520

SEQ ID NO: 67471 - DNA, 40 bp, Homo sapiens; identical to SEQ ID NO: 66369

SEQ ID NO: 67472 - DNA, 22 bp, Homo sapiens
tcacatcaccccataaacacca

SEQ ID NO: 67473 - DNA, 29 bp, Homo sapiens
gacgggctcacatcaccccataaacacca

SEQ ID NO: 67474 - DNA, 18 bp, Homo sapiens
tcccacccagggacgcca

SEQ ID NO: 67475 - DNA, 30 bp, Homo sapiens; identical to SEQ ID NO: 66397

SEQ ID NO: 67476 - DNA, 36 bp, Homo sapiens; identical to SEQ ID NO: 66333

SEQ ID NO: 67477 - DNA, 32 bp, Homo sapiens; identical to SEQ ID NO: 66350

SEQ ID NO: 67478 - DNA, 22 bp, Homo sapiens
tcgaatcccactcctgacacca

SEQ ID NO: 67479 - DNA, 16 bp, Homo sapiens
ccgtgcgagaatacca

SEQ ID NO: 67480 - DNA, 26 bp, Homo sapiens
aggcttacgaccccttatttacccca

SEQ ID NO: 67481 - DNA, 22 bp, Homo sapiens
tcaatccccagcacctccacca

SEQ ID NO: 67482 - DNA, 36 bp, Homo sapiens; identical to SEQ ID NO: 66327

SEQ ID NO: 67483 - DNA, 17 bp, Homo sapiens
tcccggccaacgcacca

SEQ ID NO: 67484 - DNA, 30 bp, Homo sapiens; identical to SEQ ID NO: 66426

SEQ ID NO: 67485 - DNA, 30 bp, Homo sapiens; identical to SEQ ID NO: 66300

SEQ ID NO: 67486 - DNA, 21 bp, Homo sapiens
tacgaccccttatttacccca

SEQ ID NO: 67487 - DNA, 25 bp, Homo sapiens
ggggttaggcctctttttaccacca

SEQ ID NO: 67488 - DNA, 38 bp, Homo sapiens; identical to SEQ ID NO: 66504

SEQ ID NO: 67489 - DNA, 29 bp, Homo sapiens
ccggatagctcagtcggtagagcatcaga

SEQ ID NO: 67490 - DNA, 23 bp, Homo sapiens
gttgcaatacttaatttctgcca

SEQ ID NO: 67491 - DNA, 19 bp, Homo sapiens
agtccgtgcgagaatacca

SEQ ID NO: 67492 - DNA, 30 bp, Homo sapiens; identical to SEQ ID NO: 66372

SEQ ID NO: 67493 - DNA, 25 bp, Homo sapiens
tccattggggtttccccgcgcaggt

SEQ ID NO: 67494 - DNA, 39 bp, Homo sapiens; identical to SEQ ID NO: 66273

SEQ ID NO: 67495 - DNA, 33 bp, Homo sapiens; identical to SEQ ID NO: 66200

SEQ ID NO: 67496 - DNA, 17 bp, Homo sapiens
acgcgggagaccggggt

SEQ ID NO: 67497 - DNA, 36 bp, Homo sapiens; identical to SEQ ID NO: 66312

SEQ ID NO: 67498 - DNA, 33 bp, Homo sapiens; identical to SEQ ID NO: 66359

SEQ ID NO: 67499 - DNA, 29 bp, Homo sapiens
aaccggagatgaaaacctttttccaagga

SEQ ID NO: 67500 - DNA, 36 bp, Homo sapiens; identical to SEQ ID NO: 66376

SEQ ID NO: 67501 - DNA, 22 bp, Homo sapiens
tcgactcccggtgtgggaacca

SEQ ID NO: 67502 - DNA, 46 bp, Homo sapiens; identical to SEQ ID NO: 66248

SEQ ID NO: 67503 - DNA, 22 bp, Homo sapiens
caacacctctttacagtgacca

SEQ ID NO: 67504 - DNA, 24 bp, Homo sapiens
agttgcaatacttaatttctgcca

SEQ ID NO: 67505 - DNA, 41 bp, Homo sapiens; identical to SEQ ID NO: 66294

SEQ ID NO: 67506 - DNA, 24 bp, Homo sapiens
aacttaacttgaccgctctgacca

SEQ ID NO: 67507 - DNA, 17 bp, Homo sapiens
tccgtgcgagaatacca

SEQ ID NO: 67508 - DNA, 27 bp, Homo sapiens
atgtctaacaacatggctttctcacca

SEQ ID NO: 67509 - DNA, 21 bp, Homo sapiens
cgatccccggcatctccacca

SEQ ID NO: 67510 - DNA, 34 bp, Homo sapiens; identical to SEQ ID NO: 66466

SEQ ID NO: 67511 - DNA, 18 bp, Homo sapiens
acttgaccgctctgacca

SEQ ID NO: 67512 - DNA, 21 bp, Homo sapiens
aacaacatggctttctcacca

SEQ ID NO: 67513 - DNA, 35 bp, Homo sapiens; identical to SEQ ID NO: 66436

SEQ ID NO: 67514 - DNA, 19 bp, Homo sapiens
acacctctttacagtgacc

SEQ ID NO: 67515 - DNA, 36 bp, Homo sapiens; identical to SEQ ID NO: 66329

SEQ ID NO: 67516 - DNA, 26 bp, Homo sapiens
gcccggctagctcagtcggtagagca

SEQ ID NO: 67517 - DNA, 18 bp, Homo sapiens
atccggctcggaggacca

SEQ ID NO: 67518 - DNA, 17 bp, Homo sapiens
tccccagtacctccacc

SEQ ID NO: 67519 - DNA, 31 bp, Homo sapiens; identical to SEQ ID NO: 66411

SEQ ID NO: 67520 - DNA, 34 bp, Homo sapiens; identical to SEQ ID NO: 66545

SEQ ID NO: 67521 - DNA, 25 bp, Homo sapiens
aaccaacacctctttacagtgacca

SEQ ID NO: 67522 - DNA, 24 bp, Homo sapiens
gggttaggcctctttttaccacca

SEQ ID NO: 67523 - DNA, 18 bp, Homo sapiens
ggcctctttttaccacca

SEQ ID NO: 67524 - DNA, 17 bp, Homo sapiens
tcccggcggagtcgcca

SEQ ID NO: 67525 - DNA, 24 bp, Homo sapiens
ggttatacccttcccgtactacca

SEQ ID NO: 67526 - DNA, 37 bp, Homo sapiens; identical to SEQ ID NO: 66313

SEQ ID NO: 67527 - DNA, 32 bp, Homo sapiens; identical to SEQ ID NO: 66284

SEQ ID NO: 67528 - DNA, 35 bp, Homo sapiens; identical to SEQ ID NO: 66409

SEQ ID NO: 67529 - DNA, 42 bp, Homo sapiens; identical to SEQ ID NO: 66325

SEQ ID NO: 67530 - DNA, 31 bp, Homo sapiens; identical to SEQ ID NO: 66276

SEQ ID NO: 67531 - DNA, 22 bp, Homo sapiens
tcgaatcccagcggtgcctcca

SEQ ID NO: 67532 - DNA, 45 bp, Homo sapiens; identical to SEQ ID NO: 66324

SEQ ID NO: 67533 - DNA, 20 bp, Homo sapiens
acgaccccttatttacccca

SEQ ID NO: 67534 - DNA, 16 bp, Homo sapiens
gggtatgattctcggt

SEQ ID NO: 67535 - DNA, 24 bp, Homo sapiens
gtcgtggttgtagtccgtgcgaga

SEQ ID NO: 67536 - DNA, 32 bp, Homo sapiens; identical to SEQ ID NO: 66473

SEQ ID NO: 67537 - DNA, 34 bp, Homo sapiens; identical to SEQ ID NO: 66527

SEQ ID NO: 67538 - DNA, 37 bp, Homo sapiens; identical to SEQ ID NO: 66493

SEQ ID NO: 67539 - DNA, 30 bp, Homo sapiens; identical to SEQ ID NO: 66358

SEQ ID NO: 67540 - DNA, 21 bp, Homo sapiens
gtagtccgtgcgagaatacca

SEQ ID NO: 67541 - DNA, 26 bp, Homo sapiens
tggttgtagtccgtgcgagaatacca

SEQ ID NO: 67542 - DNA, 31 bp, Homo sapiens; identical to SEQ ID NO: 66456

SEQ ID NO: 67543 - DNA, 26 bp, Homo sapiens
gaggcttacgaccccttatttacccc

SEQ ID NO: 67544 - DNA, 30 bp, Homo sapiens; identical to SEQ ID NO: 66576

SEQ ID NO: 67545 - DNA, 41 bp, Homo sapiens; identical to SEQ ID NO: 66455

SEQ ID NO: 67546 - DNA, 30 bp, Homo sapiens; identical to SEQ ID NO: 66435

SEQ ID NO: 67547 - DNA, 30 bp, Homo sapiens; identical to SEQ ID NO: 66560

SEQ ID NO: 67548 - DNA, 18 bp, Homo sapiens
ctcccggtatgggaacca

SEQ ID NO: 67549 - DNA, 26 bp, Homo sapiens
tcaacttaacttgaccgctctgacca

SEQ ID NO: 67550 - DNA, 18 bp, Homo sapiens
tgcccgcattctccacca

SEQ ID NO: 67551 - DNA, 38 bp, Homo sapiens; identical to SEQ ID NO: 66408

SEQ ID NO: 67552 - DNA, 37 bp, Homo sapiens; identical to SEQ ID NO: 66415

SEQ ID NO: 67553 - DNA, 18 bp, Homo sapiens
ctcccagtggggcctcca

SEQ ID NO: 67554 - DNA, 18 bp, Homo sapiens
gtcacgtcggggtcacca

SEQ ID NO: 67555 - DNA, 31 bp, Homo sapiens; identical to SEQ ID NO: 66530

SEQ ID NO: 67556 - DNA, 27 bp, Homo sapiens
gatgaaaacctttttccaaggacacca

SEQ ID NO: 67557 - DNA, 16 bp, Homo sapiens
tccgggtgccccctcc

SEQ ID NO: 67558 - DNA, 33 bp, Homo sapiens; identical to SEQ ID NO: 66570

SEQ ID NO: 67559 - DNA, 35 bp, Homo sapiens; identical to SEQ ID NO: 66595

SEQ ID NO: 67560 - DNA, 24 bp, Homo sapiens
gttcgattccccgacggggagcca

SEQ ID NO: 67561 - DNA, 18 bp, Homo sapiens
acgcgaaaggtccccggt

SEQ ID NO: 67562 - DNA, 17 bp, Homo sapiens
atcatatttaccaacca

SEQ ID NO: 67563 - DNA, 25 bp, Homo sapiens
ggcttacgaccccttatttacccca

SEQ ID NO: 67564 - DNA, 37 bp, Homo sapiens; identical to SEQ ID NO: 66564

SEQ ID NO: 67565 - DNA, 24 bp, Homo sapiens
gcttacgaccccttatttacccca

SEQ ID NO: 67566 - DNA, 16 bp, Homo sapiens
ccccttatttacccca

SEQ ID NO: 67567 - DNA, 23 bp, Homo sapiens
ctcacatcaccccataaacacca

SEQ ID NO: 67568 - DNA, 32 bp, Homo sapiens; identical to SEQ ID NO: 66491

SEQ ID NO: 67569 - DNA, 42 bp, Homo sapiens; identical to SEQ ID NO: 66306

SEQ ID NO: 67570 - DNA, 23 bp, Homo sapiens
ctgtcacgcgggagaccggggtt

SEQ ID NO: 67571 - DNA, 30 bp, Homo sapiens; identical to SEQ ID NO: 66754

SEQ ID NO: 67572 - DNA, 22 bp, Homo sapiens
tcgatccccggcacctccacca

SEQ ID NO: 67573 - DNA, 29 bp, Homo sapiens
gtccttgtagtataaactaatacaccagt

SEQ ID NO: 67574 - DNA, 34 bp, Homo sapiens; identical to SEQ ID NO: 66589

SEQ ID NO: 67575 - DNA, 17 bp, Homo sapiens
tccggctcggaggacca

SEQ ID NO: 67576 - DNA, 29 bp, Homo sapiens
ggagatgaaaacctttttccaaggacacc

SEQ ID NO: 67577 - DNA, 17 bp, Homo sapiens
aaccggagatgaaaacc

SEQ ID NO: 67578 - DNA, 22 bp, Homo sapiens
tcgaatcccagcggggcctcca

SEQ ID NO: 67579 - DNA, 38 bp, Homo sapiens; identical to SEQ ID NO: 66575

SEQ ID NO: 67580 - DNA, 23 bp, Homo sapiens
gttatacccttcccgtactacca

SEQ ID NO: 67581 - DNA, 39 bp, Homo sapiens; identical to SEQ ID NO: 66445

SEQ ID NO: 67582 - DNA, 22 bp, Homo sapiens
tcgattccccgacggggagcca

SEQ ID NO: 67583 - DNA, 25 bp, Homo sapiens
gagcccggtaatcgcataaaactta

SEQ ID NO: 67584 - DNA, 28 bp, Homo sapiens
acgggctcacatcaccccataaacacca

SEQ ID NO: 67585 - DNA, 16 bp, Homo sapiens
ggtagcgtggccgagc

SEQ ID NO: 67586 - DNA, 33 bp, Homo sapiens; identical to SEQ ID NO: 66682

SEQ ID NO: 67587 - DNA, 25 bp, Homo sapiens
ggttgtagtccgtgcgagaatacca

SEQ ID NO: 67588 - DNA, 18 bp, Homo sapiens
ttccggctcgaaggacca

SEQ ID NO: 67589 - DNA, 18 bp, Homo sapiens
ttccccgacggggagcca

SEQ ID NO: 67590 - DNA, 21 bp, Homo sapiens
cgattccccgacggggagcca

SEQ ID NO: 67591 - DNA, 35 bp, Homo sapiens; identical to SEQ ID NO: 66432

SEQ ID NO: 67592 - DNA, 30 bp, Homo sapiens; identical to SEQ ID NO: 66555

SEQ ID NO: 67593 - DNA, 32 bp, Homo sapiens; identical to SEQ ID NO: 66714

SEQ ID NO: 67594 - DNA, 42 bp, Homo sapiens; identical to SEQ ID NO: 66446

SEQ ID NO: 67595 - DNA, 30 bp, Homo sapiens; identical to SEQ ID NO: 66644

SEQ ID NO: 67596 - DNA, 29 bp, Homo sapiens
cagaggcttacgaccccttatttacccca

SEQ ID NO: 67597 - DNA, 19 bp, Homo sapiens
aacttgaccgctctgacca

SEQ ID NO: 67598 - DNA, 42 bp, Homo sapiens; identical to SEQ ID NO: 66486

SEQ ID NO: 67599 - DNA, 38 bp, Homo sapiens; identical to SEQ ID NO: 66565

SEQ ID NO: 67600 - DNA, 22 bp, Homo sapiens
tcgaatcccacttctgacacca

SEQ ID NO: 67601 - DNA, 42 bp, Homo sapiens; identical to SEQ ID NO: 66418

SEQ ID NO: 67602 - DNA, 19 bp, Homo sapiens
cacctctttacagtgacca

SEQ ID NO: 67603 - DNA, 17 bp, Homo sapiens
gcccggctagctcagtc

SEQ ID NO: 67604 - DNA, 36 bp, Homo sapiens; identical to SEQ ID NO: 66678

SEQ ID NO: 67605 - DNA, 31 bp, Homo sapiens; identical to SEQ ID NO: 66463

SEQ ID NO: 67606 - DNA, 36 bp, Homo sapiens; identical to SEQ ID NO: 66348

SEQ ID NO: 67607 - DNA, 22 bp, Homo sapiens
tcaagtccctgttcgggcgcca

SEQ ID NO: 67608 - DNA, 27 bp, Homo sapiens
ggctagctcagtcggtagagcatggga

SEQ ID NO: 67609 - DNA, 27 bp, Homo sapiens
cggctagctcagtcggtagagcatggg

SEQ ID NO: 67610 - DNA, 34 bp, Homo sapiens; identical to SEQ ID NO: 66338

SEQ ID NO: 67611 - DNA, 38 bp, Homo sapiens; identical to SEQ ID NO: 66441

SEQ ID NO: 67612 - DNA, 35 bp, Homo sapiens; identical to SEQ ID NO: 66631

SEQ ID NO: 67613 - DNA, 22 bp, Homo sapiens
caacattcaaaaaagagtacca

SEQ ID NO: 67614 - DNA, 29 bp, Homo sapiens
ccgaaaatgttggttatacccttcccgta

SEQ ID NO: 67615 - DNA, 31 bp, Homo sapiens; identical to SEQ ID NO: 66478

SEQ ID NO: 67616 - DNA, 27 bp, Homo sapiens
ggagcttaaacccccttatttctacca

SEQ ID NO: 67617 - DNA, 39 bp, Homo sapiens; identical to SEQ ID NO: 66506

SEQ ID NO: 67618 - DNA, 28 bp, Homo sapiens
ggagaccggggttcgattccccgacggg

SEQ ID NO: 67619 - DNA, 22 bp, Homo sapiens
ggtcgtggttgtagtccgtgcg

SEQ ID NO: 67620 - DNA, 18 bp, Homo sapiens
aggggtatgattctcggt

SEQ ID NO: 67621 - DNA, 33 bp, Homo sapiens; identical to SEQ ID NO: 66301

SEQ ID NO: 67622 - DNA, 33 bp, Homo sapiens; identical to SEQ ID NO: 66297

SEQ ID NO: 67623 - DNA, 28 bp, Homo sapiens
ggattcggcgctctcaccgccgcggccc

SEQ ID NO: 67624 - DNA, 26 bp, Homo sapiens
gcccggatagctcagtcggtagagca

SEQ ID NO: 67625 - DNA, 30 bp, Homo sapiens; identical to SEQ ID NO: 66406

SEQ ID NO: 67626 - DNA, 32 bp, Homo sapiens; identical to SEQ ID NO: 66781

SEQ ID NO: 67627 - DNA, 30 bp, Homo sapiens; identical to SEQ ID NO: 66541

SEQ ID NO: 67628 - DNA, 19 bp, Homo sapiens
aggcctctttttaccacca

SEQ ID NO: 67629 - DNA, 33 bp, Homo sapiens; identical to SEQ ID NO: 66674

SEQ ID NO: 67630 - DNA, 32 bp, Homo sapiens; identical to SEQ ID NO: 66516

SEQ ID NO: 67631 - DNA, 19 bp, Homo sapiens
gaccgcgtggcctaatgga

SEQ ID NO: 67632 - DNA, 21 bp, Homo sapiens
tgtcacgcgggagaccggggt

SEQ ID NO: 67633 - DNA, 34 bp, Homo sapiens; identical to SEQ ID NO: 66593

SEQ ID NO: 67634 - DNA, 37 bp, Homo sapiens; identical to SEQ ID NO: 66487

SEQ ID NO: 67635 - DNA, 18 bp, Homo sapiens
agtggttagtatccccgc

SEQ ID NO: 67636 - DNA, 25 bp, Homo sapiens
ggttcaatccccggcacctccacca

SEQ ID NO: 67637 - DNA, 36 bp, Homo sapiens; identical to SEQ ID NO: 66532

SEQ ID NO: 67638 - DNA, 23 bp, Homo sapiens
gaaaatgtttagacgggctcaca

SEQ ID NO: 67639 - DNA, 31 bp, Homo sapiens; identical to SEQ ID NO: 66262

SEQ ID NO: 67640 - DNA, 22 bp, Homo sapiens
tcgagccccagtggaaccacca

SEQ ID NO: 67641 - DNA, 43 bp, Homo sapiens; identical to SEQ ID NO: 66410

SEQ ID NO: 67642 - DNA, 39 bp, Homo sapiens; identical to SEQ ID NO: 66661

SEQ ID NO: 67643 - DNA, 30 bp, Homo sapiens; identical to SEQ ID NO: 66691

SEQ ID NO: 67644 - DNA, 18 bp, Homo sapiens
acgcgggagaccggggtt

SEQ ID NO: 67645 - DNA, 22 bp, Homo sapiens
tcaaatccgggtgccccctcca

SEQ ID NO: 67646 - DNA, 18 bp, Homo sapiens
tcctcgctggggcctcca

SEQ ID NO: 67647 - DNA, 28 bp, Homo sapiens
catgtctaacaacatggctttctcacca

SEQ ID NO: 67648 - DNA, 19 bp, Homo sapiens
caatacttaatttctgcca

SEQ ID NO: 67649 - DNA, 35 bp, Homo sapiens; identical to SEQ ID NO: 66708

SEQ ID NO: 67650 - DNA, 35 bp, Homo sapiens; identical to SEQ ID NO: 66592

SEQ ID NO: 67651 - DNA, 31 bp, Homo sapiens
ccccatgtctaacaacatggctttctcacca

SEQ ID NO: 67652 - DNA, 18 bp, Homo sapiens
gtcccggcggagtcgcca

SEQ ID NO: 67653 - DNA, 20 bp, Homo sapiens
acaacatggctttctcacca

SEQ ID NO: 67654 - DNA, 22 bp, Homo sapiens
tcacacgcgaaaggtccccggt

SEQ ID NO: 67655 - DNA, 39 bp, Homo sapiens; identical to SEQ ID NO: 66736

SEQ ID NO: 67656 - DNA, 29 bp, Homo sapiens
gcgccgctggtgtagtggtatcatgcaag

SEQ ID NO: 67657 - DNA, 18 bp, Homo sapiens
gtccctgtccaggcgcca

SEQ ID NO: 67658 - DNA, 40 bp, Homo sapiens; identical to SEQ ID NO: 66469

SEQ ID NO: 67659 - DNA, 37 bp, Homo sapiens; identical to SEQ ID NO: 66650

SEQ ID NO: 67660 - DNA, 32 bp, Homo sapiens; identical to SEQ ID NO: 66716

SEQ ID NO: 67661 - DNA, 30 bp, Homo sapiens; identical to SEQ ID NO: 66551

SEQ ID NO: 67662 - DNA, 29 bp, Homo sapiens
gcccggctagctcagtcggtagagcatga

SEQ ID NO: 67663 - DNA, 19 bp, Homo sapiens
atccccagcacctccacca

SEQ ID NO: 67664 - DNA, 27 bp, Homo sapiens
aagcaatacactgaaaatgtttagacg

SEQ ID NO: 67665 - DNA, 23 bp, Homo sapiens
gtcgtggttgtagtccgtgcgag

SEQ ID NO: 67666 - DNA, 19 bp, Homo sapiens
gaccacgtggcctaatgga

SEQ ID NO: 67667 - DNA, 27 bp, Homo sapiens
gagaaagctcacaagaactgctaactc

SEQ ID NO: 67668 - DNA, 17 bp, Homo sapiens
tctcggtggaacctcca

SEQ ID NO: 67669 - DNA, 16 bp, Homo sapiens
gcccggtaatcgcata

SEQ ID NO: 67670 - DNA, 31 bp, Homo sapiens; identical to SEQ ID NO: 66477

SEQ ID NO: 67671 - DNA, 33 bp, Homo sapiens; identical to SEQ ID NO: 66621

SEQ ID NO: 67672 - DNA, 21 bp, Homo sapiens
cgattcccggccaacgcacca

SEQ ID NO: 67673 - DNA, 16 bp, Homo sapiens
tccccggcacctccac

SEQ ID NO: 67674 - DNA, 39 bp, Homo sapiens; identical to SEQ ID NO: 66266

SEQ ID NO: 67675 - DNA, 17 bp, Homo sapiens
agtggttagtatccccg

SEQ ID NO: 67676 - DNA, 24 bp, Homo sapiens
ccttccaagcagttgacccgggtt

SEQ ID NO: 67677 - DNA, 18 bp, Homo sapiens
atcccaccctcgtcgcca

SEQ ID NO: 67678 - DNA, 22 bp, Homo sapiens
tcgatgcccgcatcctccacca

SEQ ID NO: 67679 - DNA, 17 bp, Homo sapiens
acagaggcttacgaccc

SEQ ID NO: 67680 - DNA, 24 bp, Homo sapiens
cctgtcacgcgggagaccggggtt

SEQ ID NO: 67681 - DNA, 31 bp, Homo sapiens
gacccgggttcgattcccggccaacgcacca

SEQ ID NO: 67682 - DNA, 38 bp, Homo sapiens; identical to SEQ ID NO: 66744

SEQ ID NO: 67683 - DNA, 28 bp, Homo sapiens
cgtggttgtagtccgtgcgagaatacca

SEQ ID NO: 67684 - DNA, 18 bp, Homo sapiens
ctcccggtgtgggaacca

SEQ ID NO: 67685 - DNA, 19 bp, Homo sapiens
caacatggctttctcacca

SEQ ID NO: 67686 - DNA, 37 bp, Homo sapiens; identical to SEQ ID NO: 66549

SEQ ID NO: 67687 - DNA, 35 bp, Homo sapiens
agcattaaccttttaagttaaagattaagagaacc

SEQ ID NO: 67688 - DNA, 20 bp, Homo sapiens
aactccaaataaaagtacca

SEQ ID NO: 67689 - DNA, 19 bp, Homo sapiens
gagcccggtaatcgcataa

SEQ ID NO: 67690 - DNA, 31 bp, Homo sapiens
gacaacagaggcttacgaccccttatttacc

SEQ ID NO: 67691 - DNA, 18 bp, Homo sapiens
aaccgggcagaagcacca

SEQ ID NO: 67692 - DNA, 21 bp, Homo sapiens
gagaaagctcacaagaactgc

SEQ ID NO: 67693 - DNA, 25 bp, Homo sapiens
gtctaacaacatggctttctcacca

SEQ ID NO: 67694 - DNA, 23 bp, Homo sapiens
ctaacaacatggctttctcacca

SEQ ID NO: 67695 - DNA, 32 bp, Homo sapiens; identical to SEQ ID NO: 66517

SEQ ID NO: 67696 - DNA, 23 bp, Homo sapiens
gctcacatcaccccataaacacc

SEQ ID NO: 67697 - DNA, 21 bp, Homo sapiens
gtcgtggttgtagtccgtgcg

SEQ ID NO: 67698 - DNA, 24 bp, Homo sapiens
caacttaacttgaccgctctgacc

SEQ ID NO: 67699 - DNA, 27 bp, Homo sapiens
cgggctcacatcaccccataaacacca

SEQ ID NO: 67700 - DNA, 31 bp, Homo sapiens; identical to SEQ ID NO: 66632

SEQ ID NO: 67701 - DNA, 21 bp, Homo sapiens
caactccaaataaaagtacca

SEQ ID NO: 67702 - DNA, 20 bp, Homo sapiens
ctaagccagggattgtgggt

SEQ ID NO: 67703 - DNA, 18 bp, Homo sapiens
gtggttgtagtccgtgcg

SEQ ID NO: 67704 - DNA, 18 bp, Homo sapiens
atcccaccttcgtcgcca

SEQ ID NO: 67705 - DNA, 28 bp, Homo sapiens
gagaaccaacacctctttacagtgacca

SEQ ID NO: 67706 - DNA, 33 bp, Homo sapiens; identical to SEQ ID NO: 66439

SEQ ID NO: 67707 - DNA, 38 bp, Homo sapiens; identical to SEQ ID NO: 66293

SEQ ID NO: 67708 - DNA, 32 bp, Homo sapiens; identical to SEQ ID NO: 66786

SEQ ID NO: 67709 - DNA, 19 bp, Homo sapiens
gcccggatagctcagtcgg

SEQ ID NO: 67710 - DNA, 35 bp, Homo sapiens; identical to SEQ ID NO: 66646

SEQ ID NO: 67711 - DNA, 16 bp, Homo sapiens
accgggcggaaacacc

SEQ ID NO: 67712 - DNA, 29 bp, Homo sapiens
ccgtgatcgtatagtggttagtactctgc

SEQ ID NO: 67713 - DNA, 31 bp, Homo sapiens; identical to SEQ ID NO: 66315

SEQ ID NO: 67714 - DNA, 45 bp, Homo sapiens; identical to SEQ ID NO: 66310

SEQ ID NO: 67715 - DNA, 30 bp, Homo sapiens; identical to SEQ ID NO: 66636

SEQ ID NO: 67716 - DNA, 22 bp, Homo sapiens
tcgatccccgtacgggccacca

SEQ ID NO: 67717 - DNA, 36 bp, Homo sapiens; identical to SEQ ID NO: 66529

SEQ ID NO: 67718 - DNA, 34 bp, Homo sapiens
gaccaagagccttcaaagccctcagtaagttgca

SEQ ID NO: 67719 - DNA, 38 bp, Homo sapiens; identical to SEQ ID NO: 66668

SEQ ID NO: 67720 - DNA, 33 bp, Homo sapiens; identical to SEQ ID NO: 66417

SEQ ID NO: 67721 - DNA, 38 bp, Homo sapiens; identical to SEQ ID NO: 66511

SEQ ID NO: 67722 - DNA, 20 bp, Homo sapiens
acacgcgaaaggtccccggt

SEQ ID NO: 67723 - DNA, 35 bp, Homo sapiens; identical to SEQ ID NO: 66814

SEQ ID NO: 67724 - DNA, 26 bp, Homo sapiens
cattggtcgtggttgtagtccgtgcg

SEQ ID NO: 67725 - DNA, 18 bp, Homo sapiens
atcccagcgaggcctcca

SEQ ID NO: 67726 - DNA, 34 bp, Homo sapiens; identical to SEQ ID NO: 66667

SEQ ID NO: 67727 - DNA, 33 bp, Homo sapiens; identical to SEQ ID NO: 66790

SEQ ID NO: 67728 - DNA, 44 bp, Homo sapiens; identical to SEQ ID NO: 66403

SEQ ID NO: 67729 - DNA, 26 bp, Homo sapiens
agcaatacactgaaaatgtttagacg

SEQ ID NO: 67730 - DNA, 17 bp, Homo sapiens
ccctgctcgctgcgcca

SEQ ID NO: 67731 - DNA, 25 bp, Homo sapiens
tgacaacattcaaaaaagagtacca

SEQ ID NO: 67732 - DNA, 43 bp, Homo sapiens; identical to SEQ ID NO: 66539

SEQ ID NO: 67733 - DNA, 23 bp, Homo sapiens
agaccggggttcgattccccgac

SEQ ID NO: 67734 - DNA, 23 bp, Homo sapiens
ggttccatagtgtagtggttatc

SEQ ID NO: 67735 - DNA, 28 bp, Homo sapiens
ggctagctcagtcggtagagcatgggac

SEQ ID NO: 67736 - DNA, 35 bp, Homo sapiens; identical to SEQ ID NO: 66573

SEQ ID NO: 67737 - DNA, 25 bp, Homo sapiens
agcttaaacccccttatttctacca

SEQ ID NO: 67738 - DNA, 16 bp, Homo sapiens
accccttatttacccc

SEQ ID NO: 67739 - DNA, 40 bp, Homo sapiens; identical to SEQ ID NO: 66578

SEQ ID NO: 67740 - DNA, 36 bp, Homo sapiens; identical to SEQ ID NO: 66536

SEQ ID NO: 67741 - DNA, 30 bp, Homo sapiens; identical to SEQ ID NO: 66712

SEQ ID NO: 67742 - DNA, 18 bp, Homo sapiens
aacatggctttctcacca

SEQ ID NO: 67743 - DNA, 18 bp, Homo sapiens
aatcatatttaccaacca

SEQ ID NO: 67744 - DNA, 29 bp, Homo sapiens
agcccggtaatcgcataaaacttaaaact

SEQ ID NO: 67745 - DNA, 28 bp, Homo sapiens
gcagagtggggttttgcagtccttacca

SEQ ID NO: 67746 - DNA, 25 bp, Homo sapiens
gagaaagctcacaagaactgctaac

SEQ ID NO: 67747 - DNA, 27 bp, Homo sapiens
gaccaagagccttcaaagccctcagta

SEQ ID NO: 67748 - DNA, 20 bp, Homo sapiens
cacatcaccccataaacacc

SEQ ID NO: 67749 - DNA, 29 bp, Homo sapiens
gacaggggttaggcctctttttaccacca

SEQ ID NO: 67750 - DNA, 33 bp, Homo sapiens; identical to SEQ ID NO: 66468

SEQ ID NO: 67751 - DNA, 28 bp, Homo sapiens
ggctagctcagtcggtagagcatgagac

SEQ ID NO: 67752 - DNA, 34 bp, Homo sapiens; identical to SEQ ID NO: 66508

SEQ ID NO: 67753 - DNA, 40 bp, Homo sapiens; identical to SEQ ID NO: 66779

SEQ ID NO: 67754 - DNA, 28 bp, Homo sapiens
gtttccgtagtgtagcggttatcacatt

SEQ ID NO: 67755 - DNA, 17 bp, Homo sapiens
acgcgggaggcccgggt

SEQ ID NO: 67756 - DNA, 32 bp, Homo sapiens; identical to SEQ ID NO: 66474

SEQ ID NO: 67757 - DNA, 33 bp, Homo sapiens; identical to SEQ ID NO: 66693

SEQ ID NO: 67758 - DNA, 20 bp, Homo sapiens
gagaaagctcacaagaactg

SEQ ID NO: 67759 - DNA, 23 bp, Homo sapiens
ccttccaagcagttgacccgggt

SEQ ID NO: 67760 - DNA, 17 bp, Homo sapiens
tcctgccgcggtcgcca

SEQ ID NO: 67761 - DNA, 20 bp, Homo sapiens
gtcacgcgggagaccggggt

SEQ ID NO: 67762 - DNA, 27 bp, Homo sapiens
ggctagctcagtcggtagagcatgaga

SEQ ID NO: 67763 - DNA, 25 bp, Homo sapiens
aggctaaatcctatatatcttacca

SEQ ID NO: 67764 - DNA, 31 bp, Homo sapiens; identical to SEQ ID NO: 66502

SEQ ID NO: 67765 - DNA, 19 bp, Homo sapiens
acatcaccccataaacacc

SEQ ID NO: 67766 - DNA, 28 bp, Homo sapiens
cattggtcgtggttgtagtccgtgcgag

SEQ ID NO: 67767 - DNA, 16 bp, Homo sapiens
atccgggtgccccctc

SEQ ID NO: 67768 - DNA, 31 bp, Homo sapiens; identical to SEQ ID NO: 66460

SEQ ID NO: 67769 - DNA, 26 bp, Homo sapiens
gaaaatgtttagacgggctcacatca

SEQ ID NO: 67770 - DNA, 33 bp, Homo sapiens; identical to SEQ ID NO: 66774

SEQ ID NO: 67771 - DNA, 37 bp, Homo sapiens; identical to SEQ ID NO: 66794

SEQ ID NO: 67772 - DNA, 25 bp, Homo sapiens
attggtcgtggttgtagtccgtgcg

SEQ ID NO: 67773 - DNA, 20 bp, Homo sapiens
taacttgaccgctctgacca

SEQ ID NO: 67774 - DNA, 30 bp, Homo sapiens; identical to SEQ ID NO: 66563

SEQ ID NO: 67775 - DNA, 33 bp, Homo sapiens; identical to SEQ ID NO: 66394

SEQ ID NO: 67776 - DNA, 17 bp, Homo sapiens
agctcacaagaactgct

SEQ ID NO: 67777 - DNA, 26 bp, Homo sapiens
gaccaagagccttcaaagccctcagt

SEQ ID NO: 67778 - DNA, 37 bp, Homo sapiens; identical to SEQ ID NO: 66331

SEQ ID NO: 67779 - DNA, 22 bp, Homo sapiens
tcgagcccacccagggacgcca

SEQ ID NO: 67780 - DNA, 40 bp, Homo sapiens
aacttagcattaaccttttaagttaaagattaagagaacc

SEQ ID NO: 67781 - DNA, 23 bp, Homo sapiens
ggttaggcctctttttaccacca

SEQ ID NO: 67782 - DNA, 37 bp, Homo sapiens
attaactagttttgacaacattcaaaaaagagtacca

SEQ ID NO: 67783 - DNA, 38 bp, Homo sapiens
gagcccggtaatcgcataaaacttaaaactttacagtc

SEQ ID NO: 67784 - DNA, 21 bp, Homo sapiens
cgatccccagtacctccacca

SEQ ID NO: 67785 - DNA, 35 bp, Homo sapiens; identical to SEQ ID NO: 66758

SEQ ID NO: 67786 - DNA, 19 bp, Homo sapiens
tagtggttagtatccccgc

SEQ ID NO: 67787 - DNA, 17 bp, Homo sapiens
atcctgccgactacgcc

SEQ ID NO: 67788 - DNA, 17 bp, Homo sapiens
tcccaccagagtcgcca

SEQ ID NO: 67789 - DNA, 25 bp, Homo sapiens
gagcttaaacccccttatttctacc

SEQ ID NO: 67790 - DNA, 27 bp, Homo sapiens
ttcaacttaacttgaccgctctgacca

SEQ ID NO: 67791 - DNA, 36 bp, Homo sapiens; identical to SEQ ID NO: 66701

SEQ ID NO: 67792 - DNA, 31 bp, Homo sapiens; identical to SEQ ID NO: 66675

SEQ ID NO: 67793 - DNA, 29 bp, Homo sapiens
cagtaagttgcaatacttaatttctgcca

SEQ ID NO: 67794 - DNA, 16 bp, Homo sapiens
gtggttgtagtccgtg

SEQ ID NO: 67795 - DNA, 19 bp, Homo sapiens
agagcccggtaatcgcata

SEQ ID NO: 67796 - DNA, 19 bp, Homo sapiens
aacccccttatttctacca

SEQ ID NO: 67797 - DNA, 42 bp, Homo sapiens; identical to SEQ ID NO: 66838

SEQ ID NO: 67798 - DNA, 28 bp, Homo sapiens
gtggagttaaagactttttctctgacca

SEQ ID NO: 67799 - DNA, 18 bp, Homo sapiens
gtttatgtagcttacctc

SEQ ID NO: 67800 - DNA, 19 bp, Homo sapiens
attggtcgtggttgtagtc

SEQ ID NO: 67801 - DNA, 28 bp, Homo sapiens
agatgaaaacctttttccaaggacacca

SEQ ID NO: 67802 - DNA, 40 bp, Homo sapiens
caaagcaatacactgaaaatgtttagacgggctcacatca

SEQ ID NO: 67803 - DNA, 24 bp, Homo sapiens
ggctaaatcctatatatcttacca

SEQ ID NO: 67804 - DNA, 25 bp, Homo sapiens
gaggcttacgaccccttatttaccc

SEQ ID NO: 67805 - DNA, 31 bp, Homo sapiens; identical to SEQ ID NO: 66413

SEQ ID NO: 67806 - DNA, 40 bp, Homo sapiens; identical to SEQ ID NO: 66515

SEQ ID NO: 67807 - DNA, 31 bp, Homo sapiens; identical to SEQ ID NO: 66690

SEQ ID NO: 67808 - DNA, 34 bp, Homo sapiens
acagtcagaggttcaattcctcttcttaacacca

SEQ ID NO: 67809 - DNA, 41 bp, Homo sapiens; identical to SEQ ID NO: 66535

SEQ ID NO: 67810 - DNA, 18 bp, Homo sapiens
acccttcccgtactacca

SEQ ID NO: 67811 - DNA, 23 bp, Homo sapiens
gcccggctagctcagtcggtaga

SEQ ID NO: 67812 - DNA, 28 bp, Homo sapiens
attggtcgtggttgtagtccgtgcgaga

SEQ ID NO: 67813 - DNA, 28 bp, Homo sapiens
gagatgaaaacctttttccaaggacacc

SEQ ID NO: 67814 - DNA, 17 bp, Homo sapiens
atcaccccataaacacc

SEQ ID NO: 67815 - DNA, 40 bp, Homo sapiens; identical to SEQ ID NO: 66731

SEQ ID NO: 67816 - DNA, 38 bp, Homo sapiens
aattaactagttttgacaacattcaaaaaagagtacca

SEQ ID NO: 67817 - DNA, 29 bp, Homo sapiens
cattggtcgtggttgtagtccgtgcgaga

SEQ ID NO: 67818 - DNA, 25 bp, Homo sapiens
aggcttacgaccccttatttacccc

SEQ ID NO: 67819 - DNA, 21 bp, Homo sapiens
gacaacagaggcttacgaccc

SEQ ID NO: 67820 - DNA, 18 bp, Homo sapiens
tagtggttagtatccccg

SEQ ID NO: 67821 - DNA, 17 bp, Homo sapiens
tcccacccggggtacca

SEQ ID NO: 67822 - DNA, 19 bp, Homo sapiens
ccttccaagcagttgaccc

SEQ ID NO: 67823 - DNA, 31 bp, Homo sapiens; identical to SEQ ID NO: 66783

SEQ ID NO: 67824 - DNA, 23 bp, Homo sapiens
tcccacatggtctagcggttagg

SEQ ID NO: 67825 - DNA, 22 bp, Homo sapiens
gcgccgctggtgtagtggtatc

SEQ ID NO: 67826 - DNA, 34 bp, Homo sapiens; identical to SEQ ID NO: 66374

SEQ ID NO: 67827 - DNA, 20 bp, Homo sapiens
atacccttcccgtactacca

SEQ ID NO: 67828 - DNA, 17 bp, Homo sapiens
accggagatgaaaacct

SEQ ID NO: 67829 - DNA, 37 bp, Homo sapiens; identical to SEQ ID NO: 66635

SEQ ID NO: 67830 - DNA, 34 bp, Homo sapiens; identical to SEQ ID NO: 66697

SEQ ID NO: 67831 - DNA, 33 bp, Homo sapiens
cagtcagaggttcaattcctcttcttaacacca

SEQ ID NO: 67832 - DNA, 36 bp, Homo sapiens; identical to SEQ ID NO: 66618

SEQ ID NO: 67833 - DNA, 23 bp, Homo sapiens
gagaaagctcacaagaactgcta

SEQ ID NO: 67834 - DNA, 26 bp, Homo sapiens
cggagatgaaaacctttttccaagga

SEQ ID NO: 67835 - DNA, 17 bp, Homo sapiens
acctctttacagtgacc

SEQ ID NO: 67836 - DNA, 38 bp, Homo sapiens; identical to SEQ ID NO: 66739

SEQ ID NO: 67837 - DNA, 35 bp, Homo sapiens; identical to SEQ ID NO: 66480

SEQ ID NO: 67838 - DNA, 21 bp, Homo sapiens
cgattcccggcccatgcacca

SEQ ID NO: 67839 - DNA, 46 bp, Homo sapiens; identical to SEQ ID NO: 66518

SEQ ID NO: 67840 - DNA, 46 bp, Homo sapiens; identical to SEQ ID NO: 66242

SEQ ID NO: 67841 - DNA, 16 bp, Homo sapiens
gaggcttacgacccct

SEQ ID NO: 67842 - DNA, 23 bp, Homo sapiens
gtttccgtagtgtagtggttatt

SEQ ID NO: 67843 - DNA, 33 bp, Homo sapiens; identical to SEQ ID NO: 66423

SEQ ID NO: 67844 - DNA, 35 bp, Homo sapiens
gtggttaggattcggcgctctcaccgccgcggccc

SEQ ID NO: 67845 - DNA, 28 bp, Homo sapiens
gagaaagctcacaagaactgctaactca

SEQ ID NO: 67846 - DNA, 26 bp, Homo sapiens
accggagatgaaaacctttttccaag

SEQ ID NO: 67847 - DNA, 16 bp, Homo sapiens
cccatcctcgtcgcca

SEQ ID NO: 67848 - DNA, 21 bp, Homo sapiens
cgattcccgggcggcgcacca

SEQ ID NO: 67849 - DNA, 33 bp, Homo sapiens
tcctcaaagcaatacactgaaaatgtttagacg

SEQ ID NO: 67850 - DNA, 28 bp, Homo sapiens
aggagcttaaacccccttatttctacca

SEQ ID NO: 67851 - DNA, 16 bp, Homo sapiens
ggagcttaaaccccct

SEQ ID NO: 67852 - DNA, 17 bp, Homo sapiens
tccccgacggggagcca

SEQ ID NO: 67853 - DNA, 25 bp, Homo sapiens
ggagatgaaaacctttttccaagga

SEQ ID NO: 67854 - DNA, 19 bp, Homo sapiens
agtggttaggattcggcgc

SEQ ID NO: 67855 - DNA, 24 bp, Homo sapiens
acagaccaagagccttcaaagccc

SEQ ID NO: 67856 - DNA, 31 bp, Homo sapiens; identical to SEQ ID NO: 66740

SEQ ID NO: 67857 - DNA, 29 bp, Homo sapiens
agtgtttgtgggtttaagtcccattggtc

SEQ ID NO: 67858 - DNA, 35 bp, Homo sapiens
taggagatttcaacttaacttgaccgctctgacca

SEQ ID NO: 67859 - DNA, 22 bp, Homo sapiens
tcgagtcccatctggggtgcca

SEQ ID NO: 67860 - DNA, 24 bp, Homo sapiens
gaaaacctttttccaaggacacca

SEQ ID NO: 67861 - DNA, 23 bp, Homo sapiens
gacaacattcaaaaaagagtacc

SEQ ID NO: 67862 - DNA, 17 bp, Homo sapiens
cccccttatttctacca

SEQ ID NO: 67863 - DNA, 18 bp, Homo sapiens
agcccggtaatcgcataa

SEQ ID NO: 67864 - DNA, 24 bp, Homo sapiens
gtctaacaacatggctttctcacc

SEQ ID NO: 67865 - DNA, 19 bp, Homo sapiens
atgtttagacgggctcaca

SEQ ID NO: 67866 - DNA, 40 bp, Homo sapiens; identical to SEQ ID NO: 66737

SEQ ID NO: 67867 - DNA, 27 bp, Homo sapiens
gtccttgtagtataaactaatacacca

SEQ ID NO: 67868 - DNA, 40 bp, Homo sapiens; identical to SEQ ID NO: 66383

SEQ ID NO: 67869 - DNA, 22 bp, Homo sapiens
tcgaatcctgccgactacgcca

SEQ ID NO: 67870 - DNA, 25 bp, Homo sapiens
gtcgtggttgtagtccgtgcgagaa

SEQ ID NO: 67871 - DNA, 43 bp, Homo sapiens; identical to SEQ ID NO: 66609

SEQ ID NO: 67872 - DNA, 33 bp, Homo sapiens; identical to SEQ ID NO: 66694

SEQ ID NO: 67873 - DNA, 18 bp, Homo sapiens
gtcctgccgcggtcgcca

SEQ ID NO: 67874 - DNA, 29 bp, Homo sapiens
gcccggctagctcagtcggtagagcatgg

SEQ ID NO: 67875 - DNA, 17 bp, Homo sapiens
ggggtatgattctcggt

SEQ ID NO: 67876 - DNA, 32 bp, Homo sapiens; identical to SEQ ID NO: 66605

SEQ ID NO: 67877 - DNA, 29 bp, Homo sapiens
atttcaacttaacttgaccgctctgacca

SEQ ID NO: 67878 - DNA, 27 bp, Homo sapiens
gttggttatacccttcccgtactacca

SEQ ID NO: 67879 - DNA, 32 bp, Homo sapiens; identical to SEQ ID NO: 66380

SEQ ID NO: 67880 - DNA, 36 bp, Homo sapiens
tagcattaaccttttaagttaaagattaagagaacc

SEQ ID NO: 67881 - DNA, 31 bp, Homo sapiens; identical to SEQ ID NO: 66757

SEQ ID NO: 67882 - DNA, 41 bp, Homo sapiens; identical to SEQ ID NO: 66719

SEQ ID NO: 67883 - DNA, 28 bp, Homo sapiens
aaagcaatacactgaaaatgtttagacg

SEQ ID NO: 67884 - DNA, 18 bp, Homo sapiens
atctcggtggaacctcca

SEQ ID NO: 67885 - DNA, 44 bp, Homo sapiens; identical to SEQ ID NO: 66381

SEQ ID NO: 67886 - DNA, 35 bp, Homo sapiens; identical to SEQ ID NO: 66749

SEQ ID NO: 67887 - DNA, 20 bp, Homo sapiens
aaacccccttatttctacca

SEQ ID NO: 67888 - DNA, 36 bp, Homo sapiens; identical to SEQ ID NO: 66748

SEQ ID NO: 67889 - DNA, 27 bp, Homo sapiens
cagagtggggttttgcagtccttacca

SEQ ID NO: 67890 - DNA, 45 bp, Homo sapiens; identical to SEQ ID NO: 66653

SEQ ID NO: 67891 - DNA, 20 bp, Homo sapiens
aatccccggcacctccacca

SEQ ID NO: 67892 - DNA, 39 bp, Homo sapiens; identical to SEQ ID NO: 66339

SEQ ID NO: 67893 - DNA, 16 bp, Homo sapiens
atcccaccgctgccac

SEQ ID NO: 67894 - DNA, 31 bp, Homo sapiens; identical to SEQ ID NO: 66347

SEQ ID NO: 67895 - DNA, 38 bp, Homo sapiens
taccccgaaaatgttggttatacccttcccgtactacc

SEQ ID NO: 67896 - DNA, 16 bp, Homo sapiens
ccccttatttctacca

SEQ ID NO: 67897 - DNA, 25 bp, Homo sapiens
ggttcgatccccggcatctccacca

SEQ ID NO: 67898 - DNA, 27 bp, Homo sapiens
aaccggagatgaaaacctttttccaag

SEQ ID NO: 67899 - DNA, 27 bp, Homo sapiens
gctagctcagtcggtagagcatgggac

SEQ ID NO: 67900 - DNA, 21 bp, Homo sapiens
gataatcatatttaccaacca

SEQ ID NO: 67901 - DNA, 40 bp, Homo sapiens; identical to SEQ ID NO: 66503

SEQ ID NO: 67902 - DNA, 32 bp, Homo sapiens
gcgttggtggtatagtggtaagcatagctgcc

SEQ ID NO: 67903 - DNA, 39 bp, Homo sapiens
caattaactagttttgacaacattcaaaaaagagtacca

SEQ ID NO: 67904 - DNA, 31 bp, Homo sapiens; identical to SEQ ID NO: 66461

SEQ ID NO: 67905 - DNA, 37 bp, Homo sapiens
accccgaaaatgttggttatacccttcccgtactacc

SEQ ID NO: 67906 - DNA, 38 bp, Homo sapiens; identical to SEQ ID NO: 66659

SEQ ID NO: 67907 - DNA, 29 bp, Homo sapiens
agcatagctgccttccaagcagttgaccc

SEQ ID NO: 67908 - DNA, 27 bp, Homo sapiens
attggtcgtggttgtagtccgtgcgag

SEQ ID NO: 67909 - DNA, 34 bp, Homo sapiens
catgcccccatgtctaacaacatggctttctcac

SEQ ID NO: 67910 - DNA, 41 bp, Homo sapiens; identical to SEQ ID NO: 66542

SEQ ID NO: 67911 - DNA, 17 bp, Homo sapiens
tggttagtactctgcgt

SEQ ID NO: 67912 - DNA, 32 bp, Homo sapiens
attgtgaatctgacaacagaggcttacgaccc

SEQ ID NO: 67913 - DNA, 22 bp, Homo sapiens
tcgagtcccttcgtggtcgcca

SEQ ID NO: 67914 - DNA, 17 bp, Homo sapiens
agctttggggggttcga

SEQ ID NO: 67915 - DNA, 22 bp, Homo sapiens
tcaattccccgacggggagcca

SEQ ID NO: 67916 - DNA, 20 bp, Homo sapiens
gtggttgtagtccgtgcgag

SEQ ID NO: 67917 - DNA, 34 bp, Homo sapiens
agcaatacactgaaaatgtttagacgggctcaca

SEQ ID NO: 67918 - DNA, 31 bp, Homo sapiens; identical to SEQ ID NO: 66568

SEQ ID NO: 67919 - DNA, 20 bp, Homo sapiens
attggtcgtggttgtagtcc

SEQ ID NO: 67920 - DNA, 25 bp, Homo sapiens
ggtcgtggttgtagtccgtgcgaga

SEQ ID NO: 67921 - DNA, 22 bp, Homo sapiens
tcgagtcccacctggggtacca

SEQ ID NO: 67922 - DNA, 34 bp, Homo sapiens
cggtaatcgcataaaacttaaaactttacagtca

SEQ ID NO: 67923 - DNA, 22 bp, Homo sapiens
cttaacttgaccgctctgacca

SEQ ID NO: 67924 - DNA, 32 bp, Homo sapiens
accccgaaaatgttggttatacccttcccgta

SEQ ID NO: 67925 - DNA, 19 bp, Homo sapiens
cacgcgaaaggtccccggt

SEQ ID NO: 67926 - DNA, 20 bp, Homo sapiens
ggtcgtggttgtagtccgtg

SEQ ID NO: 67927 - DNA, 18 bp, Homo sapiens
atccccggcacctccacc

SEQ ID NO: 67928 - DNA, 17 bp, Homo sapiens
catcaccccataaacac

SEQ ID NO: 67929 - DNA, 30 bp, Homo sapiens; identical to SEQ ID NO: 66295

SEQ ID NO: 67930 - DNA, 45 bp, Homo sapiens; identical to SEQ ID NO: 66427

SEQ ID NO: 67931 - DNA, 32 bp, Homo sapiens
agaactgctaactcatgcccccatgtctaaca

SEQ ID NO: 67932 - DNA, 30 bp, Homo sapiens
agttttgacaacattcaaaaaagagtacca

SEQ ID NO: 67933 - DNA, 18 bp, Homo sapiens
gtccttgtagtataaact

SEQ ID NO: 67934 - DNA, 35 bp, Homo sapiens; identical to SEQ ID NO: 66614

SEQ ID NO: 67935 - DNA, 17 bp, Homo sapiens
cgcgaaaggtccccggt

SEQ ID NO: 67936 - DNA, 41 bp, Homo sapiens; identical to SEQ ID NO: 66611

SEQ ID NO: 67937 - DNA, 39 bp, Homo sapiens
ctcaaagcaatacactgaaaatgtttagacgggctcaca

SEQ ID NO: 67938 - DNA, 24 bp, Homo sapiens
tctaacaacatggctttctcacca

SEQ ID NO: 67939 - DNA, 22 bp, Homo sapiens
tcgatccccgacacctccacca

SEQ ID NO: 67940 - DNA, 21 bp, Homo sapiens
tgcaatacttaatttctgcca

SEQ ID NO: 67941 - DNA, 34 bp, Homo sapiens
accccgaaaatgttggttatacccttcccgtact

SEQ ID NO: 67942 - DNA, 29 bp, Homo sapiens
atcgcataaaacttaaaactttacagtca

SEQ ID NO: 67943 - DNA, 28 bp, Homo sapiens
gacgggctcacatcaccccataaacacc

SEQ ID NO: 67944 - DNA, 24 bp, Homo sapiens
gaggcttacgaccccttatttacc

SEQ ID NO: 67945 - DNA, 16 bp, Homo sapiens
gcgaaaggtccccggt

SEQ ID NO: 67946 - DNA, 32 bp, Homo sapiens
ttagacgggctcacatcaccccataaacacca

SEQ ID NO: 67947 - DNA, 33 bp, Homo sapiens
attgtgaatctgacaacagaggcttacgacccc

SEQ ID NO: 67948 - DNA, 29 bp, Homo sapiens
gtgtttgtgggtttaagtcccattggtct

SEQ ID NO: 67949 - DNA, 16 bp, Homo sapiens
tcctgccgactacgcc

SEQ ID NO: 67950 - DNA, 16 bp, Homo sapiens
ggtgagtatccccgcc

SEQ ID NO: 67951 - DNA, 38 bp, Homo sapiens; identical to SEQ ID NO: 66623

SEQ ID NO: 67952 - DNA, 35 bp, Homo sapiens
agaccaagagccttcaaagccctcagtaagttgca

SEQ ID NO: 67953 - DNA, 25 bp, Homo sapiens
gggctcacatcaccccataaacacc

SEQ ID NO: 67954 - DNA, 18 bp, Homo sapiens
agtcggtagagcatcaga

SEQ ID NO: 67955 - DNA, 41 bp, Homo sapiens; identical to SEQ ID NO: 66412

SEQ ID NO: 67956 - DNA, 28 bp, Homo sapiens
aagcaatacactgaaaatgtttagacgg

SEQ ID NO: 67957 - DNA, 32 bp, Homo sapiens; identical to SEQ ID NO: 66316

SEQ ID NO: 67958 - DNA, 18 bp, Homo sapiens
accccgtacgggccacca

SEQ ID NO: 67959 - DNA, 17 bp, Homo sapiens
tggttaggattcggcgc

SEQ ID NO: 67960 - DNA, 21 bp, Homo sapiens
cgaatcccagcggtgcctcca

SEQ ID NO: 67961 - DNA, 29 bp, Homo sapiens
accggagatgaaaacctttttccaaggac

SEQ ID NO: 67962 - DNA, 33 bp, Homo sapiens
gaaaatgttggttatacccttcccgtactacca

SEQ ID NO: 67963 - DNA, 39 bp, Homo sapiens; identical to SEQ ID NO: 67082

SEQ ID NO: 67964 - DNA, 30 bp, Homo sapiens
gaagcagcttcaaacctgccggggcttcca

SEQ ID NO: 67965 - DNA, 35 bp, Homo sapiens; identical to SEQ ID NO: 66709

SEQ ID NO: 67966 - DNA, 19 bp, Homo sapiens
ggccgcgtggcctaatgga

SEQ ID NO: 67967 - DNA, 36 bp, Homo sapiens; identical to SEQ ID NO: 66813

SEQ ID NO: 67968 - DNA, 19 bp, Homo sapiens
aacacctctttacagtgac

SEQ ID NO: 67969 - DNA, 23 bp, Homo sapiens
acagaccaagagccttcaaagcc

SEQ ID NO: 67970 - DNA, 21 bp, Homo sapiens
aacattcaaaaaagagtacca

SEQ ID NO: 67971 - DNA, 19 bp, Homo sapiens
gtgagtatccccgcctgtc

SEQ ID NO: 67972 - DNA, 39 bp, Homo sapiens
atatcattggtcgtggttgtagtccgtgcgagaatacca

SEQ ID NO: 67973 - DNA, 28 bp, Homo sapiens
gcccggctagctcagtcggtagagcatg

SEQ ID NO: 67974 - DNA, 32 bp, Homo sapiens
cctcaaagcaatacactgaaaatgtttagacg

SEQ ID NO: 67975 - DNA, 18 bp, Homo sapiens
tggttaggattcggcgct

SEQ ID NO: 67976 - DNA, 45 bp, Homo sapiens; identical to SEQ ID NO: 66581

SEQ ID NO: 67977 - DNA, 35 bp, Homo sapiens; identical to SEQ ID NO: 66634

SEQ ID NO: 67978 - DNA, 39 bp, Homo sapiens; identical to SEQ ID NO: 66713

SEQ ID NO: 67979 - DNA, 22 bp, Homo sapiens
acttaacttgaccgctctgacc

SEQ ID NO: 67980 - DNA, 36 bp, Homo sapiens; identical to SEQ ID NO: 66792

SEQ ID NO: 67981 - DNA, 22 bp, Homo sapiens
agaccggggttcgattccccga

SEQ ID NO: 67982 - DNA, 38 bp, Homo sapiens; identical to SEQ ID NO: 66458

SEQ ID NO: 67983 - DNA, 18 bp, Homo sapiens
gaaaaagtcatggaggcc

SEQ ID NO: 67984 - DNA, 22 bp, Homo sapiens
tcgggtgcgagaggtcccgggt

SEQ ID NO: 67985 - DNA, 36 bp, Homo sapiens; identical to SEQ ID NO: 66834

SEQ ID NO: 67986 - DNA, 33 bp, Homo sapiens
ccccgaaaatgttggttatacccttcccgtact

SEQ ID NO: 67987 - DNA, 34 bp, Homo sapiens; identical to SEQ ID NO: 66537

SEQ ID NO: 67988 - DNA, 33 bp, Homo sapiens; identical to SEQ ID NO: 66804

SEQ ID NO: 67989 - DNA, 18 bp, Homo sapiens
gtggttagtactctgcgt

SEQ ID NO: 67990 - DNA, 18 bp, Homo sapiens
tacctcctcaaagcaata

SEQ ID NO: 67991 - DNA, 28 bp, Homo sapiens
acaggggttaggcctctttttaccacca

SEQ ID NO: 67992 - DNA, 33 bp, Homo sapiens
accccgaaaatgttggttatacccttcccgtac

SEQ ID NO: 67993 - DNA, 43 bp, Homo sapiens
cttccaattaactagttttgacaacattcaaaaaagagtacca

SEQ ID NO: 67994 - DNA, 23 bp, Homo sapiens
attggtcgtggttgtagtccgtg

SEQ ID NO: 67995 - DNA, 34 bp, Homo sapiens
tggttaggattcggcgctctcaccgccgcggccc

SEQ ID NO: 67996 - DNA, 18 bp, Homo sapiens
agtggctaggattcggcg

SEQ ID NO: 67997 - DNA, 32 bp, Homo sapiens
caaagcaatacactgaaaatgtttagacgggc

SEQ ID NO: 67998 - DNA, 35 bp, Homo sapiens; identical to SEQ ID NO: 66509

SEQ ID NO: 67999 - DNA, 39 bp, Homo sapiens
ggcccataccccgaaaatgttggttatacccttcccgta

SEQ ID NO: 68000 - DNA, 39 bp, Homo sapiens; identical to SEQ ID NO: 66707

SEQ ID NO: 68001 - DNA, 27 bp, Homo sapiens
cgcataaaacttaaaactttacagtca

SEQ ID NO: 68002 - DNA, 19 bp, Homo sapiens
taggggtatgattctcggt

SEQ ID NO: 68003 - DNA, 29 bp, Homo sapiens
gcatgggtggttcagtggtagaattctcg

SEQ ID NO: 68004 - DNA, 19 bp, Homo sapiens
gtcgtggttgtagtccgtg

SEQ ID NO: 68005 - DNA, 25 bp, Homo sapiens
tccaatggggtttccccgcacaggt

SEQ ID NO: 68006 - DNA, 18 bp, Homo sapiens
cttccaagcagttgaccc

SEQ ID NO: 68007 - DNA, 24 bp, Homo sapiens
gcctgtcacgcgggagaccggggt

SEQ ID NO: 68008 - DNA, 17 bp, Homo sapiens
gtcggtagagcatcaga

SEQ ID NO: 68009 - DNA, 22 bp, Homo sapiens
tgtagtccgtgcgagaatacca

SEQ ID NO: 68010 - DNA, 31 bp, Homo sapiens
cagttgatgcagagtggggttttgcagtcct

SEQ ID NO: 68011 - DNA, 32 bp, Homo sapiens
gagatttcaacttaacttgaccgctctgacca

SEQ ID NO: 68012 - DNA, 16 bp, Homo sapiens
cctatatatcttacca

SEQ ID NO: 68013 - DNA, 22 bp, Homo sapiens
gacaacagaggcttacgacccc

SEQ ID NO: 68014 - DNA, 29 bp, Homo sapiens
ggctagctcagtcggtagagcatgggact

SEQ ID NO: 68015 - DNA, 40 bp, Homo sapiens
catatcattggtcgtggttgtagtccgtgcgagaatacca

SEQ ID NO: 68016 - DNA, 18 bp, Homo sapiens
gagaaagctcacaagaac

SEQ ID NO: 68017 - DNA, 24 bp, Homo sapiens
gatgcagagtggggttttgcagtc

SEQ ID NO: 68018 - DNA, 33 bp, Homo sapiens; identical to SEQ ID NO: 66365

SEQ ID NO: 68019 - DNA, 25 bp, Homo sapiens
ggttcgattctcatagtcctagcca

SEQ ID NO: 68020 - DNA, 32 bp, Homo sapiens; identical to SEQ ID NO: 66821

SEQ ID NO: 68021 - DNA, 18 bp, Homo sapiens
agtggttaggattcggcg

SEQ ID NO: 68022 - DNA, 20 bp, Homo sapiens
agtggttaggattcggcgct

SEQ ID NO: 68023 - DNA, 29 bp, Homo sapiens
attggtcgtggttgtagtccgtgcgagaa

SEQ ID NO: 68024 - DNA, 21 bp, Homo sapiens
gaaaatgtttagacgggctca

SEQ ID NO: 68025 - DNA, 19 bp, Homo sapiens
tagtggttagtactctgcg

SEQ ID NO: 68026 - DNA, 26 bp, Homo sapiens
gtccttgtagtataaactaatacacc

SEQ ID NO: 68027 - DNA, 35 bp, Homo sapiens
gagcccggtaatcgcataaaacttaaaactttaca

SEQ ID NO: 68028 - DNA, 17 bp, Homo sapiens
gtcccaccagagtcgcc

SEQ ID NO: 68029 - DNA, 23 bp, Homo sapiens
agaccggggttcaattccccgac

SEQ ID NO: 68030 - DNA, 18 bp, Homo sapiens
cagagcccggtaatcgca

SEQ ID NO: 68031 - DNA, 30 bp, Homo sapiens; identical to SEQ ID NO: 66718

SEQ ID NO: 68032 - DNA, 35 bp, Homo sapiens
ccgaaaatgttggttatacccttcccgtactacca

SEQ ID NO: 68033 - DNA, 38 bp, Homo sapiens
tcaaagcaatacactgaaaatgtttagacgggctcaca

SEQ ID NO: 68034 - DNA, 45 bp, Homo sapiens; identical to SEQ ID NO: 66405

SEQ ID NO: 68035 - DNA, 21 bp, Homo sapiens
caaatcccggacgagccccca

SEQ ID NO: 68036 - DNA, 27 bp, Homo sapiens
tttgacaacattcaaaaaagagtacca

SEQ ID NO: 68037 - DNA, 17 bp, Homo sapiens
gccctcagtaagttgca

SEQ ID NO: 68038 - DNA, 16 bp, Homo sapiens
ccggctcggaggacca

SEQ ID NO: 68039 - DNA, 21 bp, Homo sapiens
gatgcagagtggggttttgca

SEQ ID NO: 68040 - DNA, 35 bp, Homo sapiens
ctgacaacagaggcttacgaccccttatttacccc

SEQ ID NO: 68041 - DNA, 28 bp, Homo sapiens
gtttccgtagtgtagtggtcatcacgtt

SEQ ID NO: 68042 - DNA, 16 bp, Homo sapiens
cccaccagagtcgcca

SEQ ID NO: 68043 - DNA, 31 bp, Homo sapiens
gtcagaggttcaattcctcttcttaacacca

SEQ ID NO: 68044 - DNA, 33 bp, Homo sapiens
aagcaatacactgaaaatgtttagacgggctca

SEQ ID NO: 68045 - DNA, 33 bp, Homo sapiens; identical to SEQ ID NO: 67214

SEQ ID NO: 68046 - DNA, 21 bp, Homo sapiens
cataatctgaaggtcgtgagt

SEQ ID NO: 68047 - DNA, 34 bp, Homo sapiens
attggtcgtggttgtagtccgtgcgagaatacca

SEQ ID NO: 68048 - DNA, 21 bp, Homo sapiens
gcagagcccggtaatcgcata

SEQ ID NO: 68049 - DNA, 23 bp, Homo sapiens
gagcccggtaatcgcataaaact

SEQ ID NO: 68050 - DNA, 17 bp, Homo sapiens
atcccaccagagtcgcc

SEQ ID NO: 68051 - DNA, 16 bp, Homo sapiens
cggttatcacgtctgc

SEQ ID NO: 68052 - DNA, 24 bp, Homo sapiens
ggtcgtggttgtagtccgtgcgag

SEQ ID NO: 68053 - DNA, 38 bp, Homo sapiens; identical to SEQ ID NO: 66765

SEQ ID NO: 68054 - DNA, 18 bp, Homo sapiens
aacagctatccattggtc

SEQ ID NO: 68055 - DNA, 17 bp, Homo sapiens
ctcccggtgtgggaacc

SEQ ID NO: 68056 - DNA, 18 bp, Homo sapiens
atcctatatatcttacca

SEQ ID NO: 68057 - DNA, 27 bp, Homo sapiens
gttgatgcagagtggggttttgcagtc

SEQ ID NO: 68058 - DNA, 31 bp, Homo sapiens
ccccgaaaatgttggttatacccttcccgta

SEQ ID NO: 68059 - DNA, 30 bp, Homo sapiens
cattggtcgtggttgtagtccgtgcgagaa

SEQ ID NO: 68060 - DNA, 20 bp, Homo sapiens
ctgaatccagcgatccgagt

SEQ ID NO: 68061 - DNA, 36 bp, Homo sapiens; identical to SEQ ID NO: 66676

SEQ ID NO: 68062 - DNA, 21 bp, Homo sapiens
cattggtcgtggttgtagtcc

SEQ ID NO: 68063 - DNA, 45 bp, Homo sapiens; identical to SEQ ID NO: 66386

SEQ ID NO: 68064 - DNA, 18 bp, Homo sapiens
agccctcagtaagttgca

SEQ ID NO: 68065 - DNA, 39 bp, Homo sapiens; identical to SEQ ID NO: 66672

SEQ ID NO: 68066 - DNA, 19 bp, Homo sapiens
gtttatgtagcttacctcc

SEQ ID NO: 68067 - DNA, 22 bp, Homo sapiens
taacaacatggctttctcacca

SEQ ID NO: 68068 - DNA, 33 bp, Homo sapiens; identical to SEQ ID NO: 66158

SEQ ID NO: 68069 - DNA, 18 bp, Homo sapiens
tccccggcatctccacca

SEQ ID NO: 68070 - DNA, 18 bp, Homo sapiens
tccccggcacctccacca

SEQ ID NO: 68071 - DNA, 18 bp, Homo sapiens
tccccagtacctccacca

SEQ ID NO: 68072 - DNA, 33 bp, Homo sapiens; identical to SEQ ID NO: 66152

SEQ ID NO: 68073 - DNA, 19 bp, Homo sapiens
catcaccccataaacacca

SEQ ID NO: 68074 - DNA, 17 bp, Homo sapiens
ccccggcatctccacca

SEQ ID NO: 68075 - DNA, 18 bp, Homo sapiens
atcccaccgctgccacca

SEQ ID NO: 68076 - DNA, 17 bp, Homo sapiens
accgggcggaaacacca

SEQ ID NO: 68077 - DNA, 30 bp, Homo sapiens; identical to SEQ ID NO: 66169

SEQ ID NO: 68078 - DNA, 32 bp, Homo sapiens; identical to SEQ ID NO: 66157

SEQ ID NO: 68079 - DNA, 34 bp, Homo sapiens; identical to SEQ ID NO: 66170

SEQ ID NO: 68080 - DNA, 33 bp, Homo sapiens; identical to SEQ ID NO: 66159

SEQ ID NO: 68081 - DNA, 33 bp, Homo sapiens; identical to SEQ ID NO: 66162

SEQ ID NO: 68082 - DNA, 31 bp, Homo sapiens; identical to SEQ ID NO: 66172

SEQ ID NO: 68083 - DNA, 21 bp, Homo sapiens
aacacctctttacagtgacca

SEQ ID NO: 68084 - DNA, 25 bp, Homo sapiens
ggctcacatcaccccataaacacca

SEQ ID NO: 68085 - DNA, 36 bp, Homo sapiens; identical to SEQ ID NO: 66178

SEQ ID NO: 68086 - DNA, 31 bp, Homo sapiens; identical to SEQ ID NO: 66166

SEQ ID NO: 68087 - DNA, 34 bp, Homo sapiens; identical to SEQ ID NO: 66187

SEQ ID NO: 68088 - DNA, 17 bp, Homo sapiens
ccccggcacctccacca

SEQ ID NO: 68089 - DNA, 35 bp, Homo sapiens; identical to SEQ ID NO: 66180

SEQ ID NO: 68090 - DNA, 32 bp, Homo sapiens; identical to SEQ ID NO: 66184

SEQ ID NO: 68091 - DNA, 31 bp, Homo sapiens; identical to SEQ ID NO: 66161

SEQ ID NO: 68092 - DNA, 17 bp, Homo sapiens
tccgggtgccccctcca

SEQ ID NO: 68093 - DNA, 33 bp, Homo sapiens; identical to SEQ ID NO: 66164

SEQ ID NO: 68094 - DNA, 20 bp, Homo sapiens
acacctctttacagtgacca

SEQ ID NO: 68095 - DNA, 18 bp, Homo sapiens
atccgggtgccccctcca

SEQ ID NO: 68096 - DNA, 31 bp, Homo sapiens; identical to SEQ ID NO: 66165

SEQ ID NO: 68097 - DNA, 18 bp, Homo sapiens
atcaccccataaacacca

SEQ ID NO: 68098 - DNA, 18 bp, Homo sapiens
aaccgggcggaaacacca

SEQ ID NO: 68099 - DNA, 32 bp, Homo sapiens; identical to SEQ ID NO: 66174

SEQ ID NO: 68100 - DNA, 33 bp, Homo sapiens; identical to SEQ ID NO: 66205

SEQ ID NO: 68101 - DNA, 32 bp, Homo sapiens; identical to SEQ ID NO: 66175

SEQ ID NO: 68102 - DNA, 17 bp, Homo sapiens
cctctttacagtgacca

SEQ ID NO: 68103 - DNA, 17 bp, Homo sapiens
tccggctcgaaggacca

SEQ ID NO: 68104 - DNA, 33 bp, Homo sapiens; identical to SEQ ID NO: 66179

SEQ ID NO: 68105 - DNA, 35 bp, Homo sapiens; identical to SEQ ID NO: 66210

SEQ ID NO: 68106 - DNA, 18 bp, Homo sapiens
acctctttacagtgacca

SEQ ID NO: 68107 - DNA, 21 bp, Homo sapiens
cacatcaccccataaacacca

SEQ ID NO: 68108 - DNA, 22 bp, Homo sapiens
tcaatccccggcacctccacca

SEQ ID NO: 68109 - DNA, 34 bp, Homo sapiens; identical to SEQ ID NO: 66191

SEQ ID NO: 68110 - DNA, 33 bp, Homo sapiens; identical to SEQ ID NO: 66225

SEQ ID NO: 68111 - DNA, 20 bp, Homo sapiens
acatcaccccataaacacca

SEQ ID NO: 68112 - DNA, 34 bp, Homo sapiens; identical to SEQ ID NO: 66188

SEQ ID NO: 68113 - DNA, 34 bp, Homo sapiens; identical to SEQ ID NO: 66217

SEQ ID NO: 68114 - DNA, 46 bp, Homo sapiens; identical to SEQ ID NO: 66248

SEQ ID NO: 68115 - DNA, 18 bp, Homo sapiens
atcccagcggggcctcca

SEQ ID NO: 68116 - DNA, 34 bp, Homo sapiens; identical to SEQ ID NO: 66183

SEQ ID NO: 68117 - DNA, 44 bp, Homo sapiens; identical to SEQ ID NO: 66233

SEQ ID NO: 68118 - DNA, 24 bp, Homo sapiens
gctcacatcaccccataaacacca

SEQ ID NO: 68119 - DNA, 16 bp, Homo sapiens
ccgggcggaaacacca

SEQ ID NO: 68120 - DNA, 18 bp, Homo sapiens
gtccgtgcgagaatacca

SEQ ID NO: 68121 - DNA, 35 bp, Homo sapiens; identical to SEQ ID NO: 66274

SEQ ID NO: 68122 - DNA, 32 bp, Homo sapiens; identical to SEQ ID NO: 66259

SEQ ID NO: 68123 - DNA, 37 bp, Homo sapiens; identical to SEQ ID NO: 66268

SEQ ID NO: 68124 - DNA, 39 bp, Homo sapiens; identical to SEQ ID NO: 66190

SEQ ID NO: 68125 - DNA, 32 bp, Homo sapiens; identical to SEQ ID NO: 66222

SEQ ID NO: 68126 - DNA, 45 bp, Homo sapiens; identical to SEQ ID NO: 66324

SEQ ID NO: 68127 - DNA, 18 bp, Homo sapiens
atcctgccgactacgcca

SEQ ID NO: 68128 - DNA, 17 bp, Homo sapiens
tcccaccgctgccacca

SEQ ID NO: 68129 - DNA, 18 bp, Homo sapiens
atcccagcggtgcctcca

SEQ ID NO: 68130 - DNA, 32 bp, Homo sapiens; identical to SEQ ID NO: 66292

SEQ ID NO: 68131 - DNA, 40 bp, Homo sapiens; identical to SEQ ID NO: 66369

SEQ ID NO: 68132 - DNA, 27 bp, Homo sapiens
gtggttgtagtccgtgcgagaatacca

SEQ ID NO: 68133 - DNA, 18 bp, Homo sapiens
tgcccgcatcctccacca

SEQ ID NO: 68134 - DNA, 33 bp, Homo sapiens; identical to SEQ ID NO: 66212

SEQ ID NO: 68135 - DNA, 33 bp, Homo sapiens; identical to SEQ ID NO: 66439

SEQ ID NO: 68136 - DNA, 43 bp, Homo sapiens; identical to SEQ ID NO: 66261

SEQ ID NO: 68137 - DNA, 25 bp, Homo sapiens
caacttaacttgaccgctctgacca

SEQ ID NO: 68138 - DNA, 34 bp, Homo sapiens; identical to SEQ ID NO: 66267

SEQ ID NO: 68139 - DNA, 39 bp, Homo sapiens; identical to SEQ ID NO: 66296

SEQ ID NO: 68140 - DNA, 34 bp, Homo sapiens; identical to SEQ ID NO: 66236

SEQ ID NO: 68141 - DNA, 41 bp, Homo sapiens; identical to SEQ ID NO: 66209

SEQ ID NO: 68142 - DNA, 36 bp, Homo sapiens; identical to SEQ ID NO: 66304

SEQ ID NO: 68143 - DNA, 41 bp, Homo sapiens; identical to SEQ ID NO: 66302

SEQ ID NO: 68144 - DNA, 18 bp, Homo sapiens
gtcccacccggggtacca

SEQ ID NO: 68145 - DNA, 34 bp, Homo sapiens; identical to SEQ ID NO: 66354

SEQ ID NO: 68146 - DNA, 20 bp, Homo sapiens
acattcaaaaaagagtacca

SEQ ID NO: 68147 - DNA, 40 bp, Homo sapiens; identical to SEQ ID NO: 66203

SEQ ID NO: 68148 - DNA, 18 bp, Homo sapiens
cccccggctcctccacca

SEQ ID NO: 68149 - DNA, 29 bp, Homo sapiens
gacgggctcacatcaccccataaacacca

SEQ ID NO: 68150 - DNA, 36 bp, Homo sapiens; identical to SEQ ID NO: 66312

SEQ ID NO: 68151 - DNA, 18 bp, Homo sapiens
accccgtccgtgcctcca

SEQ ID NO: 68152 - DNA, 18 bp, Homo sapiens
gagcccggtaatcgcata

SEQ ID NO: 68153 - DNA, 26 bp, Homo sapiens
gggctcacatcaccccataaacacca

SEQ ID NO: 68154 - DNA, 42 bp, Homo sapiens; identical to SEQ ID NO: 66182

SEQ ID NO: 68155 - DNA, 40 bp, Homo sapiens; identical to SEQ ID NO: 66264

SEQ ID NO: 68156 - DNA, 34 bp, Homo sapiens; identical to SEQ ID NO: 66244

SEQ ID NO: 68157 - DNA, 45 bp, Homo sapiens; identical to SEQ ID NO: 66310

SEQ ID NO: 68158 - DNA, 18 bp, Homo sapiens
tccccgacacctccacca

SEQ ID NO: 68159 - DNA, 39 bp, Homo sapiens; identical to SEQ ID NO: 66273

SEQ ID NO: 68160 - DNA, 29 bp, Homo sapiens
gagatgaaaacctttttccaaggacacca

SEQ ID NO: 68161 - DNA, 18 bp, Homo sapiens
tcccgggcggaaacacca

SEQ ID NO: 68162 - DNA, 22 bp, Homo sapiens
tcgactcccggtgtgggaacca

SEQ ID NO: 68163 - DNA, 19 bp, Homo sapiens
agtccgtgcgagaatacca

SEQ ID NO: 68164 - DNA, 22 bp, Homo sapiens
tcgatccccggcatctccacca

SEQ ID NO: 68165 - DNA, 22 bp, Homo sapiens
gagaaagctcacaagaactgct

SEQ ID NO: 68166 - DNA, 23 bp, Homo sapiens
acttaacttgaccgctctgacca

SEQ ID NO: 68167 - DNA, 17 bp, Homo sapiens
accgggcagaagcacca

SEQ ID NO: 68168 - DNA, 36 bp, Homo sapiens; identical to SEQ ID NO: 66327

SEQ ID NO: 68169 - DNA, 37 bp, Homo sapiens; identical to SEQ ID NO: 66429

SEQ ID NO: 68170 - DNA, 42 bp, Homo sapiens; identical to SEQ ID NO: 66325

SEQ ID NO: 68171 - DNA, 37 bp, Homo sapiens; identical to SEQ ID NO: 66355

SEQ ID NO: 68172 - DNA, 17 bp, Homo sapiens
cccgggcggaaacacca

SEQ ID NO: 68173 - DNA, 26 bp, Homo sapiens
gagcttaaacccccttatttctacca

SEQ ID NO: 68174 - DNA, 18 bp, Homo sapiens
acctcagagggggcacca

SEQ ID NO: 68175 - DNA, 30 bp, Homo sapiens; identical to SEQ ID NO: 66337

SEQ ID NO: 68176 - DNA, 39 bp, Homo sapiens; identical to SEQ ID NO: 66256

SEQ ID NO: 68177 - DNA, 32 bp, Homo sapiens; identical to SEQ ID NO: 66196

SEQ ID NO: 68178 - DNA, 27 bp, Homo sapiens
gaggcttacgaccccttatttacccca

SEQ ID NO: 68179 - DNA, 45 bp, Homo sapiens; identical to SEQ ID NO: 66581

SEQ ID NO: 68180 - DNA, 22 bp, Homo sapiens
tcgactcccggtatgggaacca

SEQ ID NO: 68181 - DNA, 25 bp, Homo sapiens
ggttcgattccccgacggggagcca

SEQ ID NO: 68182 - DNA, 24 bp, Homo sapiens
gacaacattcaaaaaagagtacca

SEQ ID NO: 68183 - DNA, 22 bp, Homo sapiens
tcgatccccagtacctccacca

SEQ ID NO: 68184 - DNA, 17 bp, Homo sapiens
tcctgccgactacgcca

SEQ ID NO: 68185 - DNA, 39 bp, Homo sapiens; identical to SEQ ID NO: 66311

SEQ ID NO: 68186 - DNA, 40 bp, Homo sapiens; identical to SEQ ID NO: 66515

SEQ ID NO: 68187 - DNA, 42 bp, Homo sapiens; identical to SEQ ID NO: 66418

SEQ ID NO: 68188 - DNA, 18 bp, Homo sapiens
atccggctcgaaggacca

SEQ ID NO: 68189 - DNA, 33 bp, Homo sapiens; identical to SEQ ID NO: 66200

SEQ ID NO: 68190 - DNA, 18 bp, Homo sapiens
atcccaccagagtcgcca

SEQ ID NO: 68191 - DNA, 42 bp, Homo sapiens; identical to SEQ ID NO: 66446

SEQ ID NO: 68192 - DNA, 18 bp, Homo sapiens
ttcccgggcggcgcacca

SEQ ID NO: 68193 - DNA, 35 bp, Homo sapiens; identical to SEQ ID NO: 66270

SEQ ID NO: 68194 - DNA, 26 bp, Homo sapiens
gagaaagctcacaagaactgctaact

SEQ ID NO: 68195 - DNA, 22 bp, Homo sapiens
tcacatcaccccataaacacca

SEQ ID NO: 68196 - DNA, 20 bp, Homo sapiens
aacacctctttacagtgacc

SEQ ID NO: 68197 - DNA, 17 bp, Homo sapiens
atcccaccgctgccacc

SEQ ID NO: 68198 - DNA, 39 bp, Homo sapiens; identical to SEQ ID NO: 66736

SEQ ID NO: 68199 - DNA, 22 bp, Homo sapiens
tcgattcccggccaacgcacca

SEQ ID NO: 68200 - DNA, 24 bp, Homo sapiens
gttgtagtccgtgcgagaatacca

SEQ ID NO: 68201 - DNA, 46 bp, Homo sapiens; identical to SEQ ID NO: 66703

SEQ ID NO: 68202 - DNA, 22 bp, Homo sapiens
tcgattcccggcccatgcacca

SEQ ID NO: 68203 - DNA, 35 bp, Homo sapiens; identical to SEQ ID NO: 66371

SEQ ID NO: 68204 - DNA, 17 bp, Homo sapiens
tcccgggcggcgcacca

SEQ ID NO: 68205 - DNA, 34 bp, Homo sapiens
gcccggctagctcagtcggtagagcatgagaccc

SEQ ID NO: 68206 - DNA, 24 bp, Homo sapiens
ggctcacatcaccccataaacacc

SEQ ID NO: 68207 - DNA, 23 bp, Homo sapiens
acaacattcaaaaaagagtacca

SEQ ID NO: 68208 - DNA, 20 bp, Homo sapiens
gcaatacttaatttctgcca

SEQ ID NO: 68209 - DNA, 38 bp, Homo sapiens; identical to SEQ ID NO: 66293

SEQ ID NO: 68210 - DNA, 16 bp, Homo sapiens
ctctttacagtgacca

SEQ ID NO: 68211 - DNA, 17 bp, Homo sapiens
ccccagtacctccacca

SEQ ID NO: 68212 - DNA, 17 bp, Homo sapiens
gcccgcattctccacca

SEQ ID NO: 68213 - DNA, 33 bp, Homo sapiens; identical to SEQ ID NO: 66442

SEQ ID NO: 68214 - DNA, 22 bp, Homo sapiens
tcgattcccggccaatgcacca

SEQ ID NO: 68215 - DNA, 43 bp, Homo sapiens; identical to SEQ ID NO: 66410

SEQ ID NO: 68216 - DNA, 31 bp, Homo sapiens; identical to SEQ ID NO: 66463

SEQ ID NO: 68217 - DNA, 43 bp, Homo sapiens; identical to SEQ ID NO: 66219

SEQ ID NO: 68218 - DNA, 38 bp, Homo sapiens; identical to SEQ ID NO: 66408

SEQ ID NO: 68219 - DNA, 17 bp, Homo sapiens
accccttatttacccca

SEQ ID NO: 68220 - DNA, 40 bp, Homo sapiens; identical to SEQ ID NO: 66308

SEQ ID NO: 68221 - DNA, 19 bp, Homo sapiens
gagaaagctcacaagaact

SEQ ID NO: 68222 - DNA, 18 bp, Homo sapiens
catcaccccataaacacc

SEQ ID NO: 68223 - DNA, 34 bp, Homo sapiens; identical to SEQ ID NO: 66545

SEQ ID NO: 68224 - DNA, 38 bp, Homo sapiens; identical to SEQ ID NO: 66208

SEQ ID NO: 68225 - DNA, 36 bp, Homo sapiens; identical to SEQ ID NO: 66329

SEQ ID NO: 68226 - DNA, 22 bp, Homo sapiens
ctgtcacgcgggagaccggggt

SEQ ID NO: 68227 - DNA, 26 bp, Homo sapiens
gaaccaacacctctttacagtgacca

SEQ ID NO: 68228 - DNA, 39 bp, Homo sapiens; identical to SEQ ID NO: 66506

SEQ ID NO: 68229 - DNA, 24 bp, Homo sapiens
gtgcaactccaaataaaagtacca

SEQ ID NO: 68230 - DNA, 36 bp, Homo sapiens; identical to SEQ ID NO: 66376

SEQ ID NO: 68231 - DNA, 18 bp, Homo sapiens
atcccatcctcgtcgcca

SEQ ID NO: 68232 - DNA, 18 bp, Homo sapiens
ggcctctttttaccacca

SEQ ID NO: 68233 - DNA, 28 bp, Homo sapiens
cggctagctcagtcggtagagcatggga

SEQ ID NO: 68234 - DNA, 31 bp, Homo sapiens; identical to SEQ ID NO: 66240

SEQ ID NO: 68235 - DNA, 35 bp, Homo sapiens; identical to SEQ ID NO: 67687

SEQ ID NO: 68236 - DNA, 19 bp, Homo sapiens
atccccggcacctccacca

SEQ ID NO: 68237 - DNA, 32 bp, Homo sapiens; identical to SEQ ID NO: 66246

SEQ ID NO: 68238 - DNA, 37 bp, Homo sapiens; identical to SEQ ID NO: 66313

SEQ ID NO: 68239 - DNA, 36 bp, Homo sapiens; identical to SEQ ID NO: 66305

SEQ ID NO: 68240 - DNA, 17 bp, Homo sapiens
tccgtgcgagaatacca

SEQ ID NO: 68241 - DNA, 18 bp, Homo sapiens
atcccagtagagcctcca

SEQ ID NO: 68242 - DNA, 33 bp, Homo sapiens; identical to SEQ ID NO: 66285

SEQ ID NO: 68243 - DNA, 18 bp, Homo sapiens
ctcccggtgtgggaacca

SEQ ID NO: 68244 - DNA, 38 bp, Homo sapiens; identical to SEQ ID NO: 66373

SEQ ID NO: 68245 - DNA, 39 bp, Homo sapiens; identical to SEQ ID NO: 66661

SEQ ID NO: 68246 - DNA, 38 bp, Homo sapiens; identical to SEQ ID NO: 66441

SEQ ID NO: 68247 - DNA, 28 bp, Homo sapiens
cggctagctcagtcggtagagcatgaga

SEQ ID NO: 68248 - DNA, 33 bp, Homo sapiens; identical to SEQ ID NO: 66394

SEQ ID NO: 68249 - DNA, 34 bp, Homo sapiens; identical to SEQ ID NO: 66215

SEQ ID NO: 68250 - DNA, 21 bp, Homo sapiens
aacaacatggctttctcacca

SEQ ID NO: 68251 - DNA, 18 bp, Homo sapiens
ttccggctcgaaggacca

SEQ ID NO: 68252 - DNA, 22 bp, Homo sapiens
tcgattccccgacggggagcca

SEQ ID NO: 68253 - DNA, 27 bp, Homo sapiens
agaaccaacacctctttacagtgacca

SEQ ID NO: 68254 - DNA, 19 bp, Homo sapiens
atccccagtacctccacca

SEQ ID NO: 68255 - DNA, 31 bp, Homo sapiens; identical to SEQ ID NO: 66276

SEQ ID NO: 68256 - DNA, 28 bp, Homo sapiens
accggagatgaaaacctttttccaagga

SEQ ID NO: 68257 - DNA, 24 bp, Homo sapiens
gggttaggcctctttttaccacca

SEQ ID NO: 68258 - DNA, 24 bp, Homo sapiens
aacttaacttgaccgctctgacca

SEQ ID NO: 68259 - DNA, 38 bp, Homo sapiens; identical to SEQ ID NO: 66504

SEQ ID NO: 68260 - DNA, 18 bp, Homo sapiens
gtcccaccagagtcgcca

SEQ ID NO: 68261 - DNA, 31 bp, Homo sapiens
ctcagtaagttgcaatacttaatttctgcca

SEQ ID NO: 68262 - DNA, 22 bp, Homo sapiens
tcgattcccgggcggcgcacca

SEQ ID NO: 68263 - DNA, 31 bp, Homo sapiens; identical to SEQ ID NO: 66530

SEQ ID NO: 68264 - DNA, 17 bp, Homo sapiens
atcatatttaccaacca

SEQ ID NO: 68265 - DNA, 38 bp, Homo sapiens; identical to SEQ ID NO: 66565

SEQ ID NO: 68266 - DNA, 21 bp, Homo sapiens
gtagtccgtgcgagaatacca

SEQ ID NO: 68267 - DNA, 24 bp, Homo sapiens
gtcgtggttgtagtccgtgcgaga

SEQ ID NO: 68268 - DNA, 45 bp, Homo sapiens; identical to SEQ ID NO: 66386

SEQ ID NO: 68269 - DNA, 25 bp, Homo sapiens
aaccaacacctctttacagtgacca

SEQ ID NO: 68270 - DNA, 21 bp, Homo sapiens
tacgaccccttatttacccca

SEQ ID NO: 68271 - DNA, 39 bp, Homo sapiens; identical to SEQ ID NO: 66445

SEQ ID NO: 68272 - DNA, 19 bp, Homo sapiens
atccccggcatctccacca

SEQ ID NO: 68273 - DNA, 36 bp, Homo sapiens; identical to SEQ ID NO: 66678

SEQ ID NO: 68274 - DNA, 30 bp, Homo sapiens; identical to SEQ ID NO: 66260

SEQ ID NO: 68275 - DNA, 46 bp, Homo sapiens; identical to SEQ ID NO: 66518

SEQ ID NO: 68276 - DNA, 28 bp, Homo sapiens
ggagaccggggttcgattccccgacggg

SEQ ID NO: 68277 - DNA, 36 bp, Homo sapiens; identical to SEQ ID NO: 67880

SEQ ID NO: 68278 - DNA, 35 bp, Homo sapiens; identical to SEQ ID NO: 66436

SEQ ID NO: 68279 - DNA, 23 bp, Homo sapiens
ccaacacctctttacagtgacca

SEQ ID NO: 68280 - DNA, 23 bp, Homo sapiens
gttgcaatacttaatttctgcca

SEQ ID NO: 68281 - DNA, 31 bp, Homo sapiens; identical to SEQ ID NO: 66477

SEQ ID NO: 68282 - DNA, 32 bp, Homo sapiens; identical to SEQ ID NO: 66263

SEQ ID NO: 68283 - DNA, 18 bp, Homo sapiens
aatcatatttaccaacca

SEQ ID NO: 68284 - DNA, 36 bp, Homo sapiens; identical to SEQ ID NO: 66333

SEQ ID NO: 68285 - DNA, 23 bp, Homo sapiens
gttatacccttcccgtactacca

SEQ ID NO: 68286 - DNA, 35 bp, Homo sapiens; identical to SEQ ID NO: 66592

SEQ ID NO: 68287 - DNA, 27 bp, Homo sapiens
cgggctcacatcaccccataaacacca

SEQ ID NO: 68288 - DNA, 20 bp, Homo sapiens
aactccaaataaaagtacca

SEQ ID NO: 68289 - DNA, 23 bp, Homo sapiens
gtcgtggttgtagtccgtgcgag

SEQ ID NO: 68290 - DNA, 34 bp, Homo sapiens; identical to SEQ ID NO: 66314

SEQ ID NO: 68291 - DNA, 29 bp, Homo sapiens
cggctagctcagtcggtagagcatgagac

SEQ ID NO: 68292 - DNA, 19 bp, Homo sapiens
cacctctttacagtgacca

SEQ ID NO: 68293 - DNA, 24 bp, Homo sapiens
agttgcaatacttaatttctgcca

SEQ ID NO: 68294 - DNA, 33 bp, Homo sapiens; identical to SEQ ID NO: 66359

SEQ ID NO: 68295 - DNA, 30 bp, Homo sapiens; identical to SEQ ID NO: 66435

SEQ ID NO: 68296 - DNA, 17 bp, Homo sapiens
agcccggtaatcgcata

SEQ ID NO: 68297 - DNA, 45 bp, Homo sapiens; identical to SEQ ID NO: 66653

SEQ ID NO: 68298 - DNA, 28 bp, Homo sapiens
acgggctcacatcaccccataaacacca

SEQ ID NO: 68299 - DNA, 19 bp, Homo sapiens
aggcctctttttaccacca

SEQ ID NO: 68300 - DNA, 28 bp, Homo sapiens
cggatagctcagtcggtagagcatcaga

SEQ ID NO: 68301 - DNA, 18 bp, Homo sapiens
acttgaccgctctgacca

SEQ ID NO: 68302 - DNA, 20 bp, Homo sapiens
tagtccgtgcgagaatacca

SEQ ID NO: 68303 - DNA, 41 bp, Homo sapiens; identical to SEQ ID NO: 66294

SEQ ID NO: 68304 - DNA, 18 bp, Homo sapiens
atccggctcggaggacca

SEQ ID NO: 68305 - DNA, 32 bp, Homo sapiens; identical to SEQ ID NO: 66284

SEQ ID NO: 68306 - DNA, 16 bp, Homo sapiens
ccgggtgccccctcca

SEQ ID NO: 68307 - DNA, 18 bp, Homo sapiens
gaccccttatttacccca

SEQ ID NO: 68308 - DNA, 23 bp, Homo sapiens
cctgtcacgcgggagaccggggt

SEQ ID NO: 68309 - DNA, 37 bp, Homo sapiens; identical to SEQ ID NO: 66493

SEQ ID NO: 68310 - DNA, 43 bp, Homo sapiens; identical to SEQ ID NO: 66539

SEQ ID NO: 68311 - DNA, 25 bp, Homo sapiens
ggggttaggcctctttttaccacca

SEQ ID NO: 68312 - DNA, 36 bp, Homo sapiens; identical to SEQ ID NO: 66532

SEQ ID NO: 68313 - DNA, 45 bp, Homo sapiens; identical to SEQ ID NO: 66562

SEQ ID NO: 68314 - DNA, 35 bp, Homo sapiens; identical to SEQ ID NO: 66634

SEQ ID NO: 68315 - DNA, 40 bp, Homo sapiens; identical to SEQ ID NO: 66361

SEQ ID NO: 68316 - DNA, 26 bp, Homo sapiens
tggttgtagtccgtgcgagaatacca

SEQ ID NO: 68317 - DNA, 17 bp, Homo sapiens
tccggctcggaggacca

SEQ ID NO: 68318 - DNA, 19 bp, Homo sapiens
cgaccccttatttacccca

SEQ ID NO: 68319 - DNA, 30 bp, Homo sapiens; identical to SEQ ID NO: 66254

SEQ ID NO: 68320 - DNA, 19 bp, Homo sapiens
caatacttaatttctgcca

SEQ ID NO: 68321 - DNA, 31 bp, Homo sapiens; identical to SEQ ID NO: 66395

SEQ ID NO: 68322 - DNA, 22 bp, Homo sapiens
caacattcaaaaaagagtacca

SEQ ID NO: 68323 - DNA, 31 bp, Homo sapiens; identical to SEQ ID NO: 66262

SEQ ID NO: 68324 - DNA, 30 bp, Homo sapiens; identical to SEQ ID NO: 66576

SEQ ID NO: 68325 - DNA, 19 bp, Homo sapiens
acacctctttacagtgacc

SEQ ID NO: 68326 - DNA, 37 bp, Homo sapiens; identical to SEQ ID NO: 66415

SEQ ID NO: 68327 - DNA, 36 bp, Homo sapiens; identical to SEQ ID NO: 66529

SEQ ID NO: 68328 - DNA, 40 bp, Homo sapiens; identical to SEQ ID NO: 66469

SEQ ID NO: 68329 - DNA, 25 bp, Homo sapiens
ggttgtagtccgtgcgagaatacca

SEQ ID NO: 68330 - DNA, 24 bp, Homo sapiens
accaacacctctttacagtgacca

SEQ ID NO: 68331 - DNA, 42 bp, Homo sapiens; identical to SEQ ID NO: 66486

SEQ ID NO: 68332 - DNA, 25 bp, Homo sapiens
tgacaacattcaaaaaagagtacca

SEQ ID NO: 68333 - DNA, 18 bp, Homo sapiens
accctgctcgctgcgcca

SEQ ID NO: 68334 - DNA, 42 bp, Homo sapiens; identical to SEQ ID NO: 66306

SEQ ID NO: 68335 - DNA, 30 bp, Homo sapiens; identical to SEQ ID NO: 66563

SEQ ID NO: 68336 - DNA, 17 bp, Homo sapiens
tccccagtacctccacc

SEQ ID NO: 68337 - DNA, 22 bp, Homo sapiens
tcgatccccggcacctccacca

SEQ ID NO: 68338 - DNA, 22 bp, Homo sapiens
tcaaatcccggacgagccccca

SEQ ID NO: 68339 - DNA, 41 bp, Homo sapiens; identical to SEQ ID NO: 66542

SEQ ID NO: 68340 - DNA, 35 bp, Homo sapiens; identical to SEQ ID NO: 66614

SEQ ID NO: 68341 - DNA, 37 bp, Homo sapiens; identical to SEQ ID NO: 67782

SEQ ID NO: 68342 - DNA, 26 bp, Homo sapiens
aggcttacgaccccttatttacccca

SEQ ID NO: 68343 - DNA, 29 bp, Homo sapiens
cggctagctcagtcggtagagcatgggac

SEQ ID NO: 68344 - DNA, 29 bp, Homo sapiens
cagtaagttgcaatacttaatttctgcca

SEQ ID NO: 68345 - DNA, 23 bp, Homo sapiens
ctcacatcaccccataaacacca

SEQ ID NO: 68346 - DNA, 18 bp, Homo sapiens
aacatggctttctcacca

SEQ ID NO: 68347 - DNA, 31 bp, Homo sapiens; identical to SEQ ID NO: 66315

SEQ ID NO: 68348 - DNA, 21 bp, Homo sapiens
gtcgtggttgtagtccgtgcg

SEQ ID NO: 68349 - DNA, 33 bp, Homo sapiens; identical to SEQ ID NO: 66365

SEQ ID NO: 68350 - DNA, 22 bp, Homo sapiens
tcaatccccggcatctccacca

SEQ ID NO: 68351 - DNA, 45 bp, Homo sapiens; identical to SEQ ID NO: 66528

SEQ ID NO: 68352 - DNA, 41 bp, Homo sapiens; identical to SEQ ID NO: 66611

SEQ ID NO: 68353 - DNA, 16 bp, Homo sapiens
gagcccggtaatcgca

SEQ ID NO: 68354 - DNA, 30 bp, Homo sapiens; identical to SEQ ID NO: 66541

SEQ ID NO: 68355 - DNA, 33 bp, Homo sapiens; identical to SEQ ID NO: 66297

SEQ ID NO: 68356 - DNA, 30 bp, Homo sapiens; identical to SEQ ID NO: 66300

SEQ ID NO: 68357 - DNA, 19 bp, Homo sapiens
aacttgaccgctctgacca

SEQ ID NO: 68358 - DNA, 32 bp, Homo sapiens; identical to SEQ ID NO: 66290

SEQ ID NO: 68359 - DNA, 24 bp, Homo sapiens
ggttatacccttcccgtactacca

SEQ ID NO: 68360 - DNA, 38 bp, Homo sapiens; identical to SEQ ID NO: 66511

SEQ ID NO: 68361 - DNA, 25 bp, Homo sapiens
gagcccggtaatcgcataaaactta

SEQ ID NO: 68362 - DNA, 17 bp, Homo sapiens
tccccggcacctccacc

SEQ ID NO: 68363 - DNA, 25 bp, Homo sapiens
ggcttacgaccccttatttacccca

SEQ ID NO: 68364 - DNA, 44 bp, Homo sapiens; identical to SEQ ID NO: 67155

SEQ ID NO: 68365 - DNA, 40 bp, Homo sapiens; identical to SEQ ID NO: 66383

SEQ ID NO: 68366 - DNA, 23 bp, Homo sapiens
ggttaggcctctttttaccacca

SEQ ID NO: 68367 - DNA, 42 bp, Homo sapiens; identical to SEQ ID NO: 66638

SEQ ID NO: 68368 - DNA, 29 bp, Homo sapiens
gacaggggttaggcctctttttaccacca

SEQ ID NO: 68369 - DNA, 36 bp, Homo sapiens; identical to SEQ ID NO: 66384

SEQ ID NO: 68370 - DNA, 17 bp, Homo sapiens
ccccgacacctccacca

SEQ ID NO: 68371 - DNA, 18 bp, Homo sapiens
aaccgggcagaagcacca

SEQ ID NO: 68372 - DNA, 29 bp, Homo sapiens
aaccggagatgaaaacctttttccaagga

SEQ ID NO: 68373 - DNA, 29 bp, Homo sapiens
caaagcaatacactgaaaatgtttagacg

SEQ ID NO: 68374 - DNA, 43 bp, Homo sapiens
gatagagtaaataataggagcttaaacccccttatttctacca

SEQ ID NO: 68375 - DNA, 34 bp, Homo sapiens; identical to SEQ ID NO: 66527

SEQ ID NO: 68376 - DNA, 30 bp, Homo sapiens; identical to SEQ ID NO: 66551

SEQ ID NO: 68377 - DNA, 46 bp, Homo sapiens; identical to SEQ ID NO: 66525

SEQ ID NO: 68378 - DNA, 40 bp, Homo sapiens; identical to SEQ ID NO: 67780

SEQ ID NO: 68379 - DNA, 30 bp, Homo sapiens; identical to SEQ ID NO: 66406

SEQ ID NO: 68380 - DNA, 31 bp, Homo sapiens; identical to SEQ ID NO: 66411

SEQ ID NO: 68381 - DNA, 19 bp, Homo sapiens
gagcccggtaatcgcataa

SEQ ID NO: 68382 - DNA, 20 bp, Homo sapiens
acgaccccttatttacccca

SEQ ID NO: 68383 - DNA, 25 bp, Homo sapiens
aggctaaatcctatatatcttacca

SEQ ID NO: 68384 - DNA, 37 bp, Homo sapiens; identical to SEQ ID NO: 66331

SEQ ID NO: 68385 - DNA, 20 bp, Homo sapiens
gagaaagctcacaagaactg

SEQ ID NO: 68386 - DNA, 21 bp, Homo sapiens
caactccaaataaaagtacca

SEQ ID NO: 68387 - DNA, 18 bp, Homo sapiens
atccaggtgccccctcca

SEQ ID NO: 68388 - DNA, 30 bp, Homo sapiens; identical to SEQ ID NO: 66397

SEQ ID NO: 68389 - DNA, 31 bp, Homo sapiens; identical to SEQ ID NO: 66512

SEQ ID NO: 68390 - DNA, 33 bp, Homo sapiens; identical to SEQ ID NO: 66790

SEQ ID NO: 68391 - DNA, 17 bp, Homo sapiens
tccccggcatctccacc

SEQ ID NO: 68392 - DNA, 22 bp, Homo sapiens
cttaacttgaccgctctgacca

SEQ ID NO: 68393 - DNA, 18 bp, Homo sapiens
tgcccgcattctccacca

SEQ ID NO: 68394 - DNA, 33 bp, Homo sapiens; identical to SEQ ID NO: 66298

SEQ ID NO: 68395 - DNA, 16 bp, Homo sapiens
ccgtgcgagaatacca

SEQ ID NO: 68396 - DNA, 35 bp, Homo sapiens; identical to SEQ ID NO: 66631

SEQ ID NO: 68397 - DNA, 33 bp, Homo sapiens; identical to SEQ ID NO: 66693

SEQ ID NO: 68398 - DNA, 38 bp, Homo sapiens; identical to SEQ ID NO: 66659

SEQ ID NO: 68399 - DNA, 33 bp, Homo sapiens; identical to SEQ ID NO: 66301

SEQ ID NO: 68400 - DNA, 43 bp, Homo sapiens; identical to SEQ ID NO: 67993

SEQ ID NO: 68401 - DNA, 30 bp, Homo sapiens; identical to SEQ ID NO: 66295

SEQ ID NO: 68402 - DNA, 36 bp, Homo sapiens; identical to SEQ ID NO: 66748

SEQ ID NO: 68403 - DNA, 38 bp, Homo sapiens; identical to SEQ ID NO: 66765

SEQ ID NO: 68404 - DNA, 25 bp, Homo sapiens
ggtgcaactccaaataaaagtacca

SEQ ID NO: 68405 - DNA, 19 bp, Homo sapiens
aacccccttatttctacca

SEQ ID NO: 68406 - DNA, 35 bp, Homo sapiens; identical to SEQ ID NO: 66432

SEQ ID NO: 68407 - DNA, 19 bp, Homo sapiens
caacatggctttctcacca

SEQ ID NO: 68408 - DNA, 16 bp, Homo sapiens
cccggccaacgcacca

SEQ ID NO: 68409 - DNA, 38 bp, Homo sapiens; identical to SEQ ID NO: 66668

SEQ ID NO: 68410 - DNA, 32 bp, Homo sapiens; identical to SEQ ID NO: 66350

SEQ ID NO: 68411 - DNA, 22 bp, Homo sapiens
ggtcgtggttgtagtccgtgcg

SEQ ID NO: 68412 - DNA, 46 bp, Homo sapiens
aactgctaactcatgcccccatgtctaacaacatggctttctcacc

SEQ ID NO: 68413 - DNA, 16 bp, Homo sapiens
cccgggcggcgcacca

SEQ ID NO: 68414 - DNA, 46 bp, Homo sapiens; identical to SEQ ID NO: 67119

SEQ ID NO: 68415 - DNA, 22 bp, Homo sapiens
tcaatccccagcacctccacca

SEQ ID NO: 68416 - DNA, 17 bp, Homo sapiens
ccccgtccgtgcctcca

SEQ ID NO: 68417 - DNA, 18 bp, Homo sapiens
ctcccggtatgggaacca

SEQ ID NO: 68418 - DNA, 29 bp, Homo sapiens
ccggctagctcagtcggtagagcatggga

SEQ ID NO: 68419 - DNA, 44 bp, Homo sapiens
aacttacacttaggagatttcaacttaacttgaccgctctgacc

SEQ ID NO: 68420 - DNA, 39 bp, Homo sapiens; identical to SEQ ID NO: 67238

SEQ ID NO: 68421 - DNA, 34 bp, Homo sapiens; identical to SEQ ID NO: 66655

SEQ ID NO: 68422 - DNA, 29 bp, Homo sapiens
ccggatagctcagtcggtagagcatcaga

SEQ ID NO: 68423 - DNA, 45 bp, Homo sapiens; identical to SEQ ID NO: 66753

SEQ ID NO: 68424 - DNA, 33 bp, Homo sapiens; identical to SEQ ID NO: 66570

SEQ ID NO: 68425 - DNA, 29 bp, Homo sapiens
ccggctagctcagtcggtagagcatgaga

SEQ ID NO: 68426 - DNA, 32 bp, Homo sapiens; identical to SEQ ID NO: 66473

SEQ ID NO: 68427 - DNA, 31 bp, Homo sapiens; identical to SEQ ID NO: 66347

SEQ ID NO: 68428 - DNA, 27 bp, Homo sapiens
ttcaacttaacttgaccgctctgacca

SEQ ID NO: 68429 - DNA, 43 bp, Homo sapiens
tgtgaatctgacaacagaggcttacgaccccttatttacccca

SEQ ID NO: 68430 - DNA, 27 bp, Homo sapiens
atgtctaacaacatggctttctcacca

SEQ ID NO: 68431 - DNA, 30 bp, Homo sapiens; identical to SEQ ID NO: 66358

SEQ ID NO: 68432 - DNA, 36 bp, Homo sapiens; identical to SEQ ID NO: 66676

SEQ ID NO: 68433 - DNA, 32 bp, Homo sapiens; identical to SEQ ID NO: 66316

SEQ ID NO: 68434 - DNA, 39 bp, Homo sapiens; identical to SEQ ID NO: 66266

SEQ ID NO: 68435 - DNA, 37 bp, Homo sapiens; identical to SEQ ID NO: 66520

SEQ ID NO: 68436 - DNA, 38 bp, Homo sapiens; identical to SEQ ID NO: 67816

SEQ ID NO: 68437 - DNA, 18 bp, Homo sapiens
gtttatgtagcttacctc

SEQ ID NO: 68438 - DNA, 32 bp, Homo sapiens; identical to SEQ ID NO: 66716

SEQ ID NO: 68439 - DNA, 19 bp, Homo sapiens
gtcgtggttgtagtccgtg

SEQ ID NO: 68440 - DNA, 24 bp, Homo sapiens
gcttacgaccccttatttacccca

SEQ ID NO: 68441 - DNA, 18 bp, Homo sapiens
gtggttgtagtccgtgcg

SEQ ID NO: 68442 - DNA, 23 bp, Homo sapiens
gagaaagctcacaagaactgcta

SEQ ID NO: 68443 - DNA, 22 bp, Homo sapiens
caacacctctttacagtgacca

SEQ ID NO: 68444 - DNA, 37 bp, Homo sapiens; identical to SEQ ID NO: 66549

SEQ ID NO: 68445 - DNA, 27 bp, Homo sapiens
ggagcttaaacccccttatttctacca

SEQ ID NO: 68446 - DNA, 43 bp, Homo sapiens
gttaactaagtgtttgtgggtttaagtcccattggtctagcca

SEQ ID NO: 68447 - DNA, 18 bp, Homo sapiens
ttccccgacggggagcca

SEQ ID NO: 68448 - DNA, 21 bp, Homo sapiens
tgcaatacttaatttctgcca

SEQ ID NO: 68449 - DNA, 28 bp, Homo sapiens
gcagagtggggttttgcagtccttacca

SEQ ID NO: 68450 - DNA, 34 bp, Homo sapiens; identical to SEQ ID NO: 66338

SEQ ID NO: 68451 - DNA, 18 bp, Homo sapiens
acccttcccgtactacca

SEQ ID NO: 68452 - DNA, 37 bp, Homo sapiens; identical to SEQ ID NO: 66564

SEQ ID NO: 68453 - DNA, 32 bp, Homo sapiens; identical to SEQ ID NO: 67931

SEQ ID NO: 68454 - DNA, 26 bp, Homo sapiens
tcaacttaacttgaccgctctgacca

SEQ ID NO: 68455 - DNA, 39 bp, Homo sapiens; identical to SEQ ID NO: 67903

SEQ ID NO: 68456 - DNA, 34 bp, Homo sapiens; identical to SEQ ID NO: 66697

SEQ ID NO: 68457 - DNA, 16 bp, Homo sapiens
ccggctcgaaggacca

SEQ ID NO: 68458 - DNA, 37 bp, Homo sapiens; identical to SEQ ID NO: 66650

SEQ ID NO: 68459 - DNA, 46 bp, Homo sapiens; identical to SEQ ID NO: 66242

SEQ ID NO: 68460 - DNA, 18 bp, Homo sapiens
tacctcctcaaagcaata

SEQ ID NO: 68461 - DNA, 25 bp, Homo sapiens
attggtcgtggttgtagtccgtgcg

SEQ ID NO: 68462 - DNA, 41 bp, Homo sapiens
tccaattaactagttttgacaacattcaaaaaagagtacca

SEQ ID NO: 68463 - DNA, 30 bp, Homo sapiens; identical to SEQ ID NO: 66644

SEQ ID NO: 68464 - DNA, 28 bp, Homo sapiens
attggtcgtggttgtagtccgtgcgaga

SEQ ID NO: 68465 - DNA, 41 bp, Homo sapiens; identical to SEQ ID NO: 66719

SEQ ID NO: 68466 - DNA, 39 bp, Homo sapiens; identical to SEQ ID NO: 67050

SEQ ID NO: 68467 - DNA, 36 bp, Homo sapiens
agcattaaccttttaagttaaagattaagagaacca

SEQ ID NO: 68468 - DNA, 29 bp, Homo sapiens
gtccttgtagtataaactaatacaccagt

SEQ ID NO: 68469 - DNA, 23 bp, Homo sapiens
tgcaactccaaataaaagtacca

SEQ ID NO: 68470 - DNA, 34 bp, Homo sapiens; identical to SEQ ID NO: 66593

SEQ ID NO: 68471 - DNA, 28 bp, Homo sapiens
gagaaccaacacctctttacagtgacca

SEQ ID NO: 68472 - DNA, 35 bp, Homo sapiens; identical to SEQ ID NO: 67858

SEQ ID NO: 68473 - DNA, 18 bp, Homo sapiens
gtccctgtccaggcgcca

SEQ ID NO: 68474 - DNA, 31 bp, Homo sapiens; identical to SEQ ID NO: 66783

SEQ ID NO: 68475 - DNA, 31 bp, Homo sapiens; identical to SEQ ID NO: 67651

SEQ ID NO: 68476 - DNA, 28 bp, Homo sapiens
gtggagttaaagactttttctctgacca

SEQ ID NO: 68477 - DNA, 21 bp, Homo sapiens
gataatcatatttaccaacca

SEQ ID NO: 68478 - DNA, 24 bp, Homo sapiens
caacttaacttgaccgctctgacc

SEQ ID NO: 68479 - DNA, 34 bp, Homo sapiens; identical to SEQ ID NO: 66508

SEQ ID NO: 68480 - DNA, 20 bp, Homo sapiens
acaacatggctttctcacca

SEQ ID NO: 68481 - DNA, 27 bp, Homo sapiens
gagaaagctcacaagaactgctaactc

SEQ ID NO: 68482 - DNA, 27 bp, Homo sapiens
attggtcgtggttgtagtccgtgcgag

SEQ ID NO: 68483 - DNA, 44 bp, Homo sapiens; identical to SEQ ID NO: 66598

SEQ ID NO: 68484 - DNA, 18 bp, Homo sapiens
tcccacccagggacgcca

SEQ ID NO: 68485 - DNA, 46 bp, Homo sapiens
gaaatacaacgatggtttttcatatcattggtcgtggttgtagtcc

SEQ ID NO: 68486 - DNA, 16 bp, Homo sapiens
accggagatgaaaacc

SEQ ID NO: 68487 - DNA, 36 bp, Homo sapiens; identical to SEQ ID NO: 66366

SEQ ID NO: 68488 - DNA, 34 bp, Homo sapiens; identical to SEQ ID NO: 66667

SEQ ID NO: 68489 - DNA, 34 bp, Homo sapiens; identical to SEQ ID NO: 66589

SEQ ID NO: 68490 - DNA, 16 bp, Homo sapiens
ctcggtggaacctcca

SEQ ID NO: 68491 - DNA, 19 bp, Homo sapiens
cattcaaaaaagagtacca

SEQ ID NO: 68492 - DNA, 36 bp, Homo sapiens
aagtgtttgtgggtttaagtcccattggtctagcca

SEQ ID NO: 68493 - DNA, 25 bp, Homo sapiens
agcttaaacccccttatttctacca

SEQ ID NO: 68494 - DNA, 31 bp, Homo sapiens; identical to SEQ ID NO: 66413

SEQ ID NO: 68495 - DNA, 21 bp, Homo sapiens
caatccccggcacctccacca

SEQ ID NO: 68496 - DNA, 25 bp, Homo sapiens
gcccggctagctcagtcggtagagc

SEQ ID NO: 68497 - DNA, 33 bp, Homo sapiens; identical to SEQ ID NO: 66682

SEQ ID NO: 68498 - DNA, 16 bp, Homo sapiens
ccgggcagaagcacca

SEQ ID NO: 68499 - DNA, 40 bp, Homo sapiens; identical to SEQ ID NO: 66578

SEQ ID NO: 68500 - DNA, 34 bp, Homo sapiens
gcattaaccttttaagttaaagattaagagaacc

SEQ ID NO: 68501 - DNA, 41 bp, Homo sapiens; identical to SEQ ID NO: 66455

SEQ ID NO: 68502 - DNA, 26 bp, Homo sapiens
gaggcttacgaccccttatttacccc

SEQ ID NO: 68503 - DNA, 37 bp, Homo sapiens; identical to SEQ ID NO: 66635

SEQ ID NO: 68504 - DNA, 27 bp, Homo sapiens
gatgaaaacctttttccaaggacacca

SEQ ID NO: 68505 - DNA, 27 bp, Homo sapiens
aagcaatacactgaaaatgtttagacg

SEQ ID NO: 68506 - DNA, 35 bp, Homo sapiens
gcccggctagctcagtcggtagagcatgagaccct

SEQ ID NO: 68507 - DNA, 30 bp, Homo sapiens; identical to SEQ ID NO: 66426

SEQ ID NO: 68508 - DNA, 31 bp, Homo sapiens; identical to SEQ ID NO: 66461

SEQ ID NO: 68509 - DNA, 35 bp, Homo sapiens; identical to SEQ ID NO: 66409

SEQ ID NO: 68510 - DNA, 25 bp, Homo sapiens
gagcttaaacccccttatttctacc

SEQ ID NO: 68511 - DNA, 20 bp, Homo sapiens
ataatcatatttaccaacca

SEQ ID NO: 68512 - DNA, 28 bp, Homo sapiens
gagaaagctcacaagaactgctaactca

SEQ ID NO: 68513 - DNA, 17 bp, Homo sapiens
catcaccccataaacac

SEQ ID NO: 68514 - DNA, 26 bp, Homo sapiens
gcccggctagctcagtcggtagagca

SEQ ID NO: 68515 - DNA, 30 bp, Homo sapiens; identical to SEQ ID NO: 67964

SEQ ID NO: 68516 - DNA, 29 bp, Homo sapiens
atttcaacttaacttgaccgctctgacca

SEQ ID NO: 68517 - DNA, 43 bp, Homo sapiens
tgctaactcatgcccccatgtctaacaacatggctttctcacc

SEQ ID NO: 68518 - DNA, 38 bp, Homo sapiens; identical to SEQ ID NO: 66575

SEQ ID NO: 68519 - DNA, 20 bp, Homo sapiens
cacatcaccccataaacacc

SEQ ID NO: 68520 - DNA, 29 bp, Homo sapiens
agtgtttgtgggtttaagtcccattggtc

SEQ ID NO: 68521 - DNA, 39 bp, Homo sapiens; identical to SEQ ID NO: 66339

SEQ ID NO: 68522 - DNA, 28 bp, Homo sapiens
cagggatgggttcgattctcatagtcct

SEQ ID NO: 68523 - DNA, 32 bp, Homo sapiens; identical to SEQ ID NO: 66380

SEQ ID NO: 68524 - DNA, 30 bp, Homo sapiens; identical to SEQ ID NO: 66555

SEQ ID NO: 68525 - DNA, 33 bp, Homo sapiens; identical to SEQ ID NO: 66621

SEQ ID NO: 68526 - DNA, 19 bp, Homo sapiens
atgtttagacgggctcaca

SEQ ID NO: 68527 - DNA, 41 bp, Homo sapiens; identical to SEQ ID NO: 66412

SEQ ID NO: 68528 - DNA, 20 bp, Homo sapiens
aaacccccttatttctacca

SEQ ID NO: 68529 - DNA, 29 bp, Homo sapiens
taggatggggtgtgataggtggcacggag

SEQ ID NO: 68530 - DNA, 29 bp, Homo sapiens
agcccggtaatcgcataaaacttaaaact

SEQ ID NO: 68531 - DNA, 44 bp, Homo sapiens; identical to SEQ ID NO: 66381

SEQ ID NO: 68532 - DNA, 35 bp, Homo sapiens
agtgtttgtgggtttaagtcccattggtctagcca

SEQ ID NO: 68533 - DNA, 20 bp, Homo sapiens
atacccttcccgtactacca

SEQ ID NO: 68534 - DNA, 22 bp, Homo sapiens
tcgaatcccagcggtgcctcca

SEQ ID NO: 68535 - DNA, 45 bp, Homo sapiens; identical to SEQ ID NO: 66405

SEQ ID NO: 68536 - DNA, 30 bp, Homo sapiens
taggatggggtgtgataggtggcacggaga

SEQ ID NO: 68537 - DNA, 29 bp, Homo sapiens
attggtcgtggttgtagtccgtgcgagaa

SEQ ID NO: 68538 - DNA, 32 bp, Homo sapiens; identical to SEQ ID NO: 67912

SEQ ID NO: 68539 - DNA, 45 bp, Homo sapiens
gattgtgaatctgacaacagaggcttacgaccccttatttacccc

SEQ ID NO: 68540 - DNA, 29 bp, Homo sapiens
gcccggctagctcagtcggtagagcatga

SEQ ID NO: 68541 - DNA, 33 bp, Homo sapiens; identical to SEQ ID NO: 66423

SEQ ID NO: 68542 - DNA, 38 bp, Homo sapiens; identical to SEQ ID NO: 67783

SEQ ID NO: 68543 - DNA, 24 bp, Homo sapiens
ggctaaatcctatatatcttacca

SEQ ID NO: 68544 - DNA, 22 bp, Homo sapiens
tcgaatcccactcctgacacca

SEQ ID NO: 68545 - DNA, 28 bp, Homo sapiens
cattggtcgtggttgtagtccgtgcgag

SEQ ID NO: 68546 - DNA, 39 bp, Homo sapiens; identical to SEQ ID NO: 67972

SEQ ID NO: 68547 - DNA, 42 bp, Homo sapiens; identical to SEQ ID NO: 66825

SEQ ID NO: 68548 - DNA, 21 bp, Homo sapiens
cgatccccggcatctccacca

SEQ ID NO: 68549 - DNA, 31 bp, Homo sapiens
aagacaggggttaggcctctttttaccacca

SEQ ID NO: 68550 - DNA, 38 bp, Homo sapiens; identical to SEQ ID NO: 66744

SEQ ID NO: 68551 - DNA, 25 bp, Homo sapiens
tccattggggtttccccgcgcaggt

SEQ ID NO: 68552 - DNA, 18 bp, Homo sapiens
atcctatatatcttacca

SEQ ID NO: 68553 - DNA, 29 bp, Homo sapiens
ccgaaaatgttggttatacccttcccgta

SEQ ID NO: 68554 - DNA, 39 bp, Homo sapiens
acttagcattaaccttttaagttaaagattaagagaacc

SEQ ID NO: 68555 - DNA, 18 bp, Homo sapiens
gaaaaagtcatggaggcc

SEQ ID NO: 68556 - DNA, 41 bp, Homo sapiens; identical to SEQ ID NO: 66656

SEQ ID NO: 68557 - DNA, 30 bp, Homo sapiens; identical to SEQ ID NO: 66754

SEQ ID NO: 68558 - DNA, 45 bp, Homo sapiens; identical to SEQ ID NO: 66427

SEQ ID NO: 68559 - DNA, 34 bp, Homo sapiens; identical to SEQ ID NO: 67922

SEQ ID NO: 68560 - DNA, 21 bp, Homo sapiens
aacattcaaaaaagagtacca

SEQ ID NO: 68561 - DNA, 20 bp, Homo sapiens
taacttgaccgctctgacca

SEQ ID NO: 68562 - DNA, 25 bp, Homo sapiens
gtcgtggttgtagtccgtgcgagaa

SEQ ID NO: 68563 - DNA, 19 bp, Homo sapiens
aacacctctttacagtgac

SEQ ID NO: 68564 - DNA, 24 bp, Homo sapiens
ggtcgtggttgtagtccgtgcgag

SEQ ID NO: 68565 - DNA, 35 bp, Homo sapiens
aaaccggagatgaaaacctttttccaaggacacca

SEQ ID NO: 68566 - DNA, 21 bp, Homo sapiens
gagaaagctcacaagaactgc

SEQ ID NO: 68567 - DNA, 18 bp, Homo sapiens
acccccttatttctacca

SEQ ID NO: 68568 - DNA, 23 bp, Homo sapiens
gctcacatcaccccataaacacc

SEQ ID NO: 68569 - DNA, 19 bp, Homo sapiens
attctcatagtcctagcca

SEQ ID NO: 68570 - DNA, 29 bp, Homo sapiens
cagaggcttacgaccccttatttacccca

SEQ ID NO: 68571 - DNA, 44 bp, Homo sapiens; identical to SEQ ID NO: 66403

SEQ ID NO: 68572 - DNA, 29 bp, Homo sapiens
gtgtttgtgggtttaagtcccattggtct

SEQ ID NO: 68573 - DNA, 28 bp, Homo sapiens
catgtctaacaacatggctttctcacca

SEQ ID NO: 68574 - DNA, 18 bp, Homo sapiens
agcccggtaatcgcataa

SEQ ID NO: 68575 - DNA, 40 bp, Homo sapiens; identical to SEQ ID NO: 66731

SEQ ID NO: 68576 - DNA, 34 bp, Homo sapiens; identical to SEQ ID NO: 66537

SEQ ID NO: 68577 - DNA, 30 bp, Homo sapiens; identical to SEQ ID NO: 66712

SEQ ID NO: 68578 - DNA, 34 bp, Homo sapiens; identical to SEQ ID NO: 66466

SEQ ID NO: 68579 - DNA, 17 bp, Homo sapiens
agctcacaagaactgct

SEQ ID NO: 68580 - DNA, 22 bp, Homo sapiens
tcaagtccctgttcgggcgcca

SEQ ID NO: 68581 - DNA, 26 bp, Homo sapiens
gcattaaccttttaagttaaagatta

SEQ ID NO: 68582 - DNA, 18 bp, Homo sapiens
tcctcgctggggcctcca

SEQ ID NO: 68583 - DNA, 33 bp, Homo sapiens
gaatcttagctttgggtgctaatggtggagtta

SEQ ID NO: 68584 - DNA, 40 bp, Homo sapiens; identical to SEQ ID NO: 66840

SEQ ID NO: 68585 - DNA, 32 bp, Homo sapiens
aaagacaggggttaggcctctttttaccacca

SEQ ID NO: 68586 - DNA, 19 bp, Homo sapiens
gtttatgtagcttacctcc

SEQ ID NO: 68587 - DNA, 45 bp, Homo sapiens
gaaatacaacgatggtttttcatatcattggtcgtggttgtagtc

SEQ ID NO: 68588 - DNA, 35 bp, Homo sapiens; identical to SEQ ID NO: 67186

SEQ ID NO: 68589 - DNA, 40 bp, Homo sapiens; identical to SEQ ID NO: 66779

SEQ ID NO: 68590 - DNA, 33 bp, Homo sapiens; identical to SEQ ID NO: 66468

SEQ ID NO: 68591 - DNA, 22 bp, Homo sapiens
tcgaatcccagcggggcctcca

SEQ ID NO: 68592 - DNA, 21 bp, Homo sapiens
tgtcacgcgggagaccggggt

SEQ ID NO: 68593 - DNA, 36 bp, Homo sapiens; identical to SEQ ID NO: 66701

SEQ ID NO: 68594 - DNA, 23 bp, Homo sapiens
ctgtcacgcgggagaccggggtt

SEQ ID NO: 68595 - DNA, 22 bp, Homo sapiens
gcaactccaaataaaagtacca

SEQ ID NO: 68596 - DNA, 32 bp, Homo sapiens; identical to SEQ ID NO: 67946

SEQ ID NO: 68597 - DNA, 35 bp, Homo sapiens
agaactgctaactcatgcccccatgtctaacaaca

SEQ ID NO: 68598 - DNA, 26 bp, Homo sapiens
accggagatgaaaacctttttccaag

SEQ ID NO: 68599 - DNA, 34 bp, Homo sapiens; identical to SEQ ID NO: 66735

SEQ ID NO: 68600 - DNA, 46 bp, Homo sapiens; identical to SEQ ID NO: 66443

SEQ ID NO: 68601 - DNA, 33 bp, Homo sapiens; identical to SEQ ID NO: 67046

SEQ ID NO: 68602 - DNA, 27 bp, Homo sapiens
ggagaccggggttcgattccccgacgg

SEQ ID NO: 68603 - DNA, 18 bp, Homo sapiens
atcccaccttcgtcgcca

SEQ ID NO: 68604 - DNA, 38 bp, Homo sapiens; identical to SEQ ID NO: 66739

SEQ ID NO: 68605 - DNA, 18 bp, Homo sapiens
gtcacgtcggggtcacca

SEQ ID NO: 68606 - DNA, 18 bp, Homo sapiens
atcccaccctcgtcgcca

SEQ ID NO: 68607 - DNA, 22 bp, Homo sapiens
tcgagccccagtggaaccacca

SEQ ID NO: 68608 - DNA, 29 bp, Homo sapiens
gcgccgctggtgtagtggtatcatgcaag

SEQ ID NO: 68609 - DNA, 36 bp, Homo sapiens; identical to SEQ ID NO: 66618

SEQ ID NO: 68610 - DNA, 17 bp, Homo sapiens
aaccggagatgaaaacc

SEQ ID NO: 68611 - DNA, 19 bp, Homo sapiens
aatcctatatatcttacca

SEQ ID NO: 68612 - DNA, 40 bp, Homo sapiens; identical to SEQ ID NO: 66737

SEQ ID NO: 68613 - DNA, 44 bp, Homo sapiens; identical to SEQ ID NO: 66820

SEQ ID NO: 68614 - DNA, 37 bp, Homo sapiens
aacatcagattgtgaatctgacaacagaggcttacga

SEQ ID NO: 68615 - DNA, 34 bp, Homo sapiens; identical to SEQ ID NO: 66374

SEQ ID NO: 68616 - DNA, 42 bp, Homo sapiens
gagcccggtaatcgcataaaacttaaaactttacagtcagag

SEQ ID NO: 68617 - DNA, 35 bp, Homo sapiens; identical to SEQ ID NO: 66646

SEQ ID NO: 68618 - DNA, 17 bp, Homo sapiens
atcaccccataaacacc

SEQ ID NO: 68619 - DNA, 30 bp, Homo sapiens; identical to SEQ ID NO: 66519

SEQ ID NO: 68620 - DNA, 39 bp, Homo sapiens
acccagaggtcgatggatcgaaaccatcctctgctacca

SEQ ID NO: 68621 - DNA, 35 bp, Homo sapiens; identical to SEQ ID NO: 66480

SEQ ID NO: 68622 - DNA, 34 bp, Homo sapiens; identical to SEQ ID NO: 67941

SEQ ID NO: 68623 - DNA, 39 bp, Homo sapiens; identical to SEQ ID NO: 66742

SEQ ID NO: 68624 - DNA, 23 bp, Homo sapiens
ctaacaacatggctttctcacca

SEQ ID NO: 68625 - DNA, 44 bp, Homo sapiens; identical to SEQ ID NO: 66664

SEQ ID NO: 68626 - DNA, 26 bp, Homo sapiens
ggtcgtggttgtagtccgtgcgagaa

SEQ ID NO: 68627 - DNA, 28 bp, Homo sapiens
agaactgctaactcatgcccccatgtct

SEQ ID NO: 68628 - DNA, 24 bp, Homo sapiens
gttcgattccccgacggggagcca

SEQ ID NO: 68629 - DNA, 46 bp, Homo sapiens
gggcccataccccgaaaatgttggttatacccttcccgtactacca

SEQ ID NO: 68630 - DNA, 35 bp, Homo sapiens; identical to SEQ ID NO: 66622

SEQ ID NO: 68631 - DNA, 32 bp, Homo sapiens; identical to SEQ ID NO: 68011

SEQ ID NO: 68632 - DNA, 25 bp, Homo sapiens
ggttcaatccccggcacctccacca

SEQ ID NO: 68633 - DNA, 36 bp, Homo sapiens; identical to SEQ ID NO: 66348

SEQ ID NO: 68634 - DNA, 21 bp, Homo sapiens
tatacccttcccgtactacca

SEQ ID NO: 68635 - DNA, 20 bp, Homo sapiens
gtggttgtagtccgtgcgag

SEQ ID NO: 68636 - DNA, 25 bp, Homo sapiens
ggtcgtggttgtagtccgtgcgaga

SEQ ID NO: 68637 - DNA, 17 bp, Homo sapiens
acctctttacagtgacc

SEQ ID NO: 68638 - DNA, 31 bp, Homo sapiens
aatggtggagttaaagactttttctctgacc

SEQ ID NO: 68639 - DNA, 22 bp, Homo sapiens
acttaacttgaccgctctgacc

SEQ ID NO: 68640 - DNA, 20 bp, Homo sapiens
attggtcgtggttgtagtcc

SEQ ID NO: 68641 - DNA, 37 bp, Homo sapiens; identical to SEQ ID NO: 66794

SEQ ID NO: 68642 - DNA, 37 bp, Homo sapiens; identical to SEQ ID NO: 67905

SEQ ID NO: 68643 - DNA, 22 bp, Homo sapiens
tcgaatcccacttctgacacca

SEQ ID NO: 68644 - DNA, 18 bp, Homo sapiens
ttcccggccaacgcacca

SEQ ID NO: 68645 - DNA, 25 bp, Homo sapiens
cggtaatcgcataaaacttaaaact

SEQ ID NO: 68646 - DNA, 25 bp, Homo sapiens
aggcttacgaccccttatttacccc

SEQ ID NO: 68647 - DNA, 40 bp, Homo sapiens
tacacttaggagatttcaacttaacttgaccgctctgacc

SEQ ID NO: 68648 - DNA, 21 bp, Homo sapiens
taaacccccttatttctacca

SEQ ID NO: 68649 - DNA, 29 bp, Homo sapiens
ggagatgaaaacctttttccaaggacacc

SEQ ID NO: 68650 - DNA, 34 bp, Homo sapiens
gctttggggggttcgattccttccttttttgcca

SEQ ID NO: 68651 - DNA, 35 bp, Homo sapiens; identical to SEQ ID NO: 66509

SEQ ID NO: 68652 - DNA, 40 bp, Homo sapiens; identical to SEQ ID NO: 67086

SEQ ID NO: 68653 - DNA, 32 bp, Homo sapiens; identical to SEQ ID NO: 66781

SEQ ID NO: 68654 - DNA, 26 bp, Homo sapiens
cattggtcgtggttgtagtccgtgcg

SEQ ID NO: 68655 - DNA, 28 bp, Homo sapiens
cgtggttgtagtccgtgcgagaatacca

SEQ ID NO: 68656 - DNA, 21 bp, Homo sapiens
cgatccccagtacctccacca

SEQ ID NO: 68657 - DNA, 27 bp, Homo sapiens
cagagtggggttttgcagtccttacca

SEQ ID NO: 68658 - DNA, 25 bp, Homo sapiens
gagaaagctcacaagaactgctaac

SEQ ID NO: 68659 - DNA, 19 bp, Homo sapiens
acatcaccccataaacacc

SEQ ID NO: 68660 - DNA, 17 bp, Homo sapiens
acgcgggagaccggggt

SEQ ID NO: 68661 - DNA, 32 bp, Homo sapiens; identical to SEQ ID NO: 66517

SEQ ID NO: 68662 - DNA, 24 bp, Homo sapiens
cagagaatagtttaaattagaatc

SEQ ID NO: 68663 - DNA, 38 bp, Homo sapiens
gagaaagctcacaagaactgctaactcatgcccccatg

SEQ ID NO: 68664 - DNA, 32 bp, Homo sapiens; identical to SEQ ID NO: 66516

SEQ ID NO: 68665 - DNA, 31 bp, Homo sapiens; identical to SEQ ID NO: 66478

SEQ ID NO: 68666 - DNA, 18 bp, Homo sapiens
ctcccagtggggcctcca

SEQ ID NO: 68667 - DNA, 20 bp, Homo sapiens
tacctcctcaaagcaataca

SEQ ID NO: 68668 - DNA, 42 bp, Homo sapiens
ctaacttagcattaaccttttaagttaaagattaagagaacc

SEQ ID NO: 68669 - DNA, 37 bp, Homo sapiens; identical to SEQ ID NO: 66487

SEQ ID NO: 68670 - DNA, 39 bp, Homo sapiens
acacttaggagatttcaacttaacttgaccgctctgacc

SEQ ID NO: 68671 - DNA, 30 bp, Homo sapiens; identical to SEQ ID NO: 66691

SEQ ID NO: 68672 - DNA, 28 bp, Homo sapiens
gtgtttgtgggtttaagtcccattggtc

SEQ ID NO: 68673 - DNA, 34 bp, Homo sapiens; identical to SEQ ID NO: 67087

SEQ ID NO: 68674 - DNA, 46 bp, Homo sapiens
gctgttaactaagtgtttgtgggtttaagtcccattggtctagcca

SEQ ID NO: 68675 - DNA, 33 bp, Homo sapiens
agctttggggggttcgattccttccttttttgc

SEQ ID NO: 68676 - DNA, 33 bp, Homo sapiens; identical to SEQ ID NO: 66774

SEQ ID NO: 68677 - DNA, 32 bp, Homo sapiens; identical to SEQ ID NO: 66714

SEQ ID NO: 68678 - DNA, 38 bp, Homo sapiens; identical to SEQ ID NO: 66458

SEQ ID NO: 68679 - DNA, 35 bp, Homo sapiens; identical to SEQ ID NO: 68027

SEQ ID NO: 68680 - DNA, 30 bp, Homo sapiens; identical to SEQ ID NO: 66723

SEQ ID NO: 68681 - DNA, 18 bp, Homo sapiens
gtcccggcggagtcgcca

SEQ ID NO: 68682 - DNA, 35 bp, Homo sapiens; identical to SEQ ID NO: 66708

SEQ ID NO: 68683 - DNA, 43 bp, Homo sapiens; identical to SEQ ID NO: 66609

SEQ ID NO: 68684 - DNA, 41 bp, Homo sapiens; identical to SEQ ID NO: 66535

SEQ ID NO: 68685 - DNA, 18 bp, Homo sapiens
atctcggtggaacctcca

SEQ ID NO: 68686 - DNA, 26 bp, Homo sapiens
gtccttgtagtataaactaatacacc

SEQ ID NO: 68687 - DNA, 22 bp, Homo sapiens
tgtagtccgtgcgagaatacca

SEQ ID NO: 68688 - DNA, 34 bp, Homo sapiens
ctaaagacaggggttaggcctctttttaccacca

SEQ ID NO: 68689 - DNA, 37 bp, Homo sapiens
gaatcttagctttgggtgctaatggtggagttaaaga

SEQ ID NO: 68690 - DNA, 16 bp, Homo sapiens
cctgccgactacgcca

SEQ ID NO: 68691 - DNA, 34 bp, Homo sapiens; identical to SEQ ID NO: 67909

SEQ ID NO: 68692 - DNA, 33 bp, Homo sapiens; identical to SEQ ID NO: 67831

SEQ ID NO: 68693 - DNA, 33 bp, Homo sapiens; identical to SEQ ID NO: 66617

SEQ ID NO: 68694 - DNA, 39 bp, Homo sapiens; identical to SEQ ID NO: 67082

SEQ ID NO: 68695 - DNA, 37 bp, Homo sapiens
tagcattaaccttttaagttaaagattaagagaacca

SEQ ID NO: 68696 - DNA, 35 bp, Homo sapiens; identical to SEQ ID NO: 66758

SEQ ID NO: 68697 - DNA, 22 bp, Homo sapiens
tcgatccccgtacgggccacca

SEQ ID NO: 68698 - DNA, 35 bp, Homo sapiens; identical to SEQ ID NO: 66814

SEQ ID NO: 68699 - DNA, 24 bp, Homo sapiens
atatcattggtcgtggttgtagtc

SEQ ID NO: 68700 - DNA, 19 bp, Homo sapiens
attggtcgtggttgtagtc

SEQ ID NO: 68701 - DNA, 19 bp, Homo sapiens
gcccggatagctcagtcgg

SEQ ID NO: 68702 - DNA, 20 bp, Homo sapiens
aacaacatggctttctcacc

SEQ ID NO: 68703 - DNA, 42 bp, Homo sapiens
ttccaattaactagttttgacaacattcaaaaaagagtacca

SEQ ID NO: 68704 - DNA, 39 bp, Homo sapiens; identical to SEQ ID NO: 67999

SEQ ID NO: 68705 - DNA, 34 bp, Homo sapiens; identical to SEQ ID NO: 66336

SEQ ID NO: 68706 - DNA, 17 bp, Homo sapiens
ccctgctcgctgcgcca

SEQ ID NO: 68707 - DNA, 38 bp, Homo sapiens
aaacatcagattgtgaatctgacaacagaggcttacga

SEQ ID NO: 68708 - DNA, 25 bp, Homo sapiens
atatcattggtcgtggttgtagtcc

SEQ ID NO: 68709 - DNA, 17 bp, Homo sapiens
gtttatgtagcttacct

SEQ ID NO: 68710 - DNA, 32 bp, Homo sapiens; identical to SEQ ID NO: 66605

SEQ ID NO: 68711 - DNA, 32 bp, Homo sapiens
gtttttcatatcattggtcgtggttgtagtcc

SEQ ID NO: 68712 - DNA, 17 bp, Homo sapiens
cccccttatttctacca

SEQ ID NO: 68713 - DNA, 27 bp, Homo sapiens
gtggagttaaagactttttctctgacc

SEQ ID NO: 68714 - DNA, 23 bp, Homo sapiens
ccttccaagcagttgacccgggt

SEQ ID NO: 68715 - DNA, 18 bp, Homo sapiens
acacctctttacagtgac

SEQ ID NO: 68716 - DNA, 32 bp, Homo sapiens
gagaaagctcacaagaactgctaactcatgcc

SEQ ID NO: 68717 - DNA, 37 bp, Homo sapiens
aaagattaagagaaccaacacctctttacagtgacca

SEQ ID NO: 68718 - DNA, 25 bp, Homo sapiens
gagtggggttttgcagtccttacca

SEQ ID NO: 68719 - DNA, 22 bp, Homo sapiens
gtggttgtagtccgtgcgagaa

SEQ ID NO: 68720 - DNA, 29 bp, Homo sapiens
gggagaccggggttcgattccccgacggg

SEQ ID NO: 68721 - DNA, 18 bp, Homo sapiens
atcccagcgaggcctcca

SEQ ID NO: 68722 - DNA, 18 bp, Homo sapiens
aacagctatccattggtc

SEQ ID NO: 68723 - DNA, 35 bp, Homo sapiens; identical to SEQ ID NO: 66709

SEQ ID NO: 68724 - DNA, 21 bp, Homo sapiens
cattggtcgtggttgtagtcc

SEQ ID NO: 68725 - DNA, 32 bp, Homo sapiens
tgcccccatgtctaacaacatggctttctcac

SEQ ID NO: 68726 - DNA, 38 bp, Homo sapiens
aatctgacaacagaggcttacgaccccttatttacccc

SEQ ID NO: 68727 - DNA, 33 bp, Homo sapiens
ccctcagtaagttgcaatacttaatttctgcca

SEQ ID NO: 68728 - DNA, 33 bp, Homo sapiens
atatcattggtcgtggttgtagtccgtgcgaga

SEQ ID NO: 68729 - DNA, 27 bp, Homo sapiens
aaccggagatgaaaacctttttccaag

SEQ ID NO: 68730 - DNA, 33 bp, Homo sapiens; identical to SEQ ID NO: 66804

SEQ ID NO: 68731 - DNA, 27 bp, Homo sapiens
cgcataaaacttaaaactttacagtca

SEQ ID NO: 68732 - DNA, 38 bp, Homo sapiens
aattcgaagaagcagcttcaaacctgccggggcttcca

SEQ ID NO: 68733 - DNA, 31 bp, Homo sapiens
attggtcgtggttgtagtccgtgcgagaata

SEQ ID NO: 68734 - DNA, 26 bp, Homo sapiens
catatcattggtcgtggttgtagtcc

SEQ ID NO: 68735 - DNA, 27 bp, Homo sapiens
agaactgctaactcatgcccccatgtc

SEQ ID NO: 68736 - DNA, 36 bp, Homo sapiens
gcccggctagctcagtcggtagagcatgagaccctt

SEQ ID NO: 68737 - DNA, 20 bp, Homo sapiens
aaatcctatatatcttacca

SEQ ID NO: 68738 - DNA, 26 bp, Homo sapiens
gcccggatagctcagtcggtagagca

SEQ ID NO: 68739 - DNA, 43 bp, Homo sapiens; identical to SEQ ID NO: 66558

SEQ ID NO: 68740 - DNA, 40 bp, Homo sapiens; identical to SEQ ID NO: 66503

SEQ ID NO: 68741 - DNA, 33 bp, Homo sapiens
cagggatgggttcgattctcatagtcctagcca

SEQ ID NO: 68742 - DNA, 24 bp, Homo sapiens
ggtaatcgcataaaacttaaaact

SEQ ID NO: 68743 - DNA, 21 bp, Homo sapiens
gcagagcccggtaatcgcata

SEQ ID NO: 68744 - DNA, 44 bp, Homo sapiens; identical to SEQ ID NO: 66604

SEQ ID NO: 68745 - DNA, 33 bp, Homo sapiens
gtaccgttaacttccaattaactagttttgaca

SEQ ID NO: 68746 - DNA, 30 bp, Homo sapiens
cgcgggagaccggggttcgattccccgacg

SEQ ID NO: 68747 - DNA, 28 bp, Homo sapiens
cgaaaatgttggttatacccttcccgta

SEQ ID NO: 68748 - DNA, 30 bp, Homo sapiens
cagagaatagtttaaattagaatcttagct

SEQ ID NO: 68749 - DNA, 23 bp, Homo sapiens
agaccggggttcgattccccgac

SEQ ID NO: 68750 - DNA, 25 bp, Homo sapiens
ggttcgatccccggcatctccacca

SEQ ID NO: 68751 - DNA, 35 bp, Homo sapiens; identical to SEQ ID NO: 66749

SEQ ID NO: 68752 - DNA, 30 bp, Homo sapiens; identical to SEQ ID NO: 68059

SEQ ID NO: 68753 - DNA, 22 bp, Homo sapiens
tcgactcccagcggggcctcca

SEQ ID NO: 68754 - DNA, 31 bp, Homo sapiens; identical to SEQ ID NO: 66757

SEQ ID NO: 68755 - DNA, 18 bp, Homo sapiens
accccgtacgggccacca

SEQ ID NO: 68756 - DNA, 32 bp, Homo sapiens
ggtttttcatatcattggtcgtggttgtagtc

SEQ ID NO: 68757 - DNA, 27 bp, Homo sapiens
gttggttatacccttcccgtactacca

SEQ ID NO: 68758 - DNA, 33 bp, Homo sapiens; identical to SEQ ID NO: 66674

SEQ ID NO: 68759 - DNA, 38 bp, Homo sapiens
ctaagtgtttgtgggtttaagtcccattggtctagcca

SEQ ID NO: 68760 - DNA, 28 bp, Homo sapiens
gcccggctagctcagtcggtagagcatg

SEQ ID NO: 68761 - DNA, 22 bp, Homo sapiens
tcaattccccgacggggagcca

SEQ ID NO: 68762 - DNA, 20 bp, Homo sapiens
gtcacgcgggagaccggggt

SEQ ID NO: 68763 - DNA, 25 bp, Homo sapiens
gtctaacaacatggctttctcacca

SEQ ID NO: 68764 - DNA, 29 bp, Homo sapiens
agaatcttagctttgggtgctaatggtgg

SEQ ID NO: 68765 - DNA, 29 bp, Homo sapiens
cattggtcgtggttgtagtccgtgcgaga

SEQ ID NO: 68766 - DNA, 34 bp, Homo sapiens; identical to SEQ ID NO: 67808

SEQ ID NO: 68767 - DNA, 23 bp, Homo sapiens
cttacgaccccttatttacccca

SEQ ID NO: 68768 - DNA, 21 bp, Homo sapiens
cgattccccgacggggagcca

SEQ ID NO: 68769 - DNA, 38 bp, Homo sapiens; identical to SEQ ID NO: 67895

SEQ ID NO: 68770 - DNA, 31 bp, Homo sapiens
catatcattggtcgtggttgtagtccgtgcg

SEQ ID NO: 68771 - DNA, 34 bp, Homo sapiens
gtgtttgtgggtttaagtcccattggtctagcca

SEQ ID NO: 68772 - DNA, 36 bp, Homo sapiens
taaaccggagatgaaaacctttttccaaggacacca

SEQ ID NO: 68773 - DNA, 30 bp, Homo sapiens; identical to SEQ ID NO: 66636

SEQ ID NO: 68774 - DNA, 17 bp, Homo sapiens
tcctgccgcggtcgcca

SEQ ID NO: 68775 - DNA, 42 bp, Homo sapiens; identical to SEQ ID NO: 67031

SEQ ID NO: 68776 - DNA, 43 bp, Homo sapiens
agtcttgtaaaccggagatgaaaacctttttccaaggacacca

SEQ ID NO: 68777 - DNA, 30 bp, Homo sapiens
atatcattggtcgtggttgtagtccgtgcg

SEQ ID NO: 68778 - DNA, 33 bp, Homo sapiens
tgtttgtgggtttaagtcccattggtctagcca

SEQ ID NO: 68779 - DNA, 34 bp, Homo sapiens
gtttatgtagcttacctcctcaaagcaatacact

SEQ ID NO: 68780 - DNA, 17 bp, Homo sapiens
tcccggcggagtcgcca

SEQ ID NO: 68781 - DNA, 18 bp, Homo sapiens
agccctcagtaagttgca

SEQ ID NO: 68782 - DNA, 24 bp, Homo sapiens
gcttaaacccccttatttctacca

SEQ ID NO: 68783 - DNA, 25 bp, Homo sapiens
catatcattggtcgtggttgtagtc

SEQ ID NO: 68784 - DNA, 38 bp, Homo sapiens; identical to SEQ ID NO: 67166

SEQ ID NO: 68785 - DNA, 19 bp, Homo sapiens
agagcccggtaatcgcata

SEQ ID NO: 68786 - DNA, 33 bp, Homo sapiens
ggtaatcgcataaaacttaaaactttacagtca

SEQ ID NO: 68787 - DNA, 29 bp, Homo sapiens
agacgggctcacatcaccccataaacacc

SEQ ID NO: 68788 - DNA, 18 bp, Homo sapiens
gagaaagctcacaagaac

SEQ ID NO: 68789 - DNA, 46 bp, Homo sapiens
gctatcgggcccataccccgaaaatgttggttatacccttcccgta

SEQ ID NO: 68790 - DNA, 39 bp, Homo sapiens
gaaaatgtttagacgggctcacatcaccccataaacacc

SEQ ID NO: 68791 - DNA, 18 bp, Homo sapiens
acgcgaaaggtccccggt

SEQ ID NO: 68792 - DNA, 31 bp, Homo sapiens; identical to SEQ ID NO: 67690

SEQ ID NO: 68793 - DNA, 40 bp, Homo sapiens; identical to SEQ ID NO: 66543

SEQ ID NO: 68794 - DNA, 28 bp, Homo sapiens
aaagcaatacactgaaaatgtttagacg

SEQ ID NO: 68795 - DNA, 29 bp, Homo sapiens
atcgcataaaacttaaaactttacagtca

SEQ ID NO: 68796 - DNA, 31 bp, Homo sapiens; identical to SEQ ID NO: 66524

SEQ ID NO: 68797 - DNA, 34 bp, Homo sapiens; identical to SEQ ID NO: 67718

SEQ ID NO: 68798 - DNA, 19 bp, Homo sapiens
tacccttcccgtactacca

SEQ ID NO: 68799 - DNA, 45 bp, Homo sapiens
actgctaactcatgcccccatgtctaacaacatggctttctcacc

SEQ ID NO: 68800 - DNA, 25 bp, Homo sapiens
cagagaatagtttaaattagaatct

SEQ ID NO: 68801 - DNA, 37 bp, Homo sapiens
gcgggagaccggggttcaattccccgacggggagcca

SEQ ID NO: 68802 - DNA, 44 bp, Homo sapiens; identical to SEQ ID NO: 66802

SEQ ID NO: 68803 - DNA, 41 bp, Homo sapiens
agctgttaactaagtgtttgtgggtttaagtcccattggtc

SEQ ID NO: 68804 - DNA, 32 bp, Homo sapiens; identical to SEQ ID NO: 66531

SEQ ID NO: 68805 - DNA, 22 bp, Homo sapiens
tcgagcccacccagggacgcca

SEQ ID NO: 68806 - DNA, 16 bp, Homo sapiens
cctatatatcttacca

SEQ ID NO: 68807 - DNA, 28 bp, Homo sapiens
gacgggctcacatcaccccataaacacc

SEQ ID NO: 68808 - DNA, 44 bp, Homo sapiens
tgatagagtaaataataggagcttaaacccccttatttctacca

SEQ ID NO: 68809 - DNA, 38 bp, Homo sapiens
gagtaaataataggagcttaaacccccttatttctacc

SEQ ID NO: 68810 - DNA, 42 bp, Homo sapiens
gtcttgtaaaccggagatgaaaacctttttccaaggacacca

SEQ ID NO: 68811 - DNA, 31 bp, Homo sapiens
gtttttcatatcattggtcgtggttgtagtc

SEQ ID NO: 68812 - DNA, 28 bp, Homo sapiens
acaggggttaggcctctttttaccacca

SEQ ID NO: 68813 - DNA, 35 bp, Homo sapiens
agattgtgaatctgacaacagaggcttacgacccc

SEQ ID NO: 68814 - DNA, 24 bp, Homo sapiens
ccttccaagcagttgacccgggtt

SEQ ID NO: 68815 - DNA, 26 bp, Homo sapiens
tggtgcaactccaaataaaagtacca

SEQ ID NO: 68816 - DNA, 33 bp, Homo sapiens
atgcccccatgtctaacaacatggctttctcac

SEQ ID NO: 68817 - DNA, 34 bp, Homo sapiens
aacatcagattgtgaatctgacaacagaggctta

SEQ ID NO: 68818 - DNA, 20 bp, Homo sapiens
ggtcgtggttgtagtccgtg

SEQ ID NO: 68819 - DNA, 40 bp, Homo sapiens; identical to SEQ ID NO: 66649

SEQ ID NO: 68820 - DNA, 27 bp, Homo sapiens
agcattaaccttttaagttaaagatta

SEQ ID NO: 68821 - DNA, 24 bp, Homo sapiens
cattggtcgtggttgtagtccgtg

SEQ ID NO: 68822 - DNA, 30 bp, Homo sapiens; identical to SEQ ID NO: 66627

SEQ ID NO: 68823 - DNA, 37 bp, Homo sapiens; identical to SEQ ID NO: 66756

SEQ ID NO: 68824 - DNA, 36 bp, Homo sapiens
cttaggagatttcaacttaacttgaccgctctgacc

SEQ ID NO: 68825 - DNA, 32 bp, Homo sapiens; identical to SEQ ID NO: 66491

SEQ ID NO: 68826 - DNA, 29 bp, Homo sapiens
tcagggatgggttcgattctcatagtcct

SEQ ID NO: 68827 - DNA, 19 bp, Homo sapiens
ccttccaagcagttgaccc

SEQ ID NO: 68828 - DNA, 27 bp, Homo sapiens
cactgtaaagctaacttagcattaacc

SEQ ID NO: 68829 - DNA, 17 bp, Homo sapiens
accggagatgaaaacct

SEQ ID NO: 68830 - DNA, 28 bp, Homo sapiens
atatcattggtcgtggttgtagtccgtg

SEQ ID NO: 68831 - DNA, 37 bp, Homo sapiens
ttagcattaaccttttaagttaaagattaagagaacc

SEQ ID NO: 68832 - DNA, 46 bp, Homo sapiens
acttaaaactttacagtcagaggttcaattcctcttcttaacacca

SEQ ID NO: 68833 - DNA, 34 bp, Homo sapiens
agtaccgttaacttccaattaactagttttgaca

SEQ ID NO: 68834 - DNA, 23 bp, Homo sapiens
attggtcgtggttgtagtccgtg

SEQ ID NO: 68835 - DNA, 19 bp, Homo sapiens
ggtaatcgcataaaactta

SEQ ID NO: 68836 - DNA, 31 bp, Homo sapiens
acgcgggagaccggggttcgattccccgacg

SEQ ID NO: 68837 - DNA, 23 bp, Homo sapiens
cttaaacccccttatttctacca

SEQ ID NO: 68838 - DNA, 29 bp, Homo sapiens
accggagatgaaaacctttttccaaggac

SEQ ID NO: 68839 - DNA, 21 bp, Homo sapiens
cgattcccggccaacgcacca

SEQ ID NO: 68840 - DNA, 18 bp, Homo sapiens
agtggttagtatccccgc

SEQ ID NO: 68841 - DNA, 33 bp, Homo sapiens; identical to SEQ ID NO: 66417

SEQ ID NO: 68842 - DNA, 18 bp, Homo sapiens
acgcgggagaccggggtt

SEQ ID NO: 68843 - DNA, 22 bp, Homo sapiens
tacctcctcaaagcaatacact

SEQ ID NO: 68844 - DNA, 18 bp, Homo sapiens
ggagcttaaaccccctta

SEQ ID NO: 68845 - DNA, 30 bp, Homo sapiens
gttaagatggcagagcccggtaatcgcata

SEQ ID NO: 68846 - DNA, 41 bp, Homo sapiens
agttaaagattaagagaaccaacacctctttacagtgacca

SEQ ID NO: 68847 - DNA, 33 bp, Homo sapiens; identical to SEQ ID NO: 67214

SEQ ID NO: 68848 - DNA, 42 bp, Homo sapiens
agctgttaactaagtgtttgtgggtttaagtcccattggtct

SEQ ID NO: 68849 - DNA, 17 bp, Homo sapiens
tctcggtggaacctcca

SEQ ID NO: 68850 - DNA, 30 bp, Homo sapiens; identical to SEQ ID NO: 66785

SEQ ID NO: 68851 - DNA, 21 bp, Homo sapiens
ttaacttgaccgctctgacca

SEQ ID NO: 68852 - DNA, 30 bp, Homo sapiens
tcagtaagttgcaatacttaatttctgcca

SEQ ID NO: 68853 - DNA, 19 bp, Homo sapiens
cgtggttgtagtccgtgcg

SEQ ID NO: 68854 - DNA, 25 bp, Homo sapiens
ggagttaaagactttttctctgacc

SEQ ID NO: 68855 - DNA, 41 bp, Homo sapiens; identical to SEQ ID NO: 67266

SEQ ID NO: 68856 - DNA, 20 bp, Homo sapiens
cggtaatcgcataaaactta

SEQ ID NO: 68857 - DNA, 40 bp, Homo sapiens
aactttacagtcagaggttcaattcctcttcttaacacca

SEQ ID NO: 68858 - DNA, 40 bp, Homo sapiens; identical to SEQ ID NO: 66652

SEQ ID NO: 68859 - DNA, 27 bp, Homo sapiens
gaccaagagccttcaaagccctcagta

SEQ ID NO: 68860 - DNA, 34 bp, Homo sapiens
ggagaccggggttcaattccccgacggggagcca

SEQ ID NO: 68861 - DNA, 25 bp, Homo sapiens
gggctcacatcaccccataaacacc

SEQ ID NO: 68862 - DNA, 20 bp, Homo sapiens
cagagcccggtaatcgcata

SEQ ID NO: 68863 - DNA, 37 bp, Homo sapiens
attcgaagaagcagcttcaaacctgccggggcttcca

SEQ ID NO: 68864 - DNA, 19 bp, Homo sapiens
gccccagtggcctaatgga

SEQ ID NO: 68865 - DNA, 23 bp, Homo sapiens
tggtcgtggttgtagtccgtgcg

SEQ ID NO: 68866 - DNA, 45 bp, Homo sapiens
agctatcgggcccataccccgaaaatgttggttatacccttcccg

SEQ ID NO: 68867 - DNA, 42 bp, Homo sapiens; identical to SEQ ID NO: 67174

SEQ ID NO: 68868 - DNA, 26 bp, Homo sapiens
gaaaatgtttagacgggctcacatca

SEQ ID NO: 68869 - DNA, 20 bp, Homo sapiens
tacgaccccttatttacccc

SEQ ID NO: 68870 - DNA, 30 bp, Homo sapiens; identical to SEQ ID NO: 66560

SEQ ID NO: 68871 - DNA, 31 bp, Homo sapiens; identical to SEQ ID NO: 66502

SEQ ID NO: 68872 - DNA, 21 bp, Homo sapiens
ttaggcctctttttaccacca

SEQ ID NO: 68873 - DNA, 43 bp, Homo sapiens
gagaaagctcacaagaactgctaactcatgcccccatgtctaa

SEQ ID NO: 68874 - DNA, 19 bp, Homo sapiens
actcccggtgtgggaacca

SEQ ID NO: 68875 - DNA, 18 bp, Homo sapiens
agtccgtgcgagaatacc

SEQ ID NO: 68876 - DNA, 33 bp, Homo sapiens; identical to SEQ ID NO: 67986

SEQ ID NO: 68877 - DNA, 27 bp, Homo sapiens
gtcgtggttgtagtccgtgcgagaata

SEQ ID NO: 68878 - DNA, 26 bp, Homo sapiens
cggagatgaaaacctttttccaagga

SEQ ID NO: 68879 - DNA, 31 bp, Homo sapiens; identical to SEQ ID NO: 66456

SEQ ID NO: 68880 - DNA, 18 bp, Homo sapiens
caacatggctttctcacc

SEQ ID NO: 68881 - DNA, 31 bp, Homo sapiens; identical to SEQ ID NO: 66690

SEQ ID NO: 68882 - DNA, 31 bp, Homo sapiens; identical to SEQ ID NO: 68058

SEQ ID NO: 68883 - DNA, 31 bp, Homo sapiens; identical to SEQ ID NO: 66632

SEQ ID NO: 68884 - DNA, 20 bp, Homo sapiens
gctaatggtggagttaaaga

SEQ ID NO: 68885 - DNA, 45 bp, Homo sapiens
aattgcaaattcgaagaagcagcttcaaacctgccggggcttcca

SEQ ID NO: 68886 - DNA, 29 bp, Homo sapiens
gcccggctagctcagtcggtagagcatgg

SEQ ID NO: 68887 - DNA, 23 bp, Homo sapiens
gctaaatcctatatatcttacca

SEQ ID NO: 68888 - DNA, 45 bp, Homo sapiens
caaaacatcagattgtgaatctgacaacagaggcttacgacccct

SEQ ID NO: 68889 - DNA, 27 bp, Homo sapiens
ccggagatgaaaacctttttccaagga

SEQ ID NO: 68890 - DNA, 22 bp, Homo sapiens
tcgagtcccacctggggtacca

SEQ ID NO: 68891 - DNA, 33 bp, Homo sapiens; identical to SEQ ID NO: 66710

SEQ ID NO: 68892 - DNA, 34 bp, Homo sapiens
atatcattggtcgtggttgtagtccgtgcgagaa

SEQ ID NO: 68893 - DNA, 41 bp, Homo sapiens
ggcccataccccgaaaatgttggttatacccttcccgtact

SEQ ID NO: 68894 - DNA, 33 bp, Homo sapiens
actcttttagtataaatagtaccgttaacttcc

SEQ ID NO: 68895 - DNA, 30 bp, Homo sapiens
atgcagagtggggttttgcagtccttacca

SEQ ID NO: 68896 - DNA, 33 bp, Homo sapiens; identical to SEQ ID NO: 67962

SEQ ID NO: 68897 - DNA, 41 bp, Homo sapiens
aacttagcattaaccttttaagttaaagattaagagaacca

SEQ ID NO: 68898 - DNA, 36 bp, Homo sapiens; identical to SEQ ID NO: 66536

SEQ ID NO: 68899 - DNA, 30 bp, Homo sapiens
ctcagggatgggttcgattctcatagtcct

SEQ ID NO: 68900 - DNA, 28 bp, Homo sapiens
ggctagctcagtcggtagagcatgagac

SEQ ID NO: 68901 - DNA, 30 bp, Homo sapiens; identical to SEQ ID NO: 66514

SEQ ID NO: 68902 - DNA, 18 bp, Homo sapiens
aggggtatgattctcggt

SEQ ID NO: 68903 - DNA, 24 bp, Homo sapiens
agcccggtaatcgcataaaactta

SEQ ID NO: 68904 - DNA, 43 bp, Homo sapiens
cccataccccgaaaatgttggttatacccttcccgtactacca

SEQ ID NO: 68905 - DNA, 40 bp, Homo sapiens
taactcatgcccccatgtctaacaacatggctttctcacc

SEQ ID NO: 68906 - DNA, 36 bp, Homo sapiens; identical to SEQ ID NO: 66813

SEQ ID NO: 68907 - DNA, 25 bp, Homo sapiens
ggagatgaaaacctttttccaagga

SEQ ID NO: 68908 - DNA, 31 bp, Homo sapiens; identical to SEQ ID NO: 67147

SEQ ID NO: 68909 - DNA, 33 bp, Homo sapiens; identical to SEQ ID NO: 67849

SEQ ID NO: 68910 - DNA, 34 bp, Homo sapiens
agaatcttagctttgggtgctaatggtggagtta

SEQ ID NO: 68911 - DNA, 29 bp, Homo sapiens
ccgtgatcgtatagtggttagtactctgc

SEQ ID NO: 68912 - DNA, 17 bp, Homo sapiens
gtccgtgcgagaatacc

SEQ ID NO: 68913 - DNA, 42 bp, Homo sapiens; identical to SEQ ID NO: 66534

SEQ ID NO: 68914 - DNA, 25 bp, Homo sapiens
gaggcttacgaccccttatttaccc

SEQ ID NO: 68915 - DNA, 42 bp, Homo sapiens
ggcccataccccgaaaatgttggttatacccttcccgtacta

SEQ ID NO: 68916 - DNA, 28 bp, Homo sapiens
ggtcgtggttgtagtccgtgcgagaata

SEQ ID NO: 68917 - DNA, 39 bp, Homo sapiens
attcttgcgacccgggttcgattcccgggcggcgcacca

SEQ ID NO: 68918 - DNA, 40 bp, Homo sapiens
acttagcattaaccttttaagttaaagattaagagaacca

SEQ ID NO: 68919 - DNA, 16 bp, Homo sapiens
ggtagcgtggccgagc

SEQ ID NO: 68920 - DNA, 41 bp, Homo sapiens
gcaaattcgaagaagcagcttcaaacctgccggggcttcca

SEQ ID NO: 68921 - DNA, 26 bp, Homo sapiens
ttgacaacattcaaaaaagagtacca

SEQ ID NO: 68922 - DNA, 25 bp, Homo sapiens
gaaccaacacctctttacagtgacc

SEQ ID NO: 68923 - DNA, 26 bp, Homo sapiens
gtggttgtagtccgtgcgagaatacc

SEQ ID NO: 68924 - DNA, 34 bp, Homo sapiens
cagctttggggggttcgattccttccttttttgc

SEQ ID NO: 68925 - DNA, 40 bp, Homo sapiens
acgtatgaggccccgggttcaatccccggcatctccacca

SEQ ID NO: 68926 - DNA, 34 bp, Homo sapiens; identical to SEQ ID NO: 68047

SEQ ID NO: 68927 - DNA, 28 bp, Homo sapiens
ggtggagttaaagactttttctctgacc

SEQ ID NO: 68928 - DNA, 18 bp, Homo sapiens
gtcctgccgcggtcgcca

SEQ ID NO: 68929 - DNA, 34 bp, Homo sapiens
ccgaaaatgttggttatacccttcccgtactacc

SEQ ID NO: 68930 - DNA, 46 bp, Homo sapiens; identical to SEQ ID NO: 66679

SEQ ID NO: 68931 - DNA, 33 bp, Homo sapiens; identical to SEQ ID NO: 67947

SEQ ID NO: 68932 - DNA, 23 bp, Homo sapiens
gttgtagtccgtgcgagaatacc

SEQ ID NO: 68933 - DNA, 28 bp, Homo sapiens
ggattcggcgctctcaccgccgcggccc

SEQ ID NO: 68934 - DNA, 28 bp, Homo sapiens
gaatcttagctttgggtgctaatggtgg

SEQ ID NO: 68935 - DNA, 28 bp, Homo sapiens
agaatcttagctttgggtgctaatggtg

SEQ ID NO: 68936 - DNA, 35 bp, Homo sapiens
gtttatgtagcttacctcctcaaagcaatacactg

SEQ ID NO: 68937 - DNA, 21 bp, Homo sapiens
gatgcagagtggggttttgca

SEQ ID NO: 68938 - DNA, 22 bp, Homo sapiens
agaccggggttcgattccccga

SEQ ID NO: 68939 - DNA, 36 bp, Homo sapiens
tctcagggatgggttcgattctcatagtcctagcca

SEQ ID NO: 68940 - DNA, 34 bp, Homo sapiens
tgacaacagaggcttacgaccccttatttacccc

SEQ ID NO: 68941 - DNA, 28 bp, Homo sapiens
aggagcttaaacccccttatttctacca

SEQ ID NO: 68942 - DNA, 29 bp, Homo sapiens
agagaaccaacacctctttacagtgacca

SEQ ID NO: 68943 - DNA, 19 bp, Homo sapiens
acaacatggctttctcacc

SEQ ID NO: 68944 - DNA, 26 bp, Homo sapiens
agcaatacactgaaaatgtttagacg

SEQ ID NO: 68945 - DNA, 43 bp, Homo sapiens; identical to SEQ ID NO: 67163

SEQ ID NO: 68946 - DNA, 31 bp, Homo sapiens; identical to SEQ ID NO: 66460

SEQ ID NO: 68947 - DNA, 22 bp, Homo sapiens
tcgaaaccgggcggaaacacca

SEQ ID NO: 68948 - DNA, 35 bp, Homo sapiens
aacatcagattgtgaatctgacaacagaggcttac

SEQ ID NO: 68949 - DNA, 31 bp, Homo sapiens
gcccccatgtctaacaacatggctttctcac

SEQ ID NO: 68950 - DNA, 18 bp, Homo sapiens
ggtcgtggttgtagtccg

SEQ ID NO: 68951 - DNA, 38 bp, Homo sapiens; identical to SEQ ID NO: 66623

SEQ ID NO: 68952 - DNA, 32 bp, Homo sapiens
atatcattggtcgtggttgtagtccgtgcgag

SEQ ID NO: 68953 - DNA, 22 bp, Homo sapiens
taacaacatggctttctcacca

SEQ ID NO: 68954 - DNA, 31 bp, Homo sapiens; identical to SEQ ID NO: 66675

SEQ ID NO: 68955 - DNA, 40 bp, Homo sapiens
agcccggtaatcgcataaaacttaaaactttacagtcaga

SEQ ID NO: 68956 - DNA, 22 bp, Homo sapiens
tcgaatccgagtcacggcacca

SEQ ID NO: 68957 - DNA, 17 bp, Homo sapiens
atcctgccgactacgcc

SEQ ID NO: 68958 - DNA, 27 bp, Homo sapiens
gtccttgtagtataaactaatacacca

SEQ ID NO: 68959 - DNA, 22 bp, Homo sapiens
tcgatgcccgcatcctccacca

SEQ ID NO: 68960 - DNA, 18 bp, Homo sapiens
aacctgccggggcttcca

SEQ ID NO: 68961 - DNA, 24 bp, Homo sapiens
gagttaaagactttttctctgacc

SEQ ID NO: 68962 - DNA, 17 bp, Homo sapiens
gcccggctagctcagtc

SEQ ID NO: 68963 - DNA, 16 bp, Homo sapiens
tccccggcacctccac

SEQ ID NO: 68964 - DNA, 32 bp, Homo sapiens; identical to SEQ ID NO: 66786

SEQ ID NO: 68965 - DNA, 41 bp, Homo sapiens
ttacacttaggagatttcaacttaacttgaccgctctgacc

SEQ ID NO: 68966 - DNA, 18 bp, Homo sapiens
agtcggtagagcatcaga

SEQ ID NO: 68967 - DNA, 23 bp, Homo sapiens
aacttaacttgaccgctctgacc

SEQ ID NO: 68968 - DNA, 29 bp, Homo sapiens
gcatgggtggttcagtggtagaattctcg

SEQ ID NO: 68969 - DNA, 16 bp, Homo sapiens
ccccttatttctacca

SEQ ID NO: 68970 - DNA, 23 bp, Homo sapiens
gaaaatgtttagacgggctcaca

SEQ ID NO: 68971 - DNA, 35 bp, Homo sapiens
gtcacgcgggagaccggggttcgattccccgacgg

SEQ ID NO: 68972 - DNA, 29 bp, Homo sapiens
tatcattggtcgtggttgtagtccgtgcg

SEQ ID NO: 68973 - DNA, 17 bp, Homo sapiens
agtggttagtatccccg

SEQ ID NO: 68974 - DNA, 20 bp, Homo sapiens
cttacctcctcaaagcaata

SEQ ID NO: 68975 - DNA, 39 bp, Homo sapiens; identical to SEQ ID NO: 66707

SEQ ID NO: 68976 - DNA, 17 bp, Homo sapiens
acagctatccattggtc

SEQ ID NO: 68977 - DNA, 31 bp, Homo sapiens; identical to SEQ ID NO: 66740

SEQ ID NO: 68978 - DNA, 23 bp, Homo sapiens
tcccacatggtctagcggttagg

SEQ ID NO: 68979 - DNA, 37 bp, Homo sapiens
gttaagatggcagagcccggtaatcgcataaaactta

SEQ ID NO: 68980 - DNA, 32 bp, Homo sapiens
aagtgtttgtgggtttaagtcccattggtcta

SEQ ID NO: 68981 - DNA, 19 bp, Homo sapiens
atccccagcacctccacca

SEQ ID NO: 68982 - DNA, 44 bp, Homo sapiens
gattgtgaatctgacaacagaggcttacgaccccttatttaccc

SEQ ID NO: 68983 - DNA, 29 bp, Homo sapiens
gcgggagaccggggttcgattccccgacg

SEQ ID NO: 68984 - DNA, 44 bp, Homo sapiens
gagaaagctcacaagaactgctaactcatgcccccatgtctaac

SEQ ID NO: 68985 - DNA, 35 bp, Homo sapiens
gcattaaccttttaagttaaagattaagagaacca

SEQ ID NO: 68986 - DNA, 38 bp, Homo sapiens
agaatcttagctttgggtgctaatggtggagttaaaga

SEQ ID NO: 68987 - DNA, 34 bp, Homo sapiens
ggtttttcatatcattggtcgtggttgtagtccg

SEQ ID NO: 68988 - DNA, 42 bp, Homo sapiens; identical to SEQ ID NO: 66647

SEQ ID NO: 68989 - DNA, 22 bp, Homo sapiens
tcgatcccgggcggaaacacca

SEQ ID NO: 68990 - DNA, 21 bp, Homo sapiens
gacaacagaggcttacgaccc

SEQ ID NO: 68991 - DNA, 35 bp, Homo sapiens
tccctggtggtctagtggctaggattcggcgcttt

SEQ ID NO: 68992 - DNA, 36 bp, Homo sapiens; identical to SEQ ID NO: 66792

SEQ ID NO: 68993 - DNA, 35 bp, Homo sapiens; identical to SEQ ID NO: 68032

SEQ ID NO: 68994 - DNA, 33 bp, Homo sapiens
gagaccggggttcaattccccgacggggagcca

SEQ ID NO: 68995 - DNA, 31 bp, Homo sapiens
agctccgaggtgattttcatattgaattgca

SEQ ID NO: 68996 - DNA, 21 bp, Homo sapiens
tggttgtagtccgtgcgagaa

SEQ ID NO: 68997 - DNA, 17 bp, Homo sapiens
acagaggcttacgaccc

SEQ ID NO: 68998 - DNA, 36 bp, Homo sapiens
aaacatcagattgtgaatctgacaacagaggcttac

SEQ ID NO: 68999 - DNA, 19 bp, Homo sapiens
tagtggttagtatccccgc

SEQ ID NO: 69000 - DNA, 38 bp, Homo sapiens
aacatcagattgtgaatctgacaacagaggcttacgac

SEQ ID NO: 69001 - DNA, 19 bp, Homo sapiens
agtcccattggtctagcca

SEQ ID NO: 69002 - DNA, 42 bp, Homo sapiens
gcacgtatgaggccccgggttcaatccccggcatctccacca

SEQ ID NO: 69003 - DNA, 32 bp, Homo sapiens
ggttccatagtgtagtggttatcacgtctgct

SEQ ID NO: 69004 - DNA, 34 bp, Homo sapiens
actcttttagtataaatagtaccgttaacttcca

SEQ ID NO: 69005 - DNA, 23 bp, Homo sapiens
ggctcacatcaccccataaacac

SEQ ID NO: 69006 - DNA, 22 bp, Homo sapiens
tcgagtcccttcgtggtcgcca

SEQ ID NO: 69007 - DNA, 44 bp, Homo sapiens
tgttaactaagtgtttgtgggtttaagtcccattggtctagcca

SEQ ID NO: 69008 - DNA, 39 bp, Homo sapiens
gaatctgacaacagaggcttacgaccccttatttacccc

SEQ ID NO: 69009 - DNA, 22 bp, Homo sapiens
gttaggcctctttttaccacca

SEQ ID NO: 69010 - DNA, 33 bp, Homo sapiens; identical to SEQ ID NO: 66162

SEQ ID NO: 69011 - DNA, 33 bp, Homo sapiens; identical to SEQ ID NO: 66152

SEQ ID NO: 69012 - DNA, 32 bp, Homo sapiens; identical to SEQ ID NO: 66157

SEQ ID NO: 69013 - DNA, 33 bp, Homo sapiens; identical to SEQ ID NO: 66159

SEQ ID NO: 69014 - DNA, 31 bp, Homo sapiens; identical to SEQ ID NO: 66161

SEQ ID NO: 69015 - DNA, 33 bp, Homo sapiens; identical to SEQ ID NO: 66164

SEQ ID NO: 69016 - DNA, 31 bp, Homo sapiens; identical to SEQ ID NO: 66166

SEQ ID NO: 69017 - DNA, 18 bp, Homo sapiens
tccccggcatctccacca

SEQ ID NO: 69018 - DNA, 36 bp, Homo sapiens; identical to SEQ ID NO: 66178

SEQ ID NO: 69019 - DNA, 18 bp, Homo sapiens
tccccggcacctccacca

SEQ ID NO: 69020 - DNA, 32 bp, Homo sapiens; identical to SEQ ID NO: 66175

SEQ ID NO: 69021 - DNA, 31 bp, Homo sapiens; identical to SEQ ID NO: 66165

SEQ ID NO: 69022 - DNA, 35 bp, Homo sapiens; identical to SEQ ID NO: 66180

SEQ ID NO: 69023 - DNA, 18 bp, Homo sapiens
tccccagtacctccacca

SEQ ID NO: 69024 - DNA, 17 bp, Homo sapiens
ccccggcatctccacca

SEQ ID NO: 69025 - DNA, 32 bp, Homo sapiens; identical to SEQ ID NO: 66174

SEQ ID NO: 69026 - DNA, 43 bp, Homo sapiens; identical to SEQ ID NO: 66219

SEQ ID NO: 69027 - DNA, 39 bp, Homo sapiens; identical to SEQ ID NO: 66190

SEQ ID NO: 69028 - DNA, 34 bp, Homo sapiens; identical to SEQ ID NO: 66183

SEQ ID NO: 69029 - DNA, 18 bp, Homo sapiens
atcccaccgctgccacca

SEQ ID NO: 69030 - DNA, 34 bp, Homo sapiens; identical to SEQ ID NO: 66187

SEQ ID NO: 69031 - DNA, 17 bp, Homo sapiens
accgggcggaaacacca

SEQ ID NO: 69032 - DNA, 41 bp, Homo sapiens; identical to SEQ ID NO: 66209

SEQ ID NO: 69033 - DNA, 33 bp, Homo sapiens; identical to SEQ ID NO: 66179

SEQ ID NO: 69034 - DNA, 34 bp, Homo sapiens; identical to SEQ ID NO: 66188

SEQ ID NO: 69035 - DNA, 19 bp, Homo sapiens
catcaccccataaacacca

SEQ ID NO: 69036 - DNA, 34 bp, Homo sapiens; identical to SEQ ID NO: 66191

SEQ ID NO: 69037 - DNA, 17 bp, Homo sapiens
ccccggcacctccacca

SEQ ID NO: 69038 - DNA, 25 bp, Homo sapiens
ggctcacatcaccccataaacacca

SEQ ID NO: 69039 - DNA, 17 bp, Homo sapiens
tccgggtgccccctcca

SEQ ID NO: 69040 - DNA, 42 bp, Homo sapiens; identical to SEQ ID NO: 66182

SEQ ID NO: 69041 - DNA, 33 bp, Homo sapiens; identical to SEQ ID NO: 66205

SEQ ID NO: 69042 - DNA, 38 bp, Homo sapiens; identical to SEQ ID NO: 66208

SEQ ID NO: 69043 - DNA, 35 bp, Homo sapiens; identical to SEQ ID NO: 66210

SEQ ID NO: 69044 - DNA, 22 bp, Homo sapiens
tcaatccccggcacctccacca

SEQ ID NO: 69045 - DNA, 40 bp, Homo sapiens; identical to SEQ ID NO: 66203

SEQ ID NO: 69046 - DNA, 18 bp, Homo sapiens
atccgggtgccccctcca

SEQ ID NO: 69047 - DNA, 34 bp, Homo sapiens; identical to SEQ ID NO: 66217

SEQ ID NO: 69048 - DNA, 16 bp, Homo sapiens
ccgggcggaaacacca

SEQ ID NO: 69049 - DNA, 34 bp, Homo sapiens; identical to SEQ ID NO: 66215

SEQ ID NO: 69050 - DNA, 44 bp, Homo sapiens; identical to SEQ ID NO: 66233

SEQ ID NO: 69051 - DNA, 34 bp, Homo sapiens; identical to SEQ ID NO: 66236

SEQ ID NO: 69052 - DNA, 39 bp, Homo sapiens; identical to SEQ ID NO: 66256

SEQ ID NO: 69053 - DNA, 21 bp, Homo sapiens
aacacctctttacagtgacca

SEQ ID NO: 69054 - DNA, 32 bp, Homo sapiens; identical to SEQ ID NO: 66246

SEQ ID NO: 69055 - DNA, 33 bp, Homo sapiens; identical to SEQ ID NO: 66225

SEQ ID NO: 69056 - DNA, 34 bp, Homo sapiens; identical to SEQ ID NO: 66244

SEQ ID NO: 69057 - DNA, 46 bp, Homo sapiens; identical to SEQ ID NO: 66242

SEQ ID NO: 69058 - DNA, 46 bp, Homo sapiens; identical to SEQ ID NO: 66248

SEQ ID NO: 69059 - DNA, 43 bp, Homo sapiens; identical to SEQ ID NO: 66261

SEQ ID NO: 69060 - DNA, 32 bp, Homo sapiens; identical to SEQ ID NO: 66196

SEQ ID NO: 69061 - DNA, 17 bp, Homo sapiens
tccggctcgaaggacca

SEQ ID NO: 69062 - DNA, 33 bp, Homo sapiens; identical to SEQ ID NO: 66212

SEQ ID NO: 69063 - DNA, 31 bp, Homo sapiens; identical to SEQ ID NO: 66240

SEQ ID NO: 69064 - DNA, 34 bp, Homo sapiens; identical to SEQ ID NO: 66267

SEQ ID NO: 69065 - DNA, 20 bp, Homo sapiens
acacctctttacagtgacca

SEQ ID NO: 69066 - DNA, 33 bp, Homo sapiens; identical to SEQ ID NO: 66200

SEQ ID NO: 69067 - DNA, 35 bp, Homo sapiens; identical to SEQ ID NO: 66274

SEQ ID NO: 69068 - DNA, 18 bp, Homo sapiens
aaccgggcggaaacacca

SEQ ID NO: 69069 - DNA, 32 bp, Homo sapiens; identical to SEQ ID NO: 66222

SEQ ID NO: 69070 - DNA, 28 bp, Homo sapiens
cggctagctcagtcggtagagcatggga

SEQ ID NO: 69071 - DNA, 40 bp, Homo sapiens; identical to SEQ ID NO: 66308

SEQ ID NO: 69072 - DNA, 24 bp, Homo sapiens
gctcacatcaccccataaacacca

SEQ ID NO: 69073 - DNA, 17 bp, Homo sapiens
cctctttacagtgacca

SEQ ID NO: 69074 - DNA, 36 bp, Homo sapiens; identical to SEQ ID NO: 66304

SEQ ID NO: 69075 - DNA, 35 bp, Homo sapiens; identical to SEQ ID NO: 66270

SEQ ID NO: 69076 - DNA, 32 bp, Homo sapiens; identical to SEQ ID NO: 66263

SEQ ID NO: 69077 - DNA, 37 bp, Homo sapiens; identical to SEQ ID NO: 66313

SEQ ID NO: 69078 - DNA, 39 bp, Homo sapiens; identical to SEQ ID NO: 66296

SEQ ID NO: 69079 - DNA, 45 bp, Homo sapiens; identical to SEQ ID NO: 66310

SEQ ID NO: 69080 - DNA, 32 bp, Homo sapiens; identical to SEQ ID NO: 66259

SEQ ID NO: 69081 - DNA, 18 bp, Homo sapiens
atcccagcggggcctcca

SEQ ID NO: 69082 - DNA, 32 bp, Homo sapiens; identical to SEQ ID NO: 66292

SEQ ID NO: 69083 - DNA, 36 bp, Homo sapiens; identical to SEQ ID NO: 66305

SEQ ID NO: 69084 - DNA, 45 bp, Homo sapiens; identical to SEQ ID NO: 66324

SEQ ID NO: 69085 - DNA, 39 bp, Homo sapiens; identical to SEQ ID NO: 66311

SEQ ID NO: 69086 - DNA, 28 bp, Homo sapiens
cggctagctcagtcggtagagcatgaga

SEQ ID NO: 69087 - DNA, 36 bp, Homo sapiens; identical to SEQ ID NO: 66312

SEQ ID NO: 69088 - DNA, 42 bp, Homo sapiens; identical to SEQ ID NO: 66306

SEQ ID NO: 69089 - DNA, 43 bp, Homo sapiens; identical to SEQ ID NO: 66609

SEQ ID NO: 69090 - DNA, 41 bp, Homo sapiens; identical to SEQ ID NO: 66294

SEQ ID NO: 69091 - DNA, 21 bp, Homo sapiens
cacatcaccccataaacacca

SEQ ID NO: 69092 - DNA, 17 bp, Homo sapiens
tcccaccgctgccacca

SEQ ID NO: 69093 - DNA, 18 bp, Homo sapiens
atcaccccataaacacca

SEQ ID NO: 69094 - DNA, 40 bp, Homo sapiens; identical to SEQ ID NO: 66264

SEQ ID NO: 69095 - DNA, 33 bp, Homo sapiens; identical to SEQ ID NO: 66301

SEQ ID NO: 69096 - DNA, 41 bp, Homo sapiens; identical to SEQ ID NO: 66302

SEQ ID NO: 69097 - DNA, 30 bp, Homo sapiens; identical to SEQ ID NO: 66260

SEQ ID NO: 69098 - DNA, 36 bp, Homo sapiens; identical to SEQ ID NO: 66327

SEQ ID NO: 69099 - DNA, 18 bp, Homo sapiens
tccccgacacctccacca

SEQ ID NO: 69100 - DNA, 34 bp, Homo sapiens; identical to SEQ ID NO: 66354

SEQ ID NO: 69101 - DNA, 41 bp, Homo sapiens; identical to SEQ ID NO: 66455

SEQ ID NO: 69102 - DNA, 40 bp, Homo sapiens; identical to SEQ ID NO: 66369

SEQ ID NO: 69103 - DNA, 33 bp, Homo sapiens; identical to SEQ ID NO: 66285

SEQ ID NO: 69104 - DNA, 18 bp, Homo sapiens
acctctttacagtgacca

SEQ ID NO: 69105 - DNA, 27 bp, Homo sapiens
gtggttgtagtccgtgcgagaatacca

SEQ ID NO: 69106 - DNA, 39 bp, Homo sapiens; identical to SEQ ID NO: 66273

SEQ ID NO: 69107 - DNA, 30 bp, Homo sapiens; identical to SEQ ID NO: 66254

SEQ ID NO: 69108 - DNA, 31 bp, Homo sapiens; identical to SEQ ID NO: 66456

SEQ ID NO: 69109 - DNA, 37 bp, Homo sapiens; identical to SEQ ID NO: 66355

SEQ ID NO: 69110 - DNA, 22 bp, Homo sapiens
tcgattcccggcccatgcacca

SEQ ID NO: 69111 - DNA, 17 bp, Homo sapiens
cccgggcggaaacacca

SEQ ID NO: 69112 - DNA, 31 bp, Homo sapiens; identical to SEQ ID NO: 66276

SEQ ID NO: 69113 - DNA, 22 bp, Homo sapiens
tcgactcccggtatgggaacca

SEQ ID NO: 69114 - DNA, 31 bp, Homo sapiens; identical to SEQ ID NO: 66262

SEQ ID NO: 69115 - DNA, 33 bp, Homo sapiens; identical to SEQ ID NO: 66297

SEQ ID NO: 69116 - DNA, 27 bp, Homo sapiens
gaggcttacgaccccttatttacccca

SEQ ID NO: 69117 - DNA, 25 bp, Homo sapiens
ggttcgattccccgacggggagcca

SEQ ID NO: 69118 - DNA, 20 bp, Homo sapiens
acatcaccccataaacacca

SEQ ID NO: 69119 - DNA, 38 bp, Homo sapiens; identical to SEQ ID NO: 66293

SEQ ID NO: 69120 - DNA, 22 bp, Homo sapiens
tcgattcccggccaacgcacca

SEQ ID NO: 69121 - DNA, 35 bp, Homo sapiens; identical to SEQ ID NO: 66432

SEQ ID NO: 69122 - DNA, 25 bp, Homo sapiens
caacttaacttgaccgctctgacca

SEQ ID NO: 69123 - DNA, 34 bp, Homo sapiens; identical to SEQ ID NO: 66336

SEQ ID NO: 69124 - DNA, 17 bp, Homo sapiens
accgggcagaagcacca

SEQ ID NO: 69125 - DNA, 37 bp, Homo sapiens; identical to SEQ ID NO: 66429

SEQ ID NO: 69126 - DNA, 22 bp, Homo sapiens
tcgattcccggccaatgcacca

SEQ ID NO: 69127 - DNA, 37 bp, Homo sapiens; identical to SEQ ID NO: 66331

SEQ ID NO: 69128 - DNA, 46 bp, Homo sapiens; identical to SEQ ID NO: 66703

SEQ ID NO: 69129 - DNA, 22 bp, Homo sapiens
tcgatccccggcatctccacca

SEQ ID NO: 69130 - DNA, 24 bp, Homo sapiens
gacaacattcaaaaaagagtacca

SEQ ID NO: 69131 - DNA, 38 bp, Homo sapiens; identical to SEQ ID NO: 66373

SEQ ID NO: 69132 - DNA, 36 bp, Homo sapiens; identical to SEQ ID NO: 66333

SEQ ID NO: 69133 - DNA, 39 bp, Homo sapiens; identical to SEQ ID NO: 66266

SEQ ID NO: 69134 - DNA, 38 bp, Homo sapiens; identical to SEQ ID NO: 66408

SEQ ID NO: 69135 - DNA, 22 bp, Homo sapiens
tcgatccccagtacctccacca

SEQ ID NO: 69136 - DNA, 42 bp, Homo sapiens; identical to SEQ ID NO: 66325

SEQ ID NO: 69137 - DNA, 36 bp, Homo sapiens; identical to SEQ ID NO: 66376

SEQ ID NO: 69138 - DNA, 16 bp, Homo sapiens
cccggccaacgcacca

SEQ ID NO: 69139 - DNA, 29 bp, Homo sapiens
cggctagctcagtcggtagagcatgagac

SEQ ID NO: 69140 - DNA, 40 bp, Homo sapiens; identical to SEQ ID NO: 66361

SEQ ID NO: 69141 - DNA, 27 bp, Homo sapiens
gatgaaaacctttttccaaggacacca

SEQ ID NO: 69142 - DNA, 42 bp, Homo sapiens; identical to SEQ ID NO: 66446

SEQ ID NO: 69143 - DNA, 45 bp, Homo sapiens; identical to SEQ ID NO: 66405

SEQ ID NO: 69144 - DNA, 45 bp, Homo sapiens; identical to SEQ ID NO: 66581

SEQ ID NO: 69145 - DNA, 22 bp, Homo sapiens
tcgattcccgggcggcgcacca

SEQ ID NO: 69146 - DNA, 29 bp, Homo sapiens
cggctagctcagtcggtagagcatgggac

SEQ ID NO: 69147 - DNA, 35 bp, Homo sapiens; identical to SEQ ID NO: 66371

SEQ ID NO: 69148 - DNA, 28 bp, Homo sapiens
agatgaaaacctttttccaaggacacca

SEQ ID NO: 69149 - DNA, 26 bp, Homo sapiens
gggctcacatcaccccataaacacca

SEQ ID NO: 69150 - DNA, 19 bp, Homo sapiens
atccccggcacctccacca

SEQ ID NO: 69151 - DNA, 18 bp, Homo sapiens
atcctgccgactacgcca

SEQ ID NO: 69152 - DNA, 32 bp, Homo sapiens; identical to SEQ ID NO: 66284

SEQ ID NO: 69153 - DNA, 18 bp, Homo sapiens
gtcccacccggggtacca

SEQ ID NO: 69154 - DNA, 28 bp, Homo sapiens
ggagaccggggttcgattccccgacggg

SEQ ID NO: 69155 - DNA, 36 bp, Homo sapiens; identical to SEQ ID NO: 66348

SEQ ID NO: 69156 - DNA, 18 bp, Homo sapiens
accccgtccgtgcctcca

SEQ ID NO: 69157 - DNA, 36 bp, Homo sapiens; identical to SEQ ID NO: 66329

SEQ ID NO: 69158 - DNA, 18 bp, Homo sapiens
cccccggctcctccacca

SEQ ID NO: 69159 - DNA, 26 bp, Homo sapiens
gagcttaaacccccttatttctacca

SEQ ID NO: 69160 - DNA, 34 bp, Homo sapiens; identical to SEQ ID NO: 66314

SEQ ID NO: 69161 - DNA, 18 bp, Homo sapiens
tgcccgcatcctccacca

SEQ ID NO: 69162 - DNA, 30 bp, Homo sapiens; identical to SEQ ID NO: 66300

SEQ ID NO: 69163 - DNA, 16 bp, Homo sapiens
ccgggtgccccctcca

SEQ ID NO: 69164 - DNA, 18 bp, Homo sapiens
atcccagcggtgcctcca

SEQ ID NO: 69165 - DNA, 33 bp, Homo sapiens; identical to SEQ ID NO: 66468

SEQ ID NO: 69166 - DNA, 46 bp, Homo sapiens; identical to SEQ ID NO: 66443

SEQ ID NO: 69167 - DNA, 31 bp, Homo sapiens; identical to SEQ ID NO: 66315

SEQ ID NO: 69168 - DNA, 42 bp, Homo sapiens; identical to SEQ ID NO: 66418

SEQ ID NO: 69169 - DNA, 37 bp, Homo sapiens; identical to SEQ ID NO: 66415

SEQ ID NO: 69170 - DNA, 29 bp, Homo sapiens
gacgggctcacatcaccccataaacacca

SEQ ID NO: 69171 - DNA, 32 bp, Homo sapiens; identical to SEQ ID NO: 66316

SEQ ID NO: 69172 - DNA, 43 bp, Homo sapiens; identical to SEQ ID NO: 66410

SEQ ID NO: 69173 - DNA, 38 bp, Homo sapiens; identical to SEQ ID NO: 66458

SEQ ID NO: 69174 - DNA, 44 bp, Homo sapiens; identical to SEQ ID NO: 66381

SEQ ID NO: 69175 - DNA, 29 bp, Homo sapiens
caaagcaatacactgaaaatgtttagacg

SEQ ID NO: 69176 - DNA, 32 bp, Homo sapiens; identical to SEQ ID NO: 66350

SEQ ID NO: 69177 - DNA, 30 bp, Homo sapiens; identical to SEQ ID NO: 66636

SEQ ID NO: 69178 - DNA, 45 bp, Homo sapiens; identical to SEQ ID NO: 66427

SEQ ID NO: 69179 - DNA, 18 bp, Homo sapiens
tcccgggcggaaacacca

SEQ ID NO: 69180 - DNA, 32 bp, Homo sapiens; identical to SEQ ID NO: 66290

SEQ ID NO: 69181 - DNA, 39 bp, Homo sapiens; identical to SEQ ID NO: 66445

SEQ ID NO: 69182 - DNA, 30 bp, Homo sapiens; identical to SEQ ID NO: 66337

SEQ ID NO: 69183 - DNA, 17 bp, Homo sapiens
gcccgcattctccacca

SEQ ID NO: 69184 - DNA, 17 bp, Homo sapiens
accccttatttacccca

SEQ ID NO: 69185 - DNA, 36 bp, Homo sapiens; identical to SEQ ID NO: 66384

SEQ ID NO: 69186 - DNA, 46 bp, Homo sapiens; identical to SEQ ID NO: 66518

SEQ ID NO: 69187 - DNA, 17 bp, Homo sapiens
tcccgggcggcgcacca

SEQ ID NO: 69188 - DNA, 32 bp, Homo sapiens; identical to SEQ ID NO: 66380

SEQ ID NO: 69189 - DNA, 37 bp, Homo sapiens; identical to SEQ ID NO: 66493

SEQ ID NO: 69190 - DNA, 35 bp, Homo sapiens; identical to SEQ ID NO: 66436

SEQ ID NO: 69191 - DNA, 33 bp, Homo sapiens; identical to SEQ ID NO: 66298

SEQ ID NO: 69192 - DNA, 19 bp, Homo sapiens
atccccagtacctccacca

SEQ ID NO: 69193 - DNA, 18 bp, Homo sapiens
gtccgtgcgagaatacca

SEQ ID NO: 69194 - DNA, 42 bp, Homo sapiens; identical to SEQ ID NO: 66486

SEQ ID NO: 69195 - DNA, 23 bp, Homo sapiens
cctgtcacgcgggagaccggggt

SEQ ID NO: 69196 - DNA, 30 bp, Homo sapiens; identical to SEQ ID NO: 66295

SEQ ID NO: 69197 - DNA, 29 bp, Homo sapiens
ccggctagctcagtcggtagagcatgaga

SEQ ID NO: 69198 - DNA, 44 bp, Homo sapiens; identical to SEQ ID NO: 66403

SEQ ID NO: 69199 - DNA, 34 bp, Homo sapiens; identical to SEQ ID NO: 66374

SEQ ID NO: 69200 - DNA, 17 bp, Homo sapiens
atcccaccgctgccacc

SEQ ID NO: 69201 - DNA, 28 bp, Homo sapiens
cggatagctcagtcggtagagcatcaga

SEQ ID NO: 69202 - DNA, 22 bp, Homo sapiens
tcgatccccggcacctccacca

SEQ ID NO: 69203 - DNA, 26 bp, Homo sapiens
gaaccaacacctctttacagtgacca

SEQ ID NO: 69204 - DNA, 22 bp, Homo sapiens
ctgtcacgcgggagaccggggt

SEQ ID NO: 69205 - DNA, 33 bp, Homo sapiens; identical to SEQ ID NO: 66365

SEQ ID NO: 69206 - DNA, 39 bp, Homo sapiens; identical to SEQ ID NO: 66506

SEQ ID NO: 69207 - DNA, 22 bp, Homo sapiens
tcgactcccggtgtgggaacca

SEQ ID NO: 69208 - DNA, 33 bp, Homo sapiens; identical to SEQ ID NO: 67214

SEQ ID NO: 69209 - DNA, 46 bp, Homo sapiens; identical to SEQ ID NO: 67119

SEQ ID NO: 69210 - DNA, 32 bp, Homo sapiens; identical to SEQ ID NO: 66491

SEQ ID NO: 69211 - DNA, 19 bp, Homo sapiens
atccccggcatctccacca

SEQ ID NO: 69212 - DNA, 17 bp, Homo sapiens
ccccagtacctccacca

SEQ ID NO: 69213 - DNA, 40 bp, Homo sapiens; identical to SEQ ID NO: 66383

SEQ ID NO: 69214 - DNA, 32 bp, Homo sapiens; identical to SEQ ID NO: 66605

SEQ ID NO: 69215 - DNA, 18 bp, Homo sapiens
atccggctcgaaggacca

SEQ ID NO: 69216 - DNA, 32 bp, Homo sapiens; identical to SEQ ID NO: 66786

SEQ ID NO: 69217 - DNA, 38 bp, Homo sapiens; identical to SEQ ID NO: 66575

SEQ ID NO: 69218 - DNA, 23 bp, Homo sapiens
acaacattcaaaaaagagtacca

SEQ ID NO: 69219 - DNA, 30 bp, Homo sapiens; identical to SEQ ID NO: 66358

SEQ ID NO: 69220 - DNA, 33 bp, Homo sapiens; identical to SEQ ID NO: 66359

SEQ ID NO: 69221 - DNA, 36 bp, Homo sapiens; identical to SEQ ID NO: 66366

SEQ ID NO: 69222 - DNA, 29 bp, Homo sapiens
ccggctagctcagtcggtagagcatggga

SEQ ID NO: 69223 - DNA, 30 bp, Homo sapiens; identical to SEQ ID NO: 66406

SEQ ID NO: 69224 - DNA, 27 bp, Homo sapiens
agaaccaacacctctttacagtgacca

SEQ ID NO: 69225 - DNA, 34 bp, Homo sapiens; identical to SEQ ID NO: 66338

SEQ ID NO: 69226 - DNA, 45 bp, Homo sapiens; identical to SEQ ID NO: 66562

SEQ ID NO: 69227 - DNA, 45 bp, Homo sapiens; identical to SEQ ID NO: 66386

SEQ ID NO: 69228 - DNA, 18 bp, Homo sapiens
acctcagagggggcacca

SEQ ID NO: 69229 - DNA, 31 bp, Homo sapiens; identical to SEQ ID NO: 66395

SEQ ID NO: 69230 - DNA, 39 bp, Homo sapiens; identical to SEQ ID NO: 66339

SEQ ID NO: 69231 - DNA, 37 bp, Homo sapiens; identical to SEQ ID NO: 66520

SEQ ID NO: 69232 - DNA, 30 bp, Homo sapiens; identical to SEQ ID NO: 66397

SEQ ID NO: 69233 - DNA, 33 bp, Homo sapiens; identical to SEQ ID NO: 66439

SEQ ID NO: 69234 - DNA, 35 bp, Homo sapiens; identical to SEQ ID NO: 66646

SEQ ID NO: 69235 - DNA, 31 bp, Homo sapiens; identical to SEQ ID NO: 66411

SEQ ID NO: 69236 - DNA, 24 bp, Homo sapiens
gttgtagtccgtgcgagaatacca

SEQ ID NO: 69237 - DNA, 37 bp, Homo sapiens; identical to SEQ ID NO: 66650

SEQ ID NO: 69238 - DNA, 30 bp, Homo sapiens; identical to SEQ ID NO: 66435

SEQ ID NO: 69239 - DNA, 24 bp, Homo sapiens
ggctcacatcaccccataaacacc

SEQ ID NO: 69240 - DNA, 17 bp, Homo sapiens
tcctgccgactacgcca

SEQ ID NO: 69241 - DNA, 40 bp, Homo sapiens; identical to SEQ ID NO: 66469

SEQ ID NO: 69242 - DNA, 33 bp, Homo sapiens; identical to SEQ ID NO: 66442

SEQ ID NO: 69243 - DNA, 38 bp, Homo sapiens; identical to SEQ ID NO: 66565

SEQ ID NO: 69244 - DNA, 31 bp, Homo sapiens; identical to SEQ ID NO: 66347

SEQ ID NO: 69245 - DNA, 45 bp, Homo sapiens; identical to SEQ ID NO: 66653

SEQ ID NO: 69246 - DNA, 18 bp, Homo sapiens
atcccagtagagcctcca

SEQ ID NO: 69247 - DNA, 22 bp, Homo sapiens
tcaaatcccggacgagccccca

SEQ ID NO: 69248 - DNA, 16 bp, Homo sapiens
ccgggcagaagcacca

SEQ ID NO: 69249 - DNA, 37 bp, Homo sapiens; identical to SEQ ID NO: 66564

SEQ ID NO: 69250 - DNA, 46 bp, Homo sapiens; identical to SEQ ID NO: 66525

SEQ ID NO: 69251 - DNA, 18 bp, Homo sapiens
atcccaccagagtcgcca

SEQ ID NO: 69252 - DNA, 18 bp, Homo sapiens
gagcccggtaatcgcata

SEQ ID NO: 69253 - DNA, 33 bp, Homo sapiens; identical to SEQ ID NO: 66423

SEQ ID NO: 69254 - DNA, 26 bp, Homo sapiens
gagaaagctcacaagaactgctaact

SEQ ID NO: 69255 - DNA, 22 bp, Homo sapiens
tcaatccccggcatctccacca

SEQ ID NO: 69256 - DNA, 16 bp, Homo sapiens
ctctttacagtgacca

SEQ ID NO: 69257 - DNA, 36 bp, Homo sapiens; identical to SEQ ID NO: 66532

SEQ ID NO: 69258 - DNA, 37 bp, Homo sapiens; identical to SEQ ID NO: 66635

SEQ ID NO: 69259 - DNA, 26 bp, Homo sapiens
aggcttacgaccccttatttacccca

SEQ ID NO: 69260 - DNA, 31 bp, Homo sapiens; identical to SEQ ID NO: 66512

SEQ ID NO: 69261 - DNA, 40 bp, Homo sapiens; identical to SEQ ID NO: 66515

SEQ ID NO: 69262 - DNA, 16 bp, Homo sapiens
ccggctcgaaggacca

SEQ ID NO: 69263 - DNA, 41 bp, Homo sapiens; identical to SEQ ID NO: 66412

SEQ ID NO: 69264 - DNA, 18 bp, Homo sapiens
ttcccgggcggcgcacca

SEQ ID NO: 69265 - DNA, 23 bp, Homo sapiens
acttaacttgaccgctctgacca

SEQ ID NO: 69266 - DNA, 38 bp, Homo sapiens; identical to SEQ ID NO: 66511

SEQ ID NO: 69267 - DNA, 38 bp, Homo sapiens; identical to SEQ ID NO: 66441

SEQ ID NO: 69268 - DNA, 16 bp, Homo sapiens
cccgggcggcgcacca

SEQ ID NO: 69269 - DNA, 35 bp, Homo sapiens; identical to SEQ ID NO: 66409

SEQ ID NO: 69270 - DNA, 29 bp, Homo sapiens
gcccggctagctcagtcggtagagcatga

SEQ ID NO: 69271 - DNA, 44 bp, Homo sapiens; identical to SEQ ID NO: 66598

SEQ ID NO: 69272 - DNA, 26 bp, Homo sapiens
gcccggctagctcagtcggtagagca

SEQ ID NO: 69273 - DNA, 25 bp, Homo sapiens
ggggttaggcctctttttaccacca

SEQ ID NO: 69274 - DNA, 35 bp, Homo sapiens; identical to SEQ ID NO: 66573

SEQ ID NO: 69275 - DNA, 35 bp, Homo sapiens; identical to SEQ ID NO: 66631

SEQ ID NO: 69276 - DNA, 31 bp, Homo sapiens; identical to SEQ ID NO: 66477

SEQ ID NO: 69277 - DNA, 33 bp, Homo sapiens; identical to SEQ ID NO: 66394

SEQ ID NO: 69278 - DNA, 31 bp, Homo sapiens; identical to SEQ ID NO: 66461

SEQ ID NO: 69279 - DNA, 30 bp, Homo sapiens; identical to SEQ ID NO: 66541

SEQ ID NO: 69280 - DNA, 35 bp, Homo sapiens; identical to SEQ ID NO: 66595

SEQ ID NO: 69281 - DNA, 36 bp, Homo sapiens; identical to SEQ ID NO: 66678

SEQ ID NO: 69282 - DNA, 24 bp, Homo sapiens
accaacacctctttacagtgacca

SEQ ID NO: 69283 - DNA, 31 bp, Homo sapiens; identical to SEQ ID NO: 66463

SEQ ID NO: 69284 - DNA, 43 bp, Homo sapiens; identical to SEQ ID NO: 66539

SEQ ID NO: 69285 - DNA, 35 bp, Homo sapiens; identical to SEQ ID NO: 67687

SEQ ID NO: 69286 - DNA, 17 bp, Homo sapiens
ccccgacacctccacca

SEQ ID NO: 69287 - DNA, 35 bp, Homo sapiens; identical to SEQ ID NO: 66592

SEQ ID NO: 69288 - DNA, 31 bp, Homo sapiens; identical to SEQ ID NO: 66675

SEQ ID NO: 69289 - DNA, 41 bp, Homo sapiens; identical to SEQ ID NO: 66719

SEQ ID NO: 69290 - DNA, 25 bp, Homo sapiens
gcccggctagctcagtcggtagagc

SEQ ID NO: 69291 - DNA, 18 bp, Homo sapiens
atccaggtgccccctcca

SEQ ID NO: 69292 - DNA, 18 bp, Homo sapiens
atcccatcctcgtcgcca

SEQ ID NO: 69293 - DNA, 23 bp, Homo sapiens
ccaacacctctttacagtgacca

SEQ ID NO: 69294 - DNA, 45 bp, Homo sapiens; identical to SEQ ID NO: 66753

SEQ ID NO: 69295 - DNA, 34 bp, Homo sapiens; identical to SEQ ID NO: 66527

SEQ ID NO: 69296 - DNA, 30 bp, Homo sapiens; identical to SEQ ID NO: 66576

SEQ ID NO: 69297 - DNA, 33 bp, Homo sapiens; identical to SEQ ID NO: 66617

SEQ ID NO: 69298 - DNA, 21 bp, Homo sapiens
tacgaccccttatttacccca

SEQ ID NO: 69299 - DNA, 16 bp, Homo sapiens
ctcggtggaacctcca

SEQ ID NO: 69300 - DNA, 29 bp, Homo sapiens
ccggatagctcagtcggtagagcatcaga

SEQ ID NO: 69301 - DNA, 30 bp, Homo sapiens; identical to SEQ ID NO: 66426

SEQ ID NO: 69302 - DNA, 27 bp, Homo sapiens
atgtctaacaacatggctttctcacca

SEQ ID NO: 69303 - DNA, 33 bp, Homo sapiens; identical to SEQ ID NO: 66417

SEQ ID NO: 69304 - DNA, 46 bp, Homo sapiens; identical to SEQ ID NO: 66679

SEQ ID NO: 69305 - DNA, 34 bp, Homo sapiens; identical to SEQ ID NO: 66697

SEQ ID NO: 69306 - DNA, 42 bp, Homo sapiens; identical to SEQ ID NO: 66534

SEQ ID NO: 69307 - DNA, 46 bp, Homo sapiens; identical to SEQ ID NO: 66805

SEQ ID NO: 69308 - DNA, 30 bp, Homo sapiens; identical to SEQ ID NO: 66551

SEQ ID NO: 69309 - DNA, 29 bp, Homo sapiens
gcgccgctggtgtagtggtatcatgcaag

SEQ ID NO: 69310 - DNA, 40 bp, Homo sapiens; identical to SEQ ID NO: 66649

SEQ ID NO: 69311 - DNA, 39 bp, Homo sapiens; identical to SEQ ID NO: 66661

SEQ ID NO: 69312 - DNA, 40 bp, Homo sapiens; identical to SEQ ID NO: 66779

SEQ ID NO: 69313 - DNA, 30 bp, Homo sapiens; identical to SEQ ID NO: 66712

SEQ ID NO: 69314 - DNA, 34 bp, Homo sapiens; identical to SEQ ID NO: 66466

SEQ ID NO: 69315 - DNA, 43 bp, Homo sapiens; identical to SEQ ID NO: 68429

SEQ ID NO: 69316 - DNA, 42 bp, Homo sapiens; identical to SEQ ID NO: 66638

SEQ ID NO: 69317 - DNA, 34 bp, Homo sapiens
tcctcgttagtatagtggtgagtatccccgcctg

SEQ ID NO: 69318 - DNA, 22 bp, Homo sapiens
gagaaagctcacaagaactgct

SEQ ID NO: 69319 - DNA, 22 bp, Homo sapiens
tcaatccccagcacctccacca

SEQ ID NO: 69320 - DNA, 19 bp, Homo sapiens
agtccgtgcgagaatacca

SEQ ID NO: 69321 - DNA, 37 bp, Homo sapiens; identical to SEQ ID NO: 66794

SEQ ID NO: 69322 - DNA, 18 bp, Homo sapiens
gtcccaccagagtcgcca

SEQ ID NO: 69323 - DNA, 37 bp, Homo sapiens; identical to SEQ ID NO: 66487

SEQ ID NO: 69324 - DNA, 18 bp, Homo sapiens
gaccccttatttacccca

SEQ ID NO: 69325 - DNA, 39 bp, Homo sapiens; identical to SEQ ID NO: 66736

SEQ ID NO: 69326 - DNA, 40 bp, Homo sapiens; identical to SEQ ID NO: 66731

SEQ ID NO: 69327 - DNA, 16 bp, Homo sapiens
gagcccggtaatcgca

SEQ ID NO: 69328 - DNA, 41 bp, Homo sapiens; identical to SEQ ID NO: 66542

SEQ ID NO: 69329 - DNA, 18 bp, Homo sapiens
tcccacccagggacgcca

SEQ ID NO: 69330 - DNA, 40 bp, Homo sapiens; identical to SEQ ID NO: 66578

SEQ ID NO: 69331 - DNA, 40 bp, Homo sapiens; identical to SEQ ID NO: 66543

SEQ ID NO: 69332 - DNA, 24 bp, Homo sapiens
gggttaggcctctttttaccacca

SEQ ID NO: 69333 - DNA, 34 bp, Homo sapiens; identical to SEQ ID NO: 66545

SEQ ID NO: 69334 - DNA, 43 bp, Homo sapiens; identical to SEQ ID NO: 66558

SEQ ID NO: 69335 - DNA, 33 bp, Homo sapiens; identical to SEQ ID NO: 66621

SEQ ID NO: 69336 - DNA, 34 bp, Homo sapiens; identical to SEQ ID NO: 66537

SEQ ID NO: 69337 - DNA, 32 bp, Homo sapiens; identical to SEQ ID NO: 67902

SEQ ID NO: 69338 - DNA, 17 bp, Homo sapiens
tccccggcacctccacc

SEQ ID NO: 69339 - DNA, 36 bp, Homo sapiens; identical to SEQ ID NO: 66676

SEQ ID NO: 69340 - DNA, 36 bp, Homo sapiens; identical to SEQ ID NO: 66618

SEQ ID NO: 69341 - DNA, 45 bp, Homo sapiens; identical to SEQ ID NO: 66528

SEQ ID NO: 69342 - DNA, 35 bp, Homo sapiens; identical to SEQ ID NO: 66614

SEQ ID NO: 69343 - DNA, 22 bp, Homo sapiens
tcgaatcccactcctgacacca

SEQ ID NO: 69344 - DNA, 23 bp, Homo sapiens
gttgcaatacttaatttctgcca

SEQ ID NO: 69345 - DNA, 31 bp, Homo sapiens; identical to SEQ ID NO: 66413

SEQ ID NO: 69346 - DNA, 36 bp, Homo sapiens; identical to SEQ ID NO: 66748

SEQ ID NO: 69347 - DNA, 38 bp, Homo sapiens; identical to SEQ ID NO: 66668

SEQ ID NO: 69348 - DNA, 34 bp, Homo sapiens; identical to SEQ ID NO: 66589

SEQ ID NO: 69349 - DNA, 34 bp, Homo sapiens; identical to SEQ ID NO: 66508

SEQ ID NO: 69350 - DNA, 35 bp, Homo sapiens; identical to SEQ ID NO: 66509

SEQ ID NO: 69351 - DNA, 25 bp, Homo sapiens
ggcttacgaccccttatttacccca

SEQ ID NO: 69352 - DNA, 24 bp, Homo sapiens
gtcgtggttgtagtccgtgcgaga

SEQ ID NO: 69353 - DNA, 34 bp, Homo sapiens; identical to SEQ ID NO: 66593

SEQ ID NO: 69354 - DNA, 17 bp, Homo sapiens
tccccagtacctccacc

SEQ ID NO: 69355 - DNA, 31 bp, Homo sapiens; identical to SEQ ID NO: 66530

SEQ ID NO: 69356 - DNA, 35 bp, Homo sapiens; identical to SEQ ID NO: 66708

SEQ ID NO: 69357 - DNA, 33 bp, Homo sapiens; identical to SEQ ID NO: 66570

SEQ ID NO: 69358 - DNA, 42 bp, Homo sapiens; identical to SEQ ID NO: 67174

SEQ ID NO: 69359 - DNA, 44 bp, Homo sapiens
ttacacgcagaaggtcctgggttcgagccccagtggaaccacca

SEQ ID NO: 69360 - DNA, 41 bp, Homo sapiens; identical to SEQ ID NO: 66470

SEQ ID NO: 69361 - DNA, 22 bp, Homo sapiens
tcacatcaccccataaacacca

SEQ ID NO: 69362 - DNA, 38 bp, Homo sapiens; identical to SEQ ID NO: 66659

SEQ ID NO: 69363 - DNA, 20 bp, Homo sapiens
gcaatacttaatttctgcca

SEQ ID NO: 69364 - DNA, 27 bp, Homo sapiens
ggagcttaaacccccttatttctacca

SEQ ID NO: 69365 - DNA, 35 bp, Homo sapiens; identical to SEQ ID NO: 66559

SEQ ID NO: 69366 - DNA, 29 bp, Homo sapiens
gcatgggtggttcagtggtagaattctcg

SEQ ID NO: 69367 - DNA, 36 bp, Homo sapiens; identical to SEQ ID NO: 66834

SEQ ID NO: 69368 - DNA, 23 bp, Homo sapiens
ctcacatcaccccataaacacca

SEQ ID NO: 69369 - DNA, 18 bp, Homo sapiens
catcaccccataaacacc

SEQ ID NO: 69370 - DNA, 26 bp, Homo sapiens
tggttgtagtccgtgcgagaatacca

SEQ ID NO: 69371 - DNA, 19 bp, Homo sapiens
cgaccccttatttacccca

SEQ ID NO: 69372 - DNA, 43 bp, Homo sapiens; identical to SEQ ID NO: 68446

SEQ ID NO: 69373 - DNA, 25 bp, Homo sapiens
tccattggggtttccccgcgcaggt

SEQ ID NO: 69374 - DNA, 18 bp, Homo sapiens
ttcccggccaacgcacca

SEQ ID NO: 69375 - DNA, 33 bp, Homo sapiens; identical to SEQ ID NO: 66682

SEQ ID NO: 69376 - DNA, 24 bp, Homo sapiens
agttgcaatacttaatttctgcca

SEQ ID NO: 69377 - DNA, 29 bp, Homo sapiens
gcccggctagctcagtcggtagagcatgg

SEQ ID NO: 69378 - DNA, 43 bp, Homo sapiens; identical to SEQ ID NO: 67993

SEQ ID NO: 69379 - DNA, 42 bp, Homo sapiens; identical to SEQ ID NO: 69002

SEQ ID NO: 69380 - DNA, 35 bp, Homo sapiens; identical to SEQ ID NO: 66480

SEQ ID NO: 69381 - DNA, 27 bp, Homo sapiens
gtccttgtagtataaactaatacacca

SEQ ID NO: 69382 - DNA, 31 bp, Homo sapiens; identical to SEQ ID NO: 66460

SEQ ID NO: 69383 - DNA, 24 bp, Homo sapiens
aacttaacttgaccgctctgacca

SEQ ID NO: 69384 - DNA, 26 bp, Homo sapiens
gtccttgtagtataaactaatacacc

SEQ ID NO: 69385 - DNA, 32 bp, Homo sapiens; identical to SEQ ID NO: 69003

SEQ ID NO: 69386 - DNA, 35 bp, Homo sapiens; identical to SEQ ID NO: 66553

SEQ ID NO: 69387 - DNA, 35 bp, Homo sapiens; identical to SEQ ID NO: 68991

SEQ ID NO: 69388 - DNA, 30 bp, Homo sapiens; identical to SEQ ID NO: 66563

SEQ ID NO: 69389 - DNA, 36 bp, Homo sapiens; identical to SEQ ID NO: 67880

SEQ ID NO: 69390 - DNA, 18 bp, Homo sapiens
ggcctctttttaccacca

SEQ ID NO: 69391 - DNA, 29 bp, Homo sapiens
ccgaaaatgttggttatacccttcccgta

SEQ ID NO: 69392 - DNA, 37 bp, Homo sapiens; identical to SEQ ID NO: 67782

SEQ ID NO: 69393 - DNA, 30 bp, Homo sapiens; identical to SEQ ID NO: 66519

SEQ ID NO: 69394 - DNA, 37 bp, Homo sapiens; identical to SEQ ID NO: 66549

SEQ ID NO: 69395 - DNA, 18 bp, Homo sapiens
atccggctcggaggacca

SEQ ID NO: 69396 - DNA, 28 bp, Homo sapiens
acgggctcacatcaccccataaacacca

SEQ ID NO: 69397 - DNA, 34 bp, Homo sapiens; identical to SEQ ID NO: 66667

SEQ ID NO: 69398 - DNA, 20 bp, Homo sapiens
acgaccccttatttacccca

SEQ ID NO: 69399 - DNA, 18 bp, Homo sapiens
aaccgggcagaagcacca

SEQ ID NO: 69400 - DNA, 24 bp, Homo sapiens
gttcgattccccgacggggagcca

SEQ ID NO: 69401 - DNA, 36 bp, Homo sapiens; identical to SEQ ID NO: 68492

SEQ ID NO: 69402 - DNA, 29 bp, Homo sapiens
cagaggcttacgaccccttatttacccca

SEQ ID NO: 69403 - DNA, 32 bp, Homo sapiens; identical to SEQ ID NO: 66531

SEQ ID NO: 69404 - DNA, 31 bp, Homo sapiens; identical to SEQ ID NO: 66690

SEQ ID NO: 69405 - DNA, 19 bp, Homo sapiens
gagaaagctcacaagaact

SEQ ID NO: 69406 - DNA, 40 bp, Homo sapiens; identical to SEQ ID NO: 66503

SEQ ID NO: 69407 - DNA, 35 bp, Homo sapiens; identical to SEQ ID NO: 66758

SEQ ID NO: 69408 - DNA, 25 bp, Homo sapiens
aaccaacacctctttacagtgacca

SEQ ID NO: 69409 - DNA, 41 bp, Homo sapiens; identical to SEQ ID NO: 68893

SEQ ID NO: 69410 - DNA, 33 bp, Homo sapiens; identical to SEQ ID NO: 66158

SEQ ID NO: 69411 - DNA, 32 bp, Homo sapiens; identical to SEQ ID NO: 66474

SEQ ID NO: 69412 - DNA, 38 bp, Homo sapiens; identical to SEQ ID NO: 67783

SEQ ID NO: 69413 - DNA, 32 bp, Homo sapiens; identical to SEQ ID NO: 66789

SEQ ID NO: 69414 - DNA, 35 bp, Homo sapiens; identical to SEQ ID NO: 66749

SEQ ID NO: 69415 - DNA, 39 bp, Homo sapiens; identical to SEQ ID NO: 66713

SEQ ID NO: 69416 - DNA, 30 bp, Homo sapiens; identical to SEQ ID NO: 66514

SEQ ID NO: 69417 - DNA, 33 bp, Homo sapiens; identical to SEQ ID NO: 67831

SEQ ID NO: 69418 - DNA, 21 bp, Homo sapiens
caatccccggcacctccacca

SEQ ID NO: 69419 - DNA, 36 bp, Homo sapiens; identical to SEQ ID NO: 67181

SEQ ID NO: 69420 - DNA, 41 bp, Homo sapiens; identical to SEQ ID NO: 66611

SEQ ID NO: 69421 - DNA, 27 bp, Homo sapiens
cgggctcacatcaccccataaacacca

SEQ ID NO: 69422 - DNA, 45 bp, Homo sapiens; identical to SEQ ID NO: 68539

SEQ ID NO: 69423 - DNA, 34 bp, Homo sapiens; identical to SEQ ID NO: 66655

SEQ ID NO: 69424 - DNA, 32 bp, Homo sapiens; identical to SEQ ID NO: 66716

SEQ ID NO: 69425 - DNA, 25 bp, Homo sapiens
ggttgtagtccgtgcgagaatacca

SEQ ID NO: 69426 - DNA, 28 bp, Homo sapiens
gtttccgtagtgtagtggtcatcacgtt

SEQ ID NO: 69427 - DNA, 26 bp, Homo sapiens
gaggcttacgaccccttatttacccc

SEQ ID NO: 69428 - DNA, 32 bp, Homo sapiens; identical to SEQ ID NO: 66781

SEQ ID NO: 69429 - DNA, 21 bp, Homo sapiens
cgatccccggcatctccacca

SEQ ID NO: 69430 - DNA, 46 bp, Homo sapiens; identical to SEQ ID NO: 68485

SEQ ID NO: 69431 - DNA, 40 bp, Homo sapiens; identical to SEQ ID NO: 66737

SEQ ID NO: 69432 - DNA, 32 bp, Homo sapiens; identical to SEQ ID NO: 66714

SEQ ID NO: 69433 - DNA, 21 bp, Homo sapiens
aacaacatggctttctcacca

SEQ ID NO: 69434 - DNA, 31 bp, Homo sapiens; identical to SEQ ID NO: 66524

SEQ ID NO: 69435 - DNA, 33 bp, Homo sapiens; identical to SEQ ID NO: 66710

SEQ ID NO: 69436 - DNA, 21 bp, Homo sapiens
gtagtccgtgcgagaatacca

SEQ ID NO: 69437 - DNA, 28 bp, Homo sapiens
cgtggttgtagtccgtgcgagaatacca

SEQ ID NO: 69438 - DNA, 44 bp, Homo sapiens; identical to SEQ ID NO: 67155

SEQ ID NO: 69439 - DNA, 38 bp, Homo sapiens; identical to SEQ ID NO: 66744

SEQ ID NO: 69440 - DNA, 28 bp, Homo sapiens
catgtctaacaacatggctttctcacca

SEQ ID NO: 69441 - DNA, 31 bp, Homo sapiens; identical to SEQ ID NO: 67651

SEQ ID NO: 69442 - DNA, 36 bp, Homo sapiens; identical to SEQ ID NO: 66762

SEQ ID NO: 69443 - DNA, 30 bp, Homo sapiens; identical to SEQ ID NO: 66644

SEQ ID NO: 69444 - DNA, 29 bp, Homo sapiens
atttcaacttaacttgaccgctctgacca

SEQ ID NO: 69445 - DNA, 31 bp, Homo sapiens; identical to SEQ ID NO: 66588

SEQ ID NO: 69446 - DNA, 37 bp, Homo sapiens; identical to SEQ ID NO: 68801

SEQ ID NO: 69447 - DNA, 29 bp, Homo sapiens
gtccttgtagtataaactaatacaccagt

SEQ ID NO: 69448 - DNA, 36 bp, Homo sapiens; identical to SEQ ID NO: 66536

SEQ ID NO: 69449 - DNA, 31 bp, Homo sapiens; identical to SEQ ID NO: 66632

SEQ ID NO: 69450 - DNA, 17 bp, Homo sapiens
ccccgtccgtgcctcca

SEQ ID NO: 69451 - DNA, 32 bp, Homo sapiens; identical to SEQ ID NO: 66516

SEQ ID NO: 69452 - DNA, 32 bp, Homo sapiens; identical to SEQ ID NO: 66517

SEQ ID NO: 69453 - DNA, 31 bp, Homo sapiens; identical to SEQ ID NO: 66502

SEQ ID NO: 69454 - DNA, 29 bp, Homo sapiens
gacaggggttaggcctctttttaccacca

SEQ ID NO: 69455 - DNA, 33 bp, Homo sapiens; identical to SEQ ID NO: 66790

SEQ ID NO: 69456 - DNA, 25 bp, Homo sapiens
gagcccggtaatcgcataaaactta

SEQ ID NO: 69457 - DNA, 34 bp, Homo sapiens; identical to SEQ ID NO: 66760

SEQ ID NO: 69458 - DNA, 20 bp, Homo sapiens
acattcaaaaaagagtacca

SEQ ID NO: 69459 - DNA, 39 bp, Homo sapiens; identical to SEQ ID NO: 67999

SEQ ID NO: 69460 - DNA, 41 bp, Homo sapiens; identical to SEQ ID NO: 68462

SEQ ID NO: 69461 - DNA, 40 bp, Homo sapiens; identical to SEQ ID NO: 66602

SEQ ID NO: 69462 - DNA, 32 bp, Homo sapiens; identical to SEQ ID NO: 67931

SEQ ID NO: 69463 - DNA, 44 bp, Homo sapiens; identical to SEQ ID NO: 68419

SEQ ID NO: 69464 - DNA, 40 bp, Homo sapiens; identical to SEQ ID NO: 66840

SEQ ID NO: 69465 - DNA, 30 bp, Homo sapiens; identical to SEQ ID NO: 66560

SEQ ID NO: 69466 - DNA, 39 bp, Homo sapiens; identical to SEQ ID NO: 67082

SEQ ID NO: 69467 - DNA, 16 bp, Homo sapiens
ccgtgcgagaatacca

SEQ ID NO: 69468 - DNA, 18 bp, Homo sapiens
accctgctcgctgcgcca

SEQ ID NO: 69469 - DNA, 33 bp, Homo sapiens
ggccccatggtgtaatggttagcactctggact

SEQ ID NO: 69470 - DNA, 38 bp, Homo sapiens; identical to SEQ ID NO: 66739

SEQ ID NO: 69471 - DNA, 39 bp, Homo sapiens; identical to SEQ ID NO: 67972

SEQ ID NO: 69472 - DNA, 33 bp, Homo sapiens; identical to SEQ ID NO: 66674

SEQ ID NO: 69473 - DNA, 41 bp, Homo sapiens; identical to SEQ ID NO: 66656

SEQ ID NO: 69474 - DNA, 42 bp, Homo sapiens; identical to SEQ ID NO: 68616

SEQ ID NO: 69475 - DNA, 22 bp, Homo sapiens
tcgagccccagtggaaccacca

SEQ ID NO: 69476 - DNA, 30 bp, Homo sapiens; identical to SEQ ID NO: 66627

SEQ ID NO: 69477 - DNA, 46 bp, Homo sapiens; identical to SEQ ID NO: 68629

SEQ ID NO: 69478 - DNA, 21 bp, Homo sapiens
cgatccccagtacctccacca

SEQ ID NO: 69479 - DNA, 28 bp, Homo sapiens
gagaaccaacacctctttacagtgacca

SEQ ID NO: 69480 - DNA, 44 bp, Homo sapiens; identical to SEQ ID NO: 66664

SEQ ID NO: 69481 - DNA, 29 bp, Homo sapiens
gtgtttgtgggtttaagtcccattggtct

SEQ ID NO: 69482 - DNA, 20 bp, Homo sapiens
aacacctctttacagtgacc

SEQ ID NO: 69483 - DNA, 45 bp, Homo sapiens; identical to SEQ ID NO: 68888

SEQ ID NO: 69484 - DNA, 30 bp, Homo sapiens; identical to SEQ ID NO: 66754

SEQ ID NO: 69485 - DNA, 34 bp, Homo sapiens; identical to SEQ ID NO: 67941

SEQ ID NO: 69486 - DNA, 23 bp, Homo sapiens
gttatacccttcccgtactacca

SEQ ID NO: 69487 - DNA, 42 bp, Homo sapiens; identical to SEQ ID NO: 66825

SEQ ID NO: 69488 - DNA, 24 bp, Homo sapiens
ggttatacccttcccgtactacca

SEQ ID NO: 69489 - DNA, 29 bp, Homo sapiens
agcccggtaatcgcataaaacttaaaact

SEQ ID NO: 69490 - DNA, 22 bp, Homo sapiens
tcgaatcccagcggtgcctcca

SEQ ID NO: 69491 - DNA, 35 bp, Homo sapiens; identical to SEQ ID NO: 68032

SEQ ID NO: 69492 - DNA, 26 bp, Homo sapiens
tcaacttaacttgaccgctctgacca

SEQ ID NO: 69493 - DNA, 33 bp, Homo sapiens; identical to SEQ ID NO: 67992

SEQ ID NO: 69494 - DNA, 35 bp, Homo sapiens; identical to SEQ ID NO: 68027

SEQ ID NO: 69495 - DNA, 18 bp, Homo sapiens
ttccggctcgaaggacca

SEQ ID NO: 69496 - DNA, 29 bp, Homo sapiens
cagtaagttgcaatacttaatttctgcca

SEQ ID NO: 69497 - DNA, 22 bp, Homo sapiens
tcgaatcccacttctgacacca

SEQ ID NO: 69498 - DNA, 32 bp, Homo sapiens; identical to SEQ ID NO: 66821

SEQ ID NO: 69499 - DNA, 25 bp, Homo sapiens
gagcttaaacccccttatttctacc

SEQ ID NO: 69500 - DNA, 29 bp, Homo sapiens
ccgtgatcgtatagtggttagtactctgc

SEQ ID NO: 69501 - DNA, 33 bp, Homo sapiens; identical to SEQ ID NO: 68994

SEQ ID NO: 69502 - DNA, 24 bp, Homo sapiens
gtgcaactccaaataaaagtacca

SEQ ID NO: 69503 - DNA, 22 bp, Homo sapiens
caacacctctttacagtgacca

SEQ ID NO: 69504 - DNA, 39 bp, Homo sapiens; identical to SEQ ID NO: 67903

SEQ ID NO: 69505 - DNA, 35 bp, Homo sapiens; identical to SEQ ID NO: 66634

SEQ ID NO: 69506 - DNA, 42 bp, Homo sapiens; identical to SEQ ID NO: 66838

SEQ ID NO: 69507 - DNA, 35 bp, Homo sapiens; identical to SEQ ID NO: 66607

SEQ ID NO: 69508 - DNA, 22 bp, Homo sapiens
tcgatccccgacacctccacca

SEQ ID NO: 69509 - DNA, 25 bp, Homo sapiens
gtctaacaacatggctttctcacca

SEQ ID NO: 69510 - DNA, 27 bp, Homo sapiens
ttcaacttaacttgaccgctctgacca

SEQ ID NO: 69511 - DNA, 27 bp, Homo sapiens
ggagaccggggttcgattccccgacgg

SEQ ID NO: 69512 - DNA, 34 bp, Homo sapiens; identical to SEQ ID NO: 67718

SEQ ID NO: 69513 - DNA, 33 bp, Homo sapiens; identical to SEQ ID NO: 67986

SEQ ID NO: 69514 - DNA, 31 bp, Homo sapiens
gcgccgctggtgtagtggtatcatgcaagat

SEQ ID NO: 69515 - DNA, 44 bp, Homo sapiens; identical to SEQ ID NO: 66802

SEQ ID NO: 69516 - DNA, 37 bp, Homo sapiens; identical to SEQ ID NO: 67905

SEQ ID NO: 69517 - DNA, 38 bp, Homo sapiens; identical to SEQ ID NO: 67816

SEQ ID NO: 69518 - DNA, 40 bp, Homo sapiens; identical to SEQ ID NO: 66778

SEQ ID NO: 69519 - DNA, 27 bp, Homo sapiens
aagcaatacactgaaaatgtttagacg

SEQ ID NO: 69520 - DNA, 32 bp, Homo sapiens; identical to SEQ ID NO: 66817

SEQ ID NO: 69521 - DNA, 23 bp, Homo sapiens
ctgtcacgcgggagaccggggtt

SEQ ID NO: 69522 - DNA, 25 bp, Homo sapiens
tgacaacattcaaaaaagagtacca

SEQ ID NO: 69523 - DNA, 38 bp, Homo sapiens; identical to SEQ ID NO: 67895

SEQ ID NO: 69524 - DNA, 31 bp, Homo sapiens; identical to SEQ ID NO: 66740

SEQ ID NO: 69525 - DNA, 30 bp, Homo sapiens; identical to SEQ ID NO: 66372

SEQ ID NO: 69526 - DNA, 39 bp, Homo sapiens; identical to SEQ ID NO: 68554

SEQ ID NO: 69527 - DNA, 25 bp, Homo sapiens
ggttcaatccccggcacctccacca

SEQ ID NO: 69528 - DNA, 23 bp, Homo sapiens
agaccggggttcgattccccgac

SEQ ID NO: 69529 - DNA, 17 bp, Homo sapiens
tccgtgcgagaatacca

SEQ ID NO: 69530 - DNA, 38 bp, Homo sapiens; identical to SEQ ID NO: 68663

SEQ ID NO: 69531 - DNA, 18 bp, Homo sapiens
ctcccggtgtgggaacca

SEQ ID NO: 69532 - DNA, 24 bp, Homo sapiens
ccttccaagcagttgacccgggtt

SEQ ID NO: 69533 - DNA, 25 bp, Homo sapiens
aggctaaatcctatatatcttacca

SEQ ID NO: 69534 - DNA, 31 bp, Homo sapiens; identical to SEQ ID NO: 68058

SEQ ID NO: 69535 - DNA, 19 bp, Homo sapiens
aggcctctttttaccacca

SEQ ID NO: 69536 - DNA, 31 bp, Homo sapiens; identical to SEQ ID NO: 66722

SEQ ID NO: 69537 - DNA, 17 bp, Homo sapiens
agcccggtaatcgcata

SEQ ID NO: 69538 - DNA, 24 bp, Homo sapiens
gaaaacctttttccaaggacacca

SEQ ID NO: 69539 - DNA, 17 bp, Homo sapiens
tccccggcatctccacc

SEQ ID NO: 69540 - DNA, 39 bp, Homo sapiens; identical to SEQ ID NO: 66672

SEQ ID NO: 69541 - DNA, 23 bp, Homo sapiens
ggttaggcctctttttaccacca

SEQ ID NO: 69542 - DNA, 28 bp, Homo sapiens
gcccggctagctcagtcggtagagcatg

SEQ ID NO: 69543 - DNA, 29 bp, Homo sapiens
agtgtttgtgggtttaagtcccattggtc

SEQ ID NO: 69544 - DNA, 38 bp, Homo sapiens; identical to SEQ ID NO: 66623

SEQ ID NO: 69545 - DNA, 33 bp, Homo sapiens; identical to SEQ ID NO: 67038

SEQ ID NO: 69546 - DNA, 35 bp, Homo sapiens; identical to SEQ ID NO: 66709

SEQ ID NO: 69547 - DNA, 44 bp, Homo sapiens; identical to SEQ ID NO: 66604

SEQ ID NO: 69548 - DNA, 23 bp, Homo sapiens
ccttccaagcagttgacccgggt

SEQ ID NO: 69549 - DNA, 33 bp, Homo sapiens; identical to SEQ ID NO: 66693

SEQ ID NO: 69550 - DNA, 19 bp, Homo sapiens
gccccagtggcctaatgga

SEQ ID NO: 69551 - DNA, 31 bp, Homo sapiens; identical to SEQ ID NO: 66478

SEQ ID NO: 69552 - DNA, 34 bp, Homo sapiens; identical to SEQ ID NO: 68500

SEQ ID NO: 69553 - DNA, 32 bp, Homo sapiens; identical to SEQ ID NO: 66830

SEQ ID NO: 69554 - DNA, 41 bp, Homo sapiens; identical to SEQ ID NO: 66535

SEQ ID NO: 69555 - DNA, 24 bp, Homo sapiens
gcttacgaccccttatttacccca

SEQ ID NO: 69556 - DNA, 18 bp, Homo sapiens
acttgaccgctctgacca

SEQ ID NO: 69557 - DNA, 42 bp, Homo sapiens; identical to SEQ ID NO: 66647

SEQ ID NO: 69558 - DNA, 36 bp, Homo sapiens; identical to SEQ ID NO: 66701

SEQ ID NO: 69559 - DNA, 34 bp, Homo sapiens; identical to SEQ ID NO: 68650

SEQ ID NO: 69560 - DNA, 34 bp, Homo sapiens; identical to SEQ ID NO: 67808

SEQ ID NO: 69561 - DNA, 24 bp, Homo sapiens
caacttaacttgaccgctctgacc

SEQ ID NO: 69562 - DNA, 18 bp, Homo sapiens
gtccctgtccaggcgcca

SEQ ID NO: 69563 - DNA, 32 bp, Homo sapiens
cccggctagctcagtcggtagagcatgagact

SEQ ID NO: 69564 - DNA, 42 bp, Homo sapiens
gcgccgctggtgtagtggtatcatgcaagattcccattcttg

SEQ ID NO: 69565 - DNA, 21 bp, Homo sapiens
tgtcacgcgggagaccggggt

SEQ ID NO: 69566 - DNA, 35 bp, Homo sapiens; identical to SEQ ID NO: 68040

SEQ ID NO: 69567 - DNA, 36 bp, Homo sapiens; identical to SEQ ID NO: 66768

SEQ ID NO: 69568 - DNA, 31 bp, Homo sapiens; identical to SEQ ID NO: 68261

SEQ ID NO: 69569 - DNA, 18 bp, Homo sapiens
tgcccgcattctccacca

SEQ ID NO: 69570 - DNA, 36 bp, Homo sapiens; identical to SEQ ID NO: 66792

SEQ ID NO: 69571 - DNA, 37 bp, Homo sapiens; identical to SEQ ID NO: 66725

SEQ ID NO: 69572 - DNA, 29 bp, Homo sapiens
agcatagctgccttccaagcagttgaccc

SEQ ID NO: 69573 - DNA, 22 bp, Homo sapiens
tcgaatcccagcggggcctcca

SEQ ID NO: 69574 - DNA, 33 bp, Homo sapiens; identical to SEQ ID NO: 67046

SEQ ID NO: 69575 - DNA, 28 bp, Homo sapiens
attggtcgtggttgtagtccgtgcgaga

SEQ ID NO: 69576 - DNA, 40 bp, Homo sapiens; identical to SEQ ID NO: 67780

SEQ ID NO: 69577 - DNA, 25 bp, Homo sapiens
agcttaaacccccttatttctacca

SEQ ID NO: 69578 - DNA, 27 bp, Homo sapiens
gaccaagagccttcaaagccctcagta

SEQ ID NO: 69579 - DNA, 18 bp, Homo sapiens
atcccaccctcgtcgcca

SEQ ID NO: 69580 - DNA, 18 bp, Homo sapiens
ctcccagtggggcctcca

SEQ ID NO: 69581 - DNA, 36 bp, Homo sapiens; identical to SEQ ID NO: 66529

SEQ ID NO: 69582 - DNA, 39 bp, Homo sapiens; identical to SEQ ID NO: 68917

SEQ ID NO: 69583 - DNA, 38 bp, Homo sapiens
gcatgaggtcccgggttcgatccccagcatctccacca

SEQ ID NO: 69584 - DNA, 37 bp, Homo sapiens
gcccggatagctcagtcggtagagcatcagactttta

SEQ ID NO: 69585 - DNA, 43 bp, Homo sapiens; identical to SEQ ID NO: 68517

SEQ ID NO: 69586 - DNA, 34 bp, Homo sapiens; identical to SEQ ID NO: 68929

SEQ ID NO: 69587 - DNA, 32 bp, Homo sapiens; identical to SEQ ID NO: 68011

SEQ ID NO: 69588 - DNA, 28 bp, Homo sapiens
gagaaagctcacaagaactgctaactca

SEQ ID NO: 69589 - DNA, 28 bp, Homo sapiens
gcagagtggggttttgcagtccttacca

SEQ ID NO: 69590 - DNA, 34 bp, Homo sapiens; identical to SEQ ID NO: 67087

SEQ ID NO: 69591 - DNA, 34 bp, Homo sapiens; identical to SEQ ID NO: 66735

SEQ ID NO: 69592 - DNA, 31 bp, Homo sapiens; identical to SEQ ID NO: 66783

SEQ ID NO: 69593 - DNA, 43 bp, Homo sapiens
gagcccggtaatcgcataaaacttaaaactttacagtcagagg

SEQ ID NO: 69594 - DNA, 19 bp, Homo sapiens
acacctctttacagtgacc

SEQ ID NO: 69595 - DNA, 40 bp, Homo sapiens; identical to SEQ ID NO: 66652

SEQ ID NO: 69596 - DNA, 32 bp, Homo sapiens; identical to SEQ ID NO: 67912

SEQ ID NO: 69597 - DNA, 31 bp, Homo sapiens; identical to SEQ ID NO: 67690

SEQ ID NO: 69598 - DNA, 27 bp, Homo sapiens
gagaaagctcacaagaactgctaactc

SEQ ID NO: 69599 - DNA, 41 bp, Homo sapiens; identical to SEQ ID NO: 68920

SEQ ID NO: 69600 - DNA, 35 bp, Homo sapiens; identical to SEQ ID NO: 68597

SEQ ID NO: 69601 - DNA, 40 bp, Homo sapiens; identical to SEQ ID NO: 67802

SEQ ID NO: 69602 - DNA, 39 bp, Homo sapiens; identical to SEQ ID NO: 66742

SEQ ID NO: 69603 - DNA, 42 bp, Homo sapiens; identical to SEQ ID NO: 67031

SEQ ID NO: 69604 - DNA, 25 bp, Homo sapiens
gaggcttacgaccccttatttaccc

SEQ ID NO: 69605 - DNA, 43 bp, Homo sapiens
tgcacgtatgaggccccgggttcaatccccggcatctccacca

SEQ ID NO: 69606 - DNA, 33 bp, Homo sapiens; identical to SEQ ID NO: 67947

SEQ ID NO: 69607 - DNA, 34 bp, Homo sapiens
tccctggtggtctagtggctaggattcggcgctt

SEQ ID NO: 69608 - DNA, 36 bp, Homo sapiens
cccgaaaatgttggttatacccttcccgtactacca

SEQ ID NO: 69609 - DNA, 27 bp, Homo sapiens
ggctagctcagtcggtagagcatggga

SEQ ID NO: 69610 - DNA, 44 bp, Homo sapiens
gcgttggtggtatagtggtgagcatagctgccttccaagcagtt

SEQ ID NO: 69611 - DNA, 43 bp, Homo sapiens
actgaaaatgtttagacgggctcacatcaccccataaacacca

SEQ ID NO: 69612 - DNA, 46 bp, Homo sapiens
gtttttcatatcattggtcgtggttgtagtccgtgcgagaatacca

SEQ ID NO: 69613 - DNA, 28 bp, Homo sapiens
ggctagctcagtcggtagagcatgagac

SEQ ID NO: 69614 - DNA, 27 bp, Homo sapiens
cggctagctcagtcggtagagcatggg

SEQ ID NO: 69615 - DNA, 37 bp, Homo sapiens; identical to SEQ ID NO: 66824

SEQ ID NO: 69616 - DNA, 34 bp, Homo sapiens; identical to SEQ ID NO: 68860

SEQ ID NO: 69617 - DNA, 38 bp, Homo sapiens
tatcattggtcgtggttgtagtccgtgcgagaatacca

SEQ ID NO: 69618 - DNA, 34 bp, Homo sapiens
tcccatatggtctagcggttaggattcctggttt

SEQ ID NO: 69619 - DNA, 30 bp, Homo sapiens; identical to SEQ ID NO: 68746

SEQ ID NO: 69620 - DNA, 35 bp, Homo sapiens; identical to SEQ ID NO: 66814

SEQ ID NO: 69621 - DNA, 35 bp, Homo sapiens; identical to SEQ ID NO: 67952

SEQ ID NO: 69622 - DNA, 37 bp, Homo sapiens
acgcgggagaccggggttcgattccccgacggggagc

SEQ ID NO: 69623 - DNA, 18 bp, Homo sapiens
gtcacgtcggggtcacca

SEQ ID NO: 69624 - DNA, 32 bp, Homo sapiens; identical to SEQ ID NO: 67946

SEQ ID NO: 69625 - DNA, 31 bp, Homo sapiens
cccggctagctcagtcggtagagcatgagac

SEQ ID NO: 69626 - DNA, 18 bp, Homo sapiens
acccttcccgtactacca

SEQ ID NO: 69627 - DNA, 44 bp, Homo sapiens
tcctaagccagggattgtgggttcgagtcccatctggggtgcca

SEQ ID NO: 69628 - DNA, 37 bp, Homo sapiens; identical to SEQ ID NO: 67045

SEQ ID NO: 69629 - DNA, 40 bp, Homo sapiens; identical to SEQ ID NO: 68015

SEQ ID NO: 69630 - DNA, 21 bp, Homo sapiens
gtcgtggttgtagtccgtgcg

SEQ ID NO: 69631 - DNA, 22 bp, Homo sapiens
tcgatccccgtacgggccacca

SEQ ID NO: 69632 - DNA, 19 bp, Homo sapiens
gcccggatagctcagtcgg

SEQ ID NO: 69633 - DNA, 46 bp, Homo sapiens; identical to SEQ ID NO: 68674

SEQ ID NO: 69634 - DNA, 39 bp, Homo sapiens; identical to SEQ ID NO: 67937

SEQ ID NO: 69635 - DNA, 32 bp, Homo sapiens
gacccagtggcctaatggataaggcatcagcc

SEQ ID NO: 69636 - DNA, 39 bp, Homo sapiens; identical to SEQ ID NO: 66654

SEQ ID NO: 69637 - DNA, 19 bp, Homo sapiens
gagcccggtaatcgcataa

SEQ ID NO: 69638 - DNA, 28 bp, Homo sapiens
gtttccgtagtgtagcggttatcacatt

SEQ ID NO: 69639 - DNA, 43 bp, Homo sapiens
tacacgcagaaggtcctgggttcgagccccagtggaaccacca

SEQ ID NO: 69640 - DNA, 45 bp, Homo sapiens
cctgtcacgcgggagaccggggttcaattccccgacggggagcca

SEQ ID NO: 69641 - DNA, 30 bp, Homo sapiens; identical to SEQ ID NO: 67964

SEQ ID NO: 69642 - DNA, 32 bp, Homo sapiens
cccggctagctcagtcggtagagcatgggact

SEQ ID NO: 69643 - DNA, 35 bp, Homo sapiens; identical to SEQ ID NO: 68813

SEQ ID NO: 69644 - DNA, 29 bp, Homo sapiens
gggagaccggggttcgattccccgacggg

SEQ ID NO: 69645 - DNA, 38 bp, Homo sapiens; identical to SEQ ID NO: 66765

SEQ ID NO: 69646 - DNA, 34 bp, Homo sapiens; identical to SEQ ID NO: 68771

SEQ ID NO: 69647 - DNA, 37 bp, Homo sapiens; identical to SEQ ID NO: 66831

SEQ ID NO: 69648 - DNA, 24 bp, Homo sapiens
gcctgtcacgcgggagaccggggt

SEQ ID NO: 69649 - DNA, 31 bp, Homo sapiens
tcctcgttagtatagtggtgagtatccccgc

SEQ ID NO: 69650 - DNA, 19 bp, Homo sapiens
atccccagcacctccacca

SEQ ID NO: 69651 - DNA, 39 bp, Homo sapiens; identical to SEQ ID NO: 68790

SEQ ID NO: 69652 - DNA, 26 bp, Homo sapiens
cattggtcgtggttgtagtccgtgcg

SEQ ID NO: 69653 - DNA, 23 bp, Homo sapiens
gctcacatcaccccataaacacc

SEQ ID NO: 69654 - DNA, 22 bp, Homo sapiens
caacattcaaaaaagagtacca

SEQ ID NO: 69655 - DNA, 32 bp, Homo sapiens
cccggatagctcagtcggtagagcatcagact

SEQ ID NO: 69656 - DNA, 34 bp, Homo sapiens
gcctggatagctcagtcggtagagcatcagactt

SEQ ID NO: 69657 - DNA, 27 bp, Homo sapiens
cagagtggggttttgcagtccttacca

SEQ ID NO: 69658 - DNA, 28 bp, Homo sapiens
ggattcggcgctctcaccgccgcggccc

SEQ ID NO: 69659 - DNA, 22 bp, Homo sapiens
tcaaatccgggtgccccctcca

SEQ ID NO: 69660 - DNA, 44 bp, Homo sapiens
agccttcaaagccctcagtaagttgcaatacttaatttctgcca

SEQ ID NO: 69661 - DNA, 33 bp, Homo sapiens; identical to SEQ ID NO: 68741

SEQ ID NO: 69662 - DNA, 39 bp, Homo sapiens
tgcacgaggtcctgggttcgatccccagtacctccacca

SEQ ID NO: 69663 - DNA, 25 bp, Homo sapiens
cggtaatcgcataaaacttaaaact

SEQ ID NO: 69664 - DNA, 35 bp, Homo sapiens; identical to SEQ ID NO: 68532

SEQ ID NO: 69665 - DNA, 17 bp, Homo sapiens
tccggctcggaggacca

SEQ ID NO: 69666 - DNA, 45 bp, Homo sapiens; identical to SEQ ID NO: 68799

SEQ ID NO: 69667 - DNA, 44 bp, Homo sapiens
tccctggtggtctagtggttaggattcggcgctctcaccgccgc

SEQ ID NO: 69668 - DNA, 16 bp, Homo sapiens
ccccttatttacccca

SEQ ID NO: 69669 - DNA, 30 bp, Homo sapiens
ccctggtggtctagtggttaggattcggcg

SEQ ID NO: 69670 - DNA, 43 bp, Homo sapiens
tgccacgcgggaggcccgggttcgattcccggcccatgcacca

SEQ ID NO: 69671 - DNA, 32 bp, Homo sapiens; identical to SEQ ID NO: 67924

SEQ ID NO: 69672 - DNA, 33 bp, Homo sapiens; identical to SEQ ID NO: 68728

SEQ ID NO: 69673 - DNA, 36 bp, Homo sapiens
tccctggtggtctagtggctaggattcggcgctttc

SEQ ID NO: 69674 - DNA, 23 bp, Homo sapiens
gtcgtggttgtagtccgtgcgag

SEQ ID NO: 69675 - DNA, 38 bp, Homo sapiens
ccgccgcggcccgggttcgattcccggtcagggaacca

SEQ ID NO: 69676 - DNA, 17 bp, Homo sapiens
acgcgggagaccggggt

SEQ ID NO: 69677 - DNA, 27 bp, Homo sapiens
gagaccggggttcgattccccgacggg

SEQ ID NO: 69678 - DNA, 43 bp, Homo sapiens; identical to SEQ ID NO: 68374

SEQ ID NO: 69679 - DNA, 34 bp, Homo sapiens; identical to SEQ ID NO: 68833

SEQ ID NO: 69680 - DNA, 33 bp, Homo sapiens; identical to SEQ ID NO: 68583

SEQ ID NO: 69681 - DNA, 34 bp, Homo sapiens; identical to SEQ ID NO: 67909

SEQ ID NO: 69682 - DNA, 34 bp, Homo sapiens; identical to SEQ ID NO: 68779

SEQ ID NO: 69683 - DNA, 31 bp, Homo sapiens; identical to SEQ ID NO: 68836

SEQ ID NO: 69684 - DNA, 40 bp, Homo sapiens; identical to SEQ ID NO: 68857

SEQ ID NO: 69685 - DNA, 45 bp, Homo sapiens
gagccttcaaagccctcagtaagttgcaatacttaatttctgcca

SEQ ID NO: 69686 - DNA, 24 bp, Homo sapiens
tctaacaacatggctttctcacca

SEQ ID NO: 69687 - DNA, 16 bp, Homo sapiens
cctgccgactacgcca

SEQ ID NO: 69688 - DNA, 40 bp, Homo sapiens
ggcccataccccgaaaatgttggttatacccttcccgtac

SEQ ID NO: 69689 - DNA, 34 bp, Homo sapiens
agcccggtaatcgcataaaacttaaaactttaca

SEQ ID NO: 69690 - DNA, 45 bp, Homo sapiens
gtttttcatatcattggtcgtggttgtagtccgtgcgagaatacc

SEQ ID NO: 69691 - DNA, 26 bp, Homo sapiens
gcccggatagctcagtcggtagagca

SEQ ID NO: 69692 - DNA, 33 bp, Homo sapiens; identical to SEQ ID NO: 68044

SEQ ID NO: 69693 - DNA, 21 bp, Homo sapiens
caactccaaataaaagtacca

SEQ ID NO: 69694 - DNA, 40 bp, Homo sapiens; identical to SEQ ID NO: 68955

SEQ ID NO: 69695 - DNA, 45 bp, Homo sapiens
caaagcaatacactgaaaatgtttagacgggctcacatcacccca

SEQ ID NO: 69696 - DNA, 45 bp, Homo sapiens; identical to SEQ ID NO: 68885

SEQ ID NO: 69697 - DNA, 30 bp, Homo sapiens; identical to SEQ ID NO: 66723

SEQ ID NO: 69698 - DNA, 34 bp, Homo sapiens; identical to SEQ ID NO: 68688

SEQ ID NO: 69699 - DNA, 32 bp, Homo sapiens
gcttctgtagtgtagtggttatcacgttcgcc

SEQ ID NO: 69700 - DNA, 45 bp, Homo sapiens; identical to SEQ ID NO: 68587

SEQ ID NO: 69701 - DNA, 33 bp, Homo sapiens
tcccatatggtctagcggttaggattcctggtt

SEQ ID NO: 69702 - DNA, 17 bp, Homo sapiens
tcccggccaacgcacca

SEQ ID NO: 69703 - DNA, 33 bp, Homo sapiens; identical to SEQ ID NO: 67849

SEQ ID NO: 69704 - DNA, 29 bp, Homo sapiens
aggattcggcgctctcaccgccgcggccc

SEQ ID NO: 69705 - DNA, 38 bp, Homo sapiens
ctttacagtcagaggttcaattcctcttcttaacacca

SEQ ID NO: 69706 - DNA, 42 bp, Homo sapiens
acacgcgaaaggtccccggttcgatcccgggcggaaacacca

SEQ ID NO: 69707 - DNA, 28 bp, Homo sapiens
ggctagctcagtcggtagagcatgggac

SEQ ID NO: 69708 - DNA, 33 bp, Homo sapiens; identical to SEQ ID NO: 66804

SEQ ID NO: 69709 - DNA, 42 bp, Homo sapiens; identical to SEQ ID NO: 68848

SEQ ID NO: 69710 - DNA, 32 bp, Homo sapiens; identical to SEQ ID NO: 68585

SEQ ID NO: 69711 - DNA, 18 bp, Homo sapiens
ctcccggtatgggaacca

SEQ ID NO: 69712 - DNA, 38 bp, Homo sapiens
gcagaaggtcctgggttcaagccccagtggaaccacca

SEQ ID NO: 69713 - DNA, 19 bp, Homo sapiens
caatacttaatttctgcca

SEQ ID NO: 69714 - DNA, 44 bp, Homo sapiens; identical to SEQ ID NO: 66820

SEQ ID NO: 69715 - DNA, 38 bp, Homo sapiens
cttagcattaaccttttaagttaaagattaagagaacc

SEQ ID NO: 69716 - DNA, 35 bp, Homo sapiens; identical to SEQ ID NO: 67186

SEQ ID NO: 69717 - DNA, 34 bp, Homo sapiens; identical to SEQ ID NO: 67922

SEQ ID NO: 69718 - DNA, 31 bp, Homo sapiens; identical to SEQ ID NO: 66568

SEQ ID NO: 69719 - DNA, 44 bp, Homo sapiens; identical to SEQ ID NO: 69007

SEQ ID NO: 69720 - DNA, 29 bp, Homo sapiens
agagaaccaacacctctttacagtgacca

SEQ ID NO: 69721 - DNA, 18 bp, Homo sapiens
atcccagcgaggcctcca

SEQ ID NO: 69722 - DNA, 37 bp, Homo sapiens
gcccggtaatcgcataaaacttaaaactttacagtca

SEQ ID NO: 69723 - DNA, 33 bp, Homo sapiens; identical to SEQ ID NO: 68745

SEQ ID NO: 69724 - DNA, 30 bp, Homo sapiens; identical to SEQ ID NO: 68895

SEQ ID NO: 69725 - DNA, 33 bp, Homo sapiens; identical to SEQ ID NO: 68727

SEQ ID NO: 69726 - DNA, 31 bp, Homo sapiens; identical to SEQ ID NO: 68043

SEQ ID NO: 69727 - DNA, 18 bp, Homo sapiens
acccccttatttctacca

SEQ ID NO: 69728 - DNA, 38 bp, Homo sapiens; identical to SEQ ID NO: 68759

SEQ ID NO: 69729 - DNA, 29 bp, Homo sapiens
gcgggagaccggggttcgattccccgacg

SEQ ID NO: 69730 - DNA, 28 bp, Homo sapiens
gcttctgtagtgtagtggttatcacgtt

SEQ ID NO: 69731 - DNA, 28 bp, Homo sapiens
gcgccgctggtgtagtggtatcatgcaa

SEQ ID NO: 69732 - DNA, 34 bp, Homo sapiens; identical to SEQ ID NO: 66170

SEQ ID NO: 69733 - DNA, 26 bp, Homo sapiens
atgaaaacctttttccaaggacacca

SEQ ID NO: 69734 - DNA, 40 bp, Homo sapiens; identical to SEQ ID NO: 67086

SEQ ID NO: 69735 - DNA, 23 bp, Homo sapiens
ctaacaacatggctttctcacca

SEQ ID NO: 69736 - DNA, 24 bp, Homo sapiens
ggctaaatcctatatatcttacca

SEQ ID NO: 69737 - DNA, 45 bp, Homo sapiens
acactgaaaatgtttagacgggctcacatcaccccataaacacca

SEQ ID NO: 69738 - DNA, 31 bp, Homo sapiens
ctcaaagcaatacactgaaaatgtttagacg

SEQ ID NO: 69739 - DNA, 18 bp, Homo sapiens
accccgtacgggccacca

SEQ ID NO: 69740 - DNA, 39 bp, Homo sapiens; identical to SEQ ID NO: 67238

SEQ ID NO: 69741 - DNA, 36 bp, Homo sapiens
agaaggtcctgggttcgagccccagtggaaccacca

SEQ ID NO: 69742 - DNA, 32 bp, Homo sapiens
gtttccgtagtgtagcggttatcacattcgcc

SEQ ID NO: 69743 - DNA, 33 bp, Homo sapiens; identical to SEQ ID NO: 68894

SEQ ID NO: 69744 - DNA, 20 bp, Homo sapiens
atacccttcccgtactacca

SEQ ID NO: 69745 - DNA, 39 bp, Homo sapiens
cttagcattaaccttttaagttaaagattaagagaacca

SEQ ID NO: 69746 - DNA, 30 bp, Homo sapiens; identical to SEQ ID NO: 66733

SEQ ID NO: 69747 - DNA, 17 bp, Homo sapiens
tcccggcggagtcgcca

SEQ ID NO: 69748 - DNA, 38 bp, Homo sapiens
gcattggtggttcagtggtagaattctcgcctgccacg

SEQ ID NO: 69749 - DNA, 34 bp, Homo sapiens; identical to SEQ ID NO: 68047

SEQ ID NO: 69750 - DNA, 40 bp, Homo sapiens
caaagcacccaacttacacttaggagatttcaacttaact

SEQ ID NO: 69751 - DNA, 46 bp, Homo sapiens; identical to SEQ ID NO: 68412

SEQ ID NO: 69752 - DNA, 39 bp, Homo sapiens; identical to SEQ ID NO: 69008

SEQ ID NO: 69753 - DNA, 37 bp, Homo sapiens; identical to SEQ ID NO: 68614

SEQ ID NO: 69754 - DNA, 22 bp, Homo sapiens
tcaagtccctgttcgggcgcca

SEQ ID NO: 69755 - DNA, 26 bp, Homo sapiens
agcaatacactgaaaatgtttagacg

SEQ ID NO: 69756 - DNA, 28 bp, Homo sapiens
gtggagttaaagactttttctctgacca

SEQ ID NO: 69757 - DNA, 19 bp, Homo sapiens
caacatggctttctcacca

SEQ ID NO: 69758 - DNA, 27 bp, Homo sapiens
gttggttatacccttcccgtactacca

SEQ ID NO: 69759 - DNA, 33 bp, Homo sapiens
ccctggtggtctagtggttaggattcggcgctc

SEQ ID NO: 69760 - DNA, 19 bp, Homo sapiens
ccttccaagcagttgaccc

SEQ ID NO: 69761 - DNA, 43 bp, Homo sapiens; identical to SEQ ID NO: 68904

SEQ ID NO: 69762 - DNA, 16 bp, Homo sapiens
atccgggtgccccctc

SEQ ID NO: 69763 - DNA, 22 bp, Homo sapiens
tcgattccccgacggggagcca

SEQ ID NO: 69764 - DNA, 31 bp, Homo sapiens
gcgggagaccggggttcaattccccgacggg

SEQ ID NO: 69765 - DNA, 30 bp, Homo sapiens; identical to SEQ ID NO: 66169

SEQ ID NO: 69766 - DNA, 28 bp, Homo sapiens
cagggatgggttcgattctcatagtcct

SEQ ID NO: 69767 - DNA, 36 bp, Homo sapiens; identical to SEQ ID NO: 66813

SEQ ID NO: 69768 - DNA, 20 bp, Homo sapiens
taacttgaccgctctgacca

SEQ ID NO: 69769 - DNA, 25 bp, Homo sapiens
aggcttacgaccccttatttacccc

SEQ ID NO: 69770 - DNA, 46 bp, Homo sapiens
caaagcacccaacttacacttaggagatttcaacttaacttgaccg

SEQ ID NO: 69771 - DNA, 16 bp, Homo sapiens
gggtatgattctcggt

SEQ ID NO: 69772 - DNA, 42 bp, Homo sapiens; identical to SEQ ID NO: 68668

SEQ ID NO: 69773 - DNA, 39 bp, Homo sapiens
gtccttgtagtataaactaatacaccagtcttgtaaacc

SEQ ID NO: 69774 - DNA, 30 bp, Homo sapiens
tcaaagcaatacactgaaaatgtttagacg

SEQ ID NO: 69775 - DNA, 30 bp, Homo sapiens; identical to SEQ ID NO: 66785

SEQ ID NO: 69776 - DNA, 32 bp, Homo sapiens; identical to SEQ ID NO: 68716

SEQ ID NO: 69777 - DNA, 25 bp, Homo sapiens
gtcgtggttgtagtccgtgcgagaa

SEQ ID NO: 69778 - DNA, 18 bp, Homo sapiens
gtggttgtagtccgtgcg

SEQ ID NO: 69779 - DNA, 35 bp, Homo sapiens
gagaaagctcacaagaactgctaactcatgccccc

SEQ ID NO: 69780 - DNA, 29 bp, Homo sapiens
atcgcataaaacttaaaactttacagtca

SEQ ID NO: 69781 - DNA, 17 bp, Homo sapiens
cccccttatttctacca

SEQ ID NO: 69782 - DNA, 29 bp, Homo sapiens
gcccggatagctcagtcggtagagcatca

SEQ ID NO: 69783 - DNA, 42 bp, Homo sapiens
gcccggctagctcagtcggtagagcatgggactcttaatccc

SEQ ID NO: 69784 - DNA, 36 bp, Homo sapiens
gcgttggtggtatagtggtaagcatagctgccttcc

SEQ ID NO: 69785 - DNA, 22 bp, Homo sapiens
tcacacgcgaaaggtccccggt

SEQ ID NO: 69786 - DNA, 29 bp, Homo sapiens
ccggggttcgattccccgacggggagcca

SEQ ID NO: 69787 - DNA, 29 bp, Homo sapiens
ggctagctcagtcggtagagcatgggact

SEQ ID NO: 69788 - DNA, 37 bp, Homo sapiens
tcccacatggtctagcggttaggattcctggttttca

SEQ ID NO: 69789 - DNA, 35 bp, Homo sapiens
tcacgcgggagaccggggttcgattccccgacggg

SEQ ID NO: 69790 - DNA, 38 bp, Homo sapiens
gcacgaggtcctgggttcgatccccagtacctccacca

SEQ ID NO: 69791 - DNA, 21 bp, Homo sapiens
cgattccccgacggggagcca

SEQ ID NO: 69792 - DNA, 16 bp, Homo sapiens
gaggcttacgacccct

SEQ ID NO: 69793 - DNA, 36 bp, Homo sapiens
cagattgtgaatctgacaacagaggcttacgacccc

SEQ ID NO: 69794 - DNA, 29 bp, Homo sapiens
cattggtcgtggttgtagtccgtgcgaga

SEQ ID NO: 69795 - DNA, 36 bp, Homo sapiens; identical to SEQ ID NO: 68939

SEQ ID NO: 69796 - DNA, 36 bp, Homo sapiens
cgcgggagaccggggttcgattccccgacggggagc

SEQ ID NO: 69797 - DNA, 44 bp, Homo sapiens
aaagcaatacactgaaaatgtttagacgggctcacatcacccca

SEQ ID NO: 69798 - DNA, 20 bp, Homo sapiens
ctaagccagggattgtgggt

SEQ ID NO: 69799 - DNA, 36 bp, Homo sapiens; identical to SEQ ID NO: 68467

SEQ ID NO: 69800 - DNA, 29 bp, Homo sapiens
cgggagaccggggttcgattccccgacgg

SEQ ID NO: 69801 - DNA, 31 bp, Homo sapiens
gtccttgtagtataaactaatacaccagtct

SEQ ID NO: 69802 - DNA, 22 bp, Homo sapiens
ggtcgtggttgtagtccgtgcg

SEQ ID NO: 69803 - DNA, 28 bp, Homo sapiens
gaatcttagctttgggtgctaatggtgg

SEQ ID NO: 69804 - DNA, 40 bp, Homo sapiens
gcccggatagctcagtcggtagagcatcagacttttaatc

SEQ ID NO: 69805 - DNA, 18 bp, Homo sapiens
atcccaccttcgtcgcca

SEQ ID NO: 69806 - DNA, 19 bp, Homo sapiens
cacctctttacagtgacca

SEQ ID NO: 69807 - DNA, 42 bp, Homo sapiens
gcagagcccggtaatcgcataaaacttaaaactttacagtca

SEQ ID NO: 69808 - DNA, 35 bp, Homo sapiens; identical to SEQ ID NO: 68971

SEQ ID NO: 69809 - DNA, 29 bp, Homo sapiens
ggagaccggggttcgattccccgacgggg

SEQ ID NO: 69810 - DNA, 36 bp, Homo sapiens
ttacagtcagaggttcaattcctcttcttaacacca

SEQ ID NO: 69811 - DNA, 34 bp, Homo sapiens
cgaaaatgttggttatacccttcccgtactacca

SEQ ID NO: 69812 - DNA, 23 bp, Homo sapiens
gaaaatgtttagacgggctcaca

SEQ ID NO: 69813 - DNA, 30 bp, Homo sapiens; identical to SEQ ID NO: 68899

SEQ ID NO: 69814 - DNA, 39 bp, Homo sapiens; identical to SEQ ID NO: 66734

SEQ ID NO: 69815 - DNA, 26 bp, Homo sapiens
ggagcttaaacccccttatttctacc

SEQ ID NO: 69816 - DNA, 18 bp, Homo sapiens
gtcccggcggagtcgcca

SEQ ID NO: 69817 - DNA, 34 bp, Homo sapiens
tcagggatgggttcgattctcatagtcctagcca

SEQ ID NO: 69818 - DNA, 17 bp, Homo sapiens
tctcggtggaacctcca

SEQ ID NO: 69819 - DNA, 40 bp, Homo sapiens; identical to SEQ ID NO: 68925

SEQ ID NO: 69820 - DNA, 29 bp, Homo sapiens
agaatcttagctttgggtgctaatggtgg

SEQ ID NO: 69821 - DNA, 22 bp, Homo sapiens
ctgccacgcgggaggcccgggt

SEQ ID NO: 69822 - DNA, 43 bp, Homo sapiens; identical to SEQ ID NO: 68873

SEQ ID NO: 69823 - DNA, 39 bp, Homo sapiens
gcccggtaatcgcataaaacttaaaactttacagtcaga

SEQ ID NO: 69824 - DNA, 40 bp, Homo sapiens
acgcgaaaggtccccggttcgatcccgggcggaaacacca

SEQ ID NO: 69825 - DNA, 28 bp, Homo sapiens
cattggtcgtggttgtagtccgtgcgag

SEQ ID NO: 69826 - DNA, 23 bp, Homo sapiens
cttaaacccccttatttctacca

SEQ ID NO: 69827 - DNA, 39 bp, Homo sapiens
gggtgctaatggtggagttaaagactttttctctgacca

SEQ ID NO: 69828 - DNA, 40 bp, Homo sapiens
tccctggtggtctagtggttaggattcggcgctctcaccg

SEQ ID NO: 69829 - DNA, 41 bp, Homo sapiens
tcctcgttagtatagtggtgagtatccccgcctgtcacgcg

SEQ ID NO: 69830 - DNA, 18 bp, Homo sapiens
acgcgaaaggtccccggt

SEQ ID NO: 69831 - DNA, 37 bp, Homo sapiens; identical to SEQ ID NO: 68863

SEQ ID NO: 69832 - DNA, 31 bp, Homo sapiens; identical to SEQ ID NO: 68770

SEQ ID NO: 69833 - DNA, 33 bp, Homo sapiens
cgggagaccggggttcgattccccgacggggag

SEQ ID NO: 69834 - DNA, 31 bp, Homo sapiens; identical to SEQ ID NO: 66755

SEQ ID NO: 69835 - DNA, 33 bp, Homo sapiens; identical to SEQ ID NO: 66162

SEQ ID NO: 69836 - DNA, 33 bp, Homo sapiens; identical to SEQ ID NO: 66152

SEQ ID NO: 69837 - DNA, 33 bp, Homo sapiens; identical to SEQ ID NO: 66159

SEQ ID NO: 69838 - DNA, 32 bp, Homo sapiens; identical to SEQ ID NO: 66157

SEQ ID NO: 69839 - DNA, 18 bp, Homo sapiens
tccccggcacctccacca

SEQ ID NO: 69840 - DNA, 18 bp, Homo sapiens
tccccggcatctccacca

SEQ ID NO: 69841 - DNA, 18 bp, Homo sapiens
tccccagtacctccacca

SEQ ID NO: 69842 - DNA, 33 bp, Homo sapiens; identical to SEQ ID NO: 66164

SEQ ID NO: 69843 - DNA, 18 bp, Homo sapiens
atcccaccgctgccacca

SEQ ID NO: 69844 - DNA, 31 bp, Homo sapiens; identical to SEQ ID NO: 66166

SEQ ID NO: 69845 - DNA, 17 bp, Homo sapiens
ccccggcatctccacca

SEQ ID NO: 69846 - DNA, 31 bp, Homo sapiens; identical to SEQ ID NO: 66161

SEQ ID NO: 69847 - DNA, 17 bp, Homo sapiens
accgggcggaaacacca

SEQ ID NO: 69848 - DNA, 32 bp, Homo sapiens; identical to SEQ ID NO: 66175

SEQ ID NO: 69849 - DNA, 32 bp, Homo sapiens; identical to SEQ ID NO: 66174

SEQ ID NO: 69850 - DNA, 31 bp, Homo sapiens; identical to SEQ ID NO: 66165

SEQ ID NO: 69851 - DNA, 33 bp, Homo sapiens; identical to SEQ ID NO: 66158

SEQ ID NO: 69852 - DNA, 34 bp, Homo sapiens; identical to SEQ ID NO: 66191

SEQ ID NO: 69853 - DNA, 17 bp, Homo sapiens
tccgggtgccccctcca

SEQ ID NO: 69854 - DNA, 34 bp, Homo sapiens; identical to SEQ ID NO: 66183

SEQ ID NO: 69855 - DNA, 33 bp, Homo sapiens; identical to SEQ ID NO: 66179

SEQ ID NO: 69856 - DNA, 17 bp, Homo sapiens
ccccggcacctccacca

SEQ ID NO: 69857 - DNA, 34 bp, Homo sapiens; identical to SEQ ID NO: 66188

SEQ ID NO: 69858 - DNA, 18 bp, Homo sapiens
atccgggtgccccctcca

SEQ ID NO: 69859 - DNA, 30 bp, Homo sapiens; identical to SEQ ID NO: 66169

SEQ ID NO: 69860 - DNA, 39 bp, Homo sapiens; identical to SEQ ID NO: 66190

SEQ ID NO: 69861 - DNA, 43 bp, Homo sapiens; identical to SEQ ID NO: 66219

SEQ ID NO: 69862 - DNA, 31 bp, Homo sapiens; identical to SEQ ID NO: 66172

SEQ ID NO: 69863 - DNA, 22 bp, Homo sapiens
tcaatccccggcacctccacca

SEQ ID NO: 69864 - DNA, 34 bp, Homo sapiens; identical to SEQ ID NO: 66187

SEQ ID NO: 69865 - DNA, 34 bp, Homo sapiens; identical to SEQ ID NO: 66170

SEQ ID NO: 69866 - DNA, 36 bp, Homo sapiens; identical to SEQ ID NO: 66178

SEQ ID NO: 69867 - DNA, 32 bp, Homo sapiens; identical to SEQ ID NO: 66222

SEQ ID NO: 69868 - DNA, 41 bp, Homo sapiens; identical to SEQ ID NO: 66209

SEQ ID NO: 69869 - DNA, 35 bp, Homo sapiens; identical to SEQ ID NO: 66180

SEQ ID NO: 69870 - DNA, 33 bp, Homo sapiens; identical to SEQ ID NO: 66212

SEQ ID NO: 69871 - DNA, 18 bp, Homo sapiens
aaccgggcggaaacacca

SEQ ID NO: 69872 - DNA, 35 bp, Homo sapiens; identical to SEQ ID NO: 66274

SEQ ID NO: 69873 - DNA, 19 bp, Homo sapiens
catcaccccataaacacca

SEQ ID NO: 69874 - DNA, 17 bp, Homo sapiens
tccggctcgaaggacca

SEQ ID NO: 69875 - DNA, 33 bp, Homo sapiens; identical to SEQ ID NO: 66205

SEQ ID NO: 69876 - DNA, 32 bp, Homo sapiens; identical to SEQ ID NO: 66263

SEQ ID NO: 69877 - DNA, 18 bp, Homo sapiens
atcctgccgactacgcca

SEQ ID NO: 69878 - DNA, 32 bp, Homo sapiens; identical to SEQ ID NO: 66184

SEQ ID NO: 69879 - DNA, 42 bp, Homo sapiens; identical to SEQ ID NO: 66182

SEQ ID NO: 69880 - DNA, 18 bp, Homo sapiens
atcccagcggggcctcca

SEQ ID NO: 69881 - DNA, 39 bp, Homo sapiens; identical to SEQ ID NO: 66256

SEQ ID NO: 69882 - DNA, 22 bp, Homo sapiens
tcgattcccggcccatgcacca

SEQ ID NO: 69883 - DNA, 22 bp, Homo sapiens
tcgatccccggcatctccacca

SEQ ID NO: 69884 - DNA, 38 bp, Homo sapiens; identical to SEQ ID NO: 66208

SEQ ID NO: 69885 - DNA, 32 bp, Homo sapiens; identical to SEQ ID NO: 66246

SEQ ID NO: 69886 - DNA, 36 bp, Homo sapiens; identical to SEQ ID NO: 66312

SEQ ID NO: 69887 - DNA, 21 bp, Homo sapiens
aacacctctttacagtgacca

SEQ ID NO: 69888 - DNA, 34 bp, Homo sapiens; identical to SEQ ID NO: 66244

SEQ ID NO: 69889 - DNA, 36 bp, Homo sapiens; identical to SEQ ID NO: 66304

SEQ ID NO: 69890 - DNA, 16 bp, Homo sapiens
ccgggcggaaacacca

SEQ ID NO: 69891 - DNA, 34 bp, Homo sapiens; identical to SEQ ID NO: 66267

SEQ ID NO: 69892 - DNA, 25 bp, Homo sapiens
ggctcacatcaccccataaacacca

SEQ ID NO: 69893 - DNA, 30 bp, Homo sapiens; identical to SEQ ID NO: 66260

SEQ ID NO: 69894 - DNA, 18 bp, Homo sapiens
gtcccacccggggtacca

SEQ ID NO: 69895 - DNA, 22 bp, Homo sapiens
tcgactcccggtatgggaacca

SEQ ID NO: 69896 - DNA, 33 bp, Homo sapiens; identical to SEQ ID NO: 66225

SEQ ID NO: 69897 - DNA, 22 bp, Homo sapiens
tcgattcccggccaatgcacca

SEQ ID NO: 69898 - DNA, 18 bp, Homo sapiens
tccccgacacctccacca

SEQ ID NO: 69899 - DNA, 18 bp, Homo sapiens
atcccagcggtgcctcca

SEQ ID NO: 69900 - DNA, 31 bp, Homo sapiens; identical to SEQ ID NO: 66240

SEQ ID NO: 69901 - DNA, 22 bp, Homo sapiens
tcgattcccggccaacgcacca

SEQ ID NO: 69902 - DNA, 22 bp, Homo sapiens
tcgatccccagtacctccacca

SEQ ID NO: 69903 - DNA, 40 bp, Homo sapiens; identical to SEQ ID NO: 66203

SEQ ID NO: 69904 - DNA, 17 bp, Homo sapiens
tcccaccgctgccacca

SEQ ID NO: 69905 - DNA, 22 bp, Homo sapiens
tcgactcccggtgtgggaacca

SEQ ID NO: 69906 - DNA, 34 bp, Homo sapiens; identical to SEQ ID NO: 66215

SEQ ID NO: 69907 - DNA, 36 bp, Homo sapiens; identical to SEQ ID NO: 66327

SEQ ID NO: 69908 - DNA, 40 bp, Homo sapiens; identical to SEQ ID NO: 66361

SEQ ID NO: 69909 - DNA, 37 bp, Homo sapiens; identical to SEQ ID NO: 66313

SEQ ID NO: 69910 - DNA, 20 bp, Homo sapiens
acacctctttacagtgacca

SEQ ID NO: 69911 - DNA, 17 bp, Homo sapiens
accgggcagaagcacca

SEQ ID NO: 69912 - DNA, 35 bp, Homo sapiens; identical to SEQ ID NO: 66270

SEQ ID NO: 69913 - DNA, 35 bp, Homo sapiens; identical to SEQ ID NO: 66210

SEQ ID NO: 69914 - DNA, 22 bp, Homo sapiens
tcgattcccgggcggcgcacca

SEQ ID NO: 69915 - DNA, 41 bp, Homo sapiens; identical to SEQ ID NO: 66294

SEQ ID NO: 69916 - DNA, 18 bp, Homo sapiens
accccgtccgtgcctcca

SEQ ID NO: 69917 - DNA, 32 bp, Homo sapiens; identical to SEQ ID NO: 66259

SEQ ID NO: 69918 - DNA, 38 bp, Homo sapiens; identical to SEQ ID NO: 66511

SEQ ID NO: 69919 - DNA, 32 bp, Homo sapiens; identical to SEQ ID NO: 66196

SEQ ID NO: 69920 - DNA, 34 bp, Homo sapiens; identical to SEQ ID NO: 66314

SEQ ID NO: 69921 - DNA, 42 bp, Homo sapiens; identical to SEQ ID NO: 66306

SEQ ID NO: 69922 - DNA, 33 bp, Homo sapiens; identical to SEQ ID NO: 66468

SEQ ID NO: 69923 - DNA, 43 bp, Homo sapiens; identical to SEQ ID NO: 66609

SEQ ID NO: 69924 - DNA, 18 bp, Homo sapiens
tgcccgcatcctccacca

SEQ ID NO: 69925 - DNA, 17 bp, Homo sapiens
cctctttacagtgacca

SEQ ID NO: 69926 - DNA, 38 bp, Homo sapiens; identical to SEQ ID NO: 66293

SEQ ID NO: 69927 - DNA, 22 bp, Homo sapiens
tcgattccccgacggggagcca

SEQ ID NO: 69928 - DNA, 40 bp, Homo sapiens; identical to SEQ ID NO: 66515

SEQ ID NO: 69929 - DNA, 31 bp, Homo sapiens; identical to SEQ ID NO: 66456

SEQ ID NO: 69930 - DNA, 28 bp, Homo sapiens
cggctagctcagtcggtagagcatggga

SEQ ID NO: 69931 - DNA, 33 bp, Homo sapiens; identical to SEQ ID NO: 66200

SEQ ID NO: 69932 - DNA, 33 bp, Homo sapiens; identical to SEQ ID NO: 66301

SEQ ID NO: 69933 - DNA, 36 bp, Homo sapiens; identical to SEQ ID NO: 66329

SEQ ID NO: 69934 - DNA, 44 bp, Homo sapiens; identical to SEQ ID NO: 66233

SEQ ID NO: 69935 - DNA, 18 bp, Homo sapiens
atccggctcgaaggacca

SEQ ID NO: 69936 - DNA, 18 bp, Homo sapiens
acctctttacagtgacca

SEQ ID NO: 69937 - DNA, 19 bp, Homo sapiens
atccccagtacctccacca

SEQ ID NO: 69938 - DNA, 18 bp, Homo sapiens
ctcccggtgtgggaacca

SEQ ID NO: 69939 - DNA, 32 bp, Homo sapiens; identical to SEQ ID NO: 66284

SEQ ID NO: 69940 - DNA, 18 bp, Homo sapiens
cccccggctcctccacca

SEQ ID NO: 69941 - DNA, 43 bp, Homo sapiens; identical to SEQ ID NO: 66261

SEQ ID NO: 69942 - DNA, 31 bp, Homo sapiens; identical to SEQ ID NO: 66315

SEQ ID NO: 69943 - DNA, 19 bp, Homo sapiens
atccccggcacctccacca

SEQ ID NO: 69944 - DNA, 17 bp, Homo sapiens
cccgggcggaaacacca

SEQ ID NO: 69945 - DNA, 34 bp, Homo sapiens; identical to SEQ ID NO: 66217

SEQ ID NO: 69946 - DNA, 25 bp, Homo sapiens
ggttcgattccccgacggggagcca

SEQ ID NO: 69947 - DNA, 40 bp, Homo sapiens; identical to SEQ ID NO: 66264

SEQ ID NO: 69948 - DNA, 18 bp, Homo sapiens
tcccgggcggaaacacca

SEQ ID NO: 69949 - DNA, 32 bp, Homo sapiens; identical to SEQ ID NO: 66292

SEQ ID NO: 69950 - DNA, 22 bp, Homo sapiens
ctgtcacgcgggagaccggggt

SEQ ID NO: 69951 - DNA, 46 bp, Homo sapiens; identical to SEQ ID NO: 66248

SEQ ID NO: 69952 - DNA, 39 bp, Homo sapiens; identical to SEQ ID NO: 66339

SEQ ID NO: 69953 - DNA, 37 bp, Homo sapiens; identical to SEQ ID NO: 66268

SEQ ID NO: 69954 - DNA, 28 bp, Homo sapiens
cggctagctcagtcggtagagcatgaga

SEQ ID NO: 69955 - DNA, 17 bp, Homo sapiens
atcccaccgctgccacc

SEQ ID NO: 69956 - DNA, 23 bp, Homo sapiens
agaccggggttcgattccccgac

SEQ ID NO: 69957 - DNA, 22 bp, Homo sapiens
tcgatccccggcacctccacca

SEQ ID NO: 69958 - DNA, 31 bp, Homo sapiens; identical to SEQ ID NO: 66276

SEQ ID NO: 69959 - DNA, 45 bp, Homo sapiens; identical to SEQ ID NO: 66386

SEQ ID NO: 69960 - DNA, 33 bp, Homo sapiens
gtcacgcgggagaccggggttcgattccccgac

SEQ ID NO: 69961 - DNA, 18 bp, Homo sapiens
atcccaccagagtcgcca

SEQ ID NO: 69962 - DNA, 41 bp, Homo sapiens; identical to SEQ ID NO: 66302

SEQ ID NO: 69963 - DNA, 18 bp, Homo sapiens
acctcagagggggcacca

SEQ ID NO: 69964 - DNA, 29 bp, Homo sapiens
gagatgaaaacctttttccaaggacacca

SEQ ID NO: 69965 - DNA, 34 bp, Homo sapiens; identical to SEQ ID NO: 66236

SEQ ID NO: 69966 - DNA, 17 bp, Homo sapiens
ccccagtacctccacca

SEQ ID NO: 69967 - DNA, 28 bp, Homo sapiens
cggatagctcagtcggtagagcatcaga

SEQ ID NO: 69968 - DNA, 18 bp, Homo sapiens
ttcccgggcggcgcacca

SEQ ID NO: 69969 - DNA, 33 bp, Homo sapiens; identical to SEQ ID NO: 66285

SEQ ID NO: 69970 - DNA, 29 bp, Homo sapiens
cggctagctcagtcggtagagcatgagac

SEQ ID NO: 69971 - DNA, 46 bp, Homo sapiens; identical to SEQ ID NO: 66242

SEQ ID NO: 69972 - DNA, 39 bp, Homo sapiens; identical to SEQ ID NO: 66296

SEQ ID NO: 69973 - DNA, 39 bp, Homo sapiens; identical to SEQ ID NO: 66273

SEQ ID NO: 69974 - DNA, 41 bp, Homo sapiens; identical to SEQ ID NO: 66455

SEQ ID NO: 69975 - DNA, 18 bp, Homo sapiens
atcaccccataaacacca

SEQ ID NO: 69976 - DNA, 17 bp, Homo sapiens
tcccgggcggcgcacca

SEQ ID NO: 69977 - DNA, 31 bp, Homo sapiens; identical to SEQ ID NO: 66262

SEQ ID NO: 69978 - DNA, 45 bp, Homo sapiens; identical to SEQ ID NO: 66324

SEQ ID NO: 69979 - DNA, 19 bp, Homo sapiens
atccccggcatctccacca

SEQ ID NO: 69980 - DNA, 23 bp, Homo sapiens
cctgtcacgcgggagaccggggt

SEQ ID NO: 69981 - DNA, 17 bp, Homo sapiens
tcctgccgactacgcca

SEQ ID NO: 69982 - DNA, 40 bp, Homo sapiens; identical to SEQ ID NO: 66308

SEQ ID NO: 69983 - DNA, 30 bp, Homo sapiens; identical to SEQ ID NO: 66254

SEQ ID NO: 69984 - DNA, 24 bp, Homo sapiens
gctcacatcaccccataaacacca

SEQ ID NO: 69985 - DNA, 18 bp, Homo sapiens
accctgctcgctgcgcca

SEQ ID NO: 69986 - DNA, 40 bp, Homo sapiens; identical to SEQ ID NO: 66369

SEQ ID NO: 69987 - DNA, 18 bp, Homo sapiens
ttccggctcgaaggacca

SEQ ID NO: 69988 - DNA, 32 bp, Homo sapiens; identical to SEQ ID NO: 66316

SEQ ID NO: 69989 - DNA, 33 bp, Homo sapiens; identical to SEQ ID NO: 66365

SEQ ID NO: 69990 - DNA, 20 bp, Homo sapiens
acatcaccccataaacacca

SEQ ID NO: 69991 - DNA, 41 bp, Homo sapiens; identical to SEQ ID NO: 66542

SEQ ID NO: 69992 - DNA, 17 bp, Homo sapiens
gcccgcattctccacca

SEQ ID NO: 69993 - DNA, 33 bp, Homo sapiens; identical to SEQ ID NO: 66394

SEQ ID NO: 69994 - DNA, 40 bp, Homo sapiens; identical to SEQ ID NO: 66469

SEQ ID NO: 69995 - DNA, 18 bp, Homo sapiens
atcccatcctcgtcgcca

SEQ ID NO: 69996 - DNA, 22 bp, Homo sapiens
tcaatccccagcacctccacca

SEQ ID NO: 69997 - DNA, 30 bp, Homo sapiens; identical to SEQ ID NO: 66636

SEQ ID NO: 69998 - DNA, 36 bp, Homo sapiens; identical to SEQ ID NO: 66348

SEQ ID NO: 69999 - DNA, 33 bp, Homo sapiens; identical to SEQ ID NO: 66359

SEQ ID NO: 70000 - DNA, 32 bp, Homo sapiens; identical to SEQ ID NO: 66491

SEQ ID NO: 70001 - DNA, 34 bp, Homo sapiens; identical to SEQ ID NO: 66354

SEQ ID NO: 70002 - DNA, 36 bp, Homo sapiens; identical to SEQ ID NO: 66333

SEQ ID NO: 70003 - DNA, 30 bp, Homo sapiens; identical to SEQ ID NO: 66300

SEQ ID NO: 70004 - DNA, 32 bp, Homo sapiens; identical to SEQ ID NO: 66290

SEQ ID NO: 70005 - DNA, 22 bp, Homo sapiens
tcaatccccggcatctccacca

SEQ ID NO: 70006 - DNA, 34 bp, Homo sapiens; identical to SEQ ID NO: 66508

SEQ ID NO: 70007 - DNA, 16 bp, Homo sapiens
ccgggtgccccctcca

SEQ ID NO: 70008 - DNA, 34 bp, Homo sapiens; identical to SEQ ID NO: 66336

SEQ ID NO: 70009 - DNA, 22 bp, Homo sapiens
gagaaagctcacaagaactgct

SEQ ID NO: 70010 - DNA, 29 bp, Homo sapiens
cggctagctcagtcggtagagcatgggac

SEQ ID NO: 70011 - DNA, 30 bp, Homo sapiens; identical to SEQ ID NO: 66519

SEQ ID NO: 70012 - DNA, 36 bp, Homo sapiens; identical to SEQ ID NO: 66384

SEQ ID NO: 70013 - DNA, 35 bp, Homo sapiens; identical to SEQ ID NO: 66432

SEQ ID NO: 70014 - DNA, 18 bp, Homo sapiens
atcccagtagagcctcca

SEQ ID NO: 70015 - DNA, 40 bp, Homo sapiens; identical to SEQ ID NO: 66383

SEQ ID NO: 70016 - DNA, 18 bp, Homo sapiens
atccggctcggaggacca

SEQ ID NO: 70017 - DNA, 19 bp, Homo sapiens
gagaaagctcacaagaact

SEQ ID NO: 70018 - DNA, 25 bp, Homo sapiens
caacttaacttgaccgctctgacca

SEQ ID NO: 70019 - DNA, 17 bp, Homo sapiens
ccccgacacctccacca

SEQ ID NO: 70020 - DNA, 33 bp, Homo sapiens; identical to SEQ ID NO: 66297

SEQ ID NO: 70021 - DNA, 30 bp, Homo sapiens; identical to SEQ ID NO: 66406

SEQ ID NO: 70022 - DNA, 21 bp, Homo sapiens
cacatcaccccataaacacca

SEQ ID NO: 70023 - DNA, 29 bp, Homo sapiens
gcgccgctggtgtagtggtatcatgcaag

SEQ ID NO: 70024 - DNA, 18 bp, Homo sapiens
ctcccggtatgggaacca

SEQ ID NO: 70025 - DNA, 38 bp, Homo sapiens; identical to SEQ ID NO: 66373

SEQ ID NO: 70026 - DNA, 39 bp, Homo sapiens; identical to SEQ ID NO: 66266

SEQ ID NO: 70027 - DNA, 27 bp, Homo sapiens
gaggcttacgaccccttatttacccca

SEQ ID NO: 70028 - DNA, 33 bp, Homo sapiens; identical to SEQ ID NO: 66423

SEQ ID NO: 70029 - DNA, 29 bp, Homo sapiens
gacgggctcacatcaccccataaacacca

SEQ ID NO: 70030 - DNA, 31 bp, Homo sapiens; identical to SEQ ID NO: 66512

SEQ ID NO: 70031 - DNA, 26 bp, Homo sapiens
gagaaagctcacaagaactgctaact

SEQ ID NO: 70032 - DNA, 35 bp, Homo sapiens; identical to SEQ ID NO: 68971

SEQ ID NO: 70033 - DNA, 20 bp, Homo sapiens
acattcaaaaaagagtacca

SEQ ID NO: 70034 - DNA, 37 bp, Homo sapiens; identical to SEQ ID NO: 66429

SEQ ID NO: 70035 - DNA, 35 bp, Homo sapiens; identical to SEQ ID NO: 66409

SEQ ID NO: 70036 - DNA, 24 bp, Homo sapiens
gtcgtggttgtagtccgtgcgaga

SEQ ID NO: 70037 - DNA, 18 bp, Homo sapiens
ttccccgacggggagcca

SEQ ID NO: 70038 - DNA, 34 bp, Homo sapiens; identical to SEQ ID NO: 66338

SEQ ID NO: 70039 - DNA, 38 bp, Homo sapiens; identical to SEQ ID NO: 66458

SEQ ID NO: 70040 - DNA, 17 bp, Homo sapiens
tccggctcggaggacca

SEQ ID NO: 70041 - DNA, 45 bp, Homo sapiens; identical to SEQ ID NO: 66562

SEQ ID NO: 70042 - DNA, 37 bp, Homo sapiens; identical to SEQ ID NO: 66355

SEQ ID NO: 70043 - DNA, 28 bp, Homo sapiens
ggagaccggggttcgattccccgacggg

SEQ ID NO: 70044 - DNA, 30 bp, Homo sapiens; identical to SEQ ID NO: 66295

SEQ ID NO: 70045 - DNA, 30 bp, Homo sapiens; identical to SEQ ID NO: 66358

SEQ ID NO: 70046 - DNA, 17 bp, Homo sapiens
tccccggcacctccacc

SEQ ID NO: 70047 - DNA, 26 bp, Homo sapiens
gggctcacatcaccccataaacacca

SEQ ID NO: 70048 - DNA, 31 bp, Homo sapiens; identical to SEQ ID NO: 66411

SEQ ID NO: 70049 - DNA, 31 bp, Homo sapiens; identical to SEQ ID NO: 69514

SEQ ID NO: 70050 - DNA, 32 bp, Homo sapiens; identical to SEQ ID NO: 67902

SEQ ID NO: 70051 - DNA, 45 bp, Homo sapiens; identical to SEQ ID NO: 66581

SEQ ID NO: 70052 - DNA, 18 bp, Homo sapiens
gtcccaccagagtcgcca

SEQ ID NO: 70053 - DNA, 32 bp, Homo sapiens; identical to SEQ ID NO: 66350

SEQ ID NO: 70054 - DNA, 22 bp, Homo sapiens
tcgaatcccactcctgacacca

SEQ ID NO: 70055 - DNA, 17 bp, Homo sapiens
tccccagtacctccacc

SEQ ID NO: 70056 - DNA, 33 bp, Homo sapiens; identical to SEQ ID NO: 66298

SEQ ID NO: 70057 - DNA, 35 bp, Homo sapiens; identical to SEQ ID NO: 66371

SEQ ID NO: 70058 - DNA, 25 bp, Homo sapiens
gcccggctagctcagtcggtagagc

SEQ ID NO: 70059 - DNA, 45 bp, Homo sapiens; identical to SEQ ID NO: 66310

SEQ ID NO: 70060 - DNA, 42 bp, Homo sapiens; identical to SEQ ID NO: 66418

SEQ ID NO: 70061 - DNA, 22 bp, Homo sapiens
tcgactcccagcggggcctcca

SEQ ID NO: 70062 - DNA, 32 bp, Homo sapiens; identical to SEQ ID NO: 66380

SEQ ID NO: 70063 - DNA, 22 bp, Homo sapiens
tcaagtccctgttcgggcgcca

SEQ ID NO: 70064 - DNA, 42 bp, Homo sapiens; identical to SEQ ID NO: 66325

SEQ ID NO: 70065 - DNA, 29 bp, Homo sapiens
ccggatagctcagtcggtagagcatcaga

SEQ ID NO: 70066 - DNA, 22 bp, Homo sapiens
tcaaatcccggacgagccccca

SEQ ID NO: 70067 - DNA, 39 bp, Homo sapiens; identical to SEQ ID NO: 66506

SEQ ID NO: 70068 - DNA, 18 bp, Homo sapiens
gtccctgtccaggcgcca

SEQ ID NO: 70069 - DNA, 34 bp, Homo sapiens; identical to SEQ ID NO: 66527

SEQ ID NO: 70070 - DNA, 18 bp, Homo sapiens
aaccgggcagaagcacca

SEQ ID NO: 70071 - DNA, 36 bp, Homo sapiens; identical to SEQ ID NO: 66305

SEQ ID NO: 70072 - DNA, 26 bp, Homo sapiens
gcccggctagctcagtcggtagagca

SEQ ID NO: 70073 - DNA, 22 bp, Homo sapiens
tcgaatcccagcggtgcctcca

SEQ ID NO: 70074 - DNA, 23 bp, Homo sapiens
acttaacttgaccgctctgacca

SEQ ID NO: 70075 - DNA, 24 bp, Homo sapiens
gacaacattcaaaaaagagtacca

SEQ ID NO: 70076 - DNA, 39 bp, Homo sapiens; identical to SEQ ID NO: 68790

SEQ ID NO: 70077 - DNA, 29 bp, Homo sapiens
gcccggctagctcagtcggtagagcatga

SEQ ID NO: 70078 - DNA, 32 bp, Homo sapiens; identical to SEQ ID NO: 66786

SEQ ID NO: 70079 - DNA, 33 bp, Homo sapiens; identical to SEQ ID NO: 67214

SEQ ID NO: 70080 - DNA, 44 bp, Homo sapiens; identical to SEQ ID NO: 66403

SEQ ID NO: 70081 - DNA, 22 bp, Homo sapiens
tcgaatcccagcggggcctcca

SEQ ID NO: 70082 - DNA, 42 bp, Homo sapiens; identical to SEQ ID NO: 66446

SEQ ID NO: 70083 - DNA, 31 bp, Homo sapiens; identical to SEQ ID NO: 66463

SEQ ID NO: 70084 - DNA, 38 bp, Homo sapiens; identical to SEQ ID NO: 66565

SEQ ID NO: 70085 - DNA, 30 bp, Homo sapiens; identical to SEQ ID NO: 66337

SEQ ID NO: 70086 - DNA, 42 bp, Homo sapiens; identical to SEQ ID NO: 66486

SEQ ID NO: 70087 - DNA, 36 bp, Homo sapiens; identical to SEQ ID NO: 66529

SEQ ID NO: 70088 - DNA, 31 bp, Homo sapiens; identical to SEQ ID NO: 66461

SEQ ID NO: 70089 - DNA, 40 bp, Homo sapiens; identical to SEQ ID NO: 66543

SEQ ID NO: 70090 - DNA, 38 bp, Homo sapiens; identical to SEQ ID NO: 66408

SEQ ID NO: 70091 - DNA, 39 bp, Homo sapiens; identical to SEQ ID NO: 66311

SEQ ID NO: 70092 - DNA, 42 bp, Homo sapiens; identical to SEQ ID NO: 66638

SEQ ID NO: 70093 - DNA, 22 bp, Homo sapiens
tcgagccccagtggaaccacca

SEQ ID NO: 70094 - DNA, 16 bp, Homo sapiens
cccggccaacgcacca

SEQ ID NO: 70095 - DNA, 18 bp, Homo sapiens
atccaggtgccccctcca

SEQ ID NO: 70096 - DNA, 23 bp, Homo sapiens
acaacattcaaaaaagagtacca

SEQ ID NO: 70097 - DNA, 30 bp, Homo sapiens; identical to SEQ ID NO: 66397

SEQ ID NO: 70098 - DNA, 43 bp, Homo sapiens; identical to SEQ ID NO: 66410

SEQ ID NO: 70099 - DNA, 40 bp, Homo sapiens; identical to SEQ ID NO: 66578

SEQ ID NO: 70100 - DNA, 29 bp, Homo sapiens
ccggctagctcagtcggtagagcatgaga

SEQ ID NO: 70101 - DNA, 31 bp, Homo sapiens; identical to SEQ ID NO: 66413

SEQ ID NO: 70102 - DNA, 31 bp, Homo sapiens; identical to SEQ ID NO: 66478

SEQ ID NO: 70103 - DNA, 37 bp, Homo sapiens; identical to SEQ ID NO: 66487

SEQ ID NO: 70104 - DNA, 27 bp, Homo sapiens
gtggttgtagtccgtgcgagaatacca

SEQ ID NO: 70105 - DNA, 35 bp, Homo sapiens; identical to SEQ ID NO: 66592

SEQ ID NO: 70106 - DNA, 29 bp, Homo sapiens
ccggctagctcagtcggtagagcatggga

SEQ ID NO: 70107 - DNA, 42 bp, Homo sapiens; identical to SEQ ID NO: 66825

SEQ ID NO: 70108 - DNA, 45 bp, Homo sapiens; identical to SEQ ID NO: 66405

SEQ ID NO: 70109 - DNA, 22 bp, Homo sapiens
agaccggggttcgattccccga

SEQ ID NO: 70110 - DNA, 46 bp, Homo sapiens; identical to SEQ ID NO: 66518

SEQ ID NO: 70111 - DNA, 31 bp, Homo sapiens; identical to SEQ ID NO: 68261

SEQ ID NO: 70112 - DNA, 35 bp, Homo sapiens; identical to SEQ ID NO: 66709

SEQ ID NO: 70113 - DNA, 32 bp, Homo sapiens; identical to SEQ ID NO: 66605

SEQ ID NO: 70114 - DNA, 25 bp, Homo sapiens
tccattggggtttccccgcgcaggt

SEQ ID NO: 70115 - DNA, 34 bp, Homo sapiens; identical to SEQ ID NO: 66537

SEQ ID NO: 70116 - DNA, 46 bp, Homo sapiens; identical to SEQ ID NO: 66443

SEQ ID NO: 70117 - DNA, 18 bp, Homo sapiens
gtccgtgcgagaatacca

SEQ ID NO: 70118 - DNA, 29 bp, Homo sapiens
gcatgggtggttcagtggtagaattctcg

SEQ ID NO: 70119 - DNA, 36 bp, Homo sapiens; identical to SEQ ID NO: 66366

SEQ ID NO: 70120 - DNA, 29 bp, Homo sapiens
gggagaccggggttcgattccccgacggg

SEQ ID NO: 70121 - DNA, 39 bp, Homo sapiens; identical to SEQ ID NO: 68620

SEQ ID NO: 70122 - DNA, 35 bp, Homo sapiens; identical to SEQ ID NO: 66480

SEQ ID NO: 70123 - DNA, 36 bp, Homo sapiens; identical to SEQ ID NO: 66701

SEQ ID NO: 70124 - DNA, 17 bp, Homo sapiens
tccccggcatctccacc

SEQ ID NO: 70125 - DNA, 17 bp, Homo sapiens
accccttatttacccca

SEQ ID NO: 70126 - DNA, 21 bp, Homo sapiens
caatccccggcacctccacca

SEQ ID NO: 70127 - DNA, 24 bp, Homo sapiens
accaacacctctttacagtgacca

SEQ ID NO: 70128 - DNA, 37 bp, Homo sapiens; identical to SEQ ID NO: 66331

SEQ ID NO: 70129 - DNA, 35 bp, Homo sapiens; identical to SEQ ID NO: 66646

SEQ ID NO: 70130 - DNA, 33 bp, Homo sapiens; identical to SEQ ID NO: 67046

SEQ ID NO: 70131 - DNA, 22 bp, Homo sapiens
tcacatcaccccataaacacca

SEQ ID NO: 70132 - DNA, 45 bp, Homo sapiens; identical to SEQ ID NO: 69737

SEQ ID NO: 70133 - DNA, 28 bp, Homo sapiens
gcgccgctggtgtagtggtatcatgcaa

SEQ ID NO: 70134 - DNA, 45 bp, Homo sapiens; identical to SEQ ID NO: 66427

SEQ ID NO: 70135 - DNA, 16 bp, Homo sapiens
ccgggcagaagcacca

SEQ ID NO: 70136 - DNA, 42 bp, Homo sapiens; identical to SEQ ID NO: 67174

SEQ ID NO: 70137 - DNA, 18 bp, Homo sapiens
tcccacccagggacgcca

SEQ ID NO: 70138 - DNA, 26 bp, Homo sapiens
gagcttaaacccccttatttctacca

SEQ ID NO: 70139 - DNA, 33 bp, Homo sapiens; identical to SEQ ID NO: 66442

SEQ ID NO: 70140 - DNA, 27 bp, Homo sapiens
cgggctcacatcaccccataaacacca

SEQ ID NO: 70141 - DNA, 18 bp, Homo sapiens
atcccaccttcgtcgcca

SEQ ID NO: 70142 - DNA, 30 bp, Homo sapiens; identical to SEQ ID NO: 66576

SEQ ID NO: 70143 - DNA, 37 bp, Homo sapiens; identical to SEQ ID NO: 66415

SEQ ID NO: 70144 - DNA, 30 bp, Homo sapiens; identical to SEQ ID NO: 66426

SEQ ID NO: 70145 - DNA, 46 bp, Homo sapiens; identical to SEQ ID NO: 66703

SEQ ID NO: 70146 - DNA, 36 bp, Homo sapiens; identical to SEQ ID NO: 66678

SEQ ID NO: 70147 - DNA, 18 bp, Homo sapiens
tgcccgcattctccacca

SEQ ID NO: 70148 - DNA, 31 bp, Homo sapiens; identical to SEQ ID NO: 66395

SEQ ID NO: 70149 - DNA, 31 bp, Homo sapiens; identical to SEQ ID NO: 68836

SEQ ID NO: 70150 - DNA, 28 bp, Homo sapiens
gcccggctagctcagtcggtagagcatg

SEQ ID NO: 70151 - DNA, 34 bp, Homo sapiens; identical to SEQ ID NO: 67087

SEQ ID NO: 70152 - DNA, 31 bp, Homo sapiens; identical to SEQ ID NO: 66460

SEQ ID NO: 70153 - DNA, 38 bp, Homo sapiens; identical to SEQ ID NO: 66504

SEQ ID NO: 70154 - DNA, 16 bp, Homo sapiens
ctcggtggaacctcca

SEQ ID NO: 70155 - DNA, 24 bp, Homo sapiens
gtgcaactccaaataaaagtacca

SEQ ID NO: 70156 - DNA, 24 bp, Homo sapiens
gagaccggggttcgattccccgac

SEQ ID NO: 70157 - DNA, 32 bp, Homo sapiens; identical to SEQ ID NO: 69003

SEQ ID NO: 70158 - DNA, 35 bp, Homo sapiens; identical to SEQ ID NO: 67687

SEQ ID NO: 70159 - DNA, 23 bp, Homo sapiens
agaccggggttcaattccccgac

SEQ ID NO: 70160 - DNA, 29 bp, Homo sapiens
cgggagaccggggttcgattccccgacgg

SEQ ID NO: 70161 - DNA, 38 bp, Homo sapiens; identical to SEQ ID NO: 66765

SEQ ID NO: 70162 - DNA, 24 bp, Homo sapiens
gttgtagtccgtgcgagaatacca

SEQ ID NO: 70163 - DNA, 39 bp, Homo sapiens; identical to SEQ ID NO: 67238

SEQ ID NO: 70164 - DNA, 34 bp, Homo sapiens; identical to SEQ ID NO: 66466

SEQ ID NO: 70165 - DNA, 44 bp, Homo sapiens; identical to SEQ ID NO: 66381

SEQ ID NO: 70166 - DNA, 26 bp, Homo sapiens
gcccggatagctcagtcggtagagca

SEQ ID NO: 70167 - DNA, 22 bp, Homo sapiens
tcaattccccgacggggagcca

SEQ ID NO: 70168 - DNA, 22 bp, Homo sapiens
tcgatccccgtacgggccacca

SEQ ID NO: 70169 - DNA, 38 bp, Homo sapiens; identical to SEQ ID NO: 68663

SEQ ID NO: 70170 - DNA, 18 bp, Homo sapiens
accccgtacgggccacca

SEQ ID NO: 70171 - DNA, 16 bp, Homo sapiens
cccgggcggcgcacca

SEQ ID NO: 70172 - DNA, 41 bp, Homo sapiens; identical to SEQ ID NO: 66535

SEQ ID NO: 70173 - DNA, 17 bp, Homo sapiens
ccccgtccgtgcctcca

SEQ ID NO: 70174 - DNA, 31 bp, Homo sapiens; identical to SEQ ID NO: 66347

SEQ ID NO: 70175 - DNA, 40 bp, Homo sapiens; identical to SEQ ID NO: 66737

SEQ ID NO: 70176 - DNA, 34 bp, Homo sapiens; identical to SEQ ID NO: 66374

SEQ ID NO: 70177 - DNA, 38 bp, Homo sapiens; identical to SEQ ID NO: 69790

SEQ ID NO: 70178 - DNA, 19 bp, Homo sapiens
atccccagcacctccacca

SEQ ID NO: 70179 - DNA, 23 bp, Homo sapiens
ctgtcacgcgggagaccggggtt

SEQ ID NO: 70180 - DNA, 23 bp, Homo sapiens
ccaacacctctttacagtgacca

SEQ ID NO: 70181 - DNA, 16 bp, Homo sapiens
ccggctcgaaggacca

SEQ ID NO: 70182 - DNA, 37 bp, Homo sapiens; identical to SEQ ID NO: 66794

SEQ ID NO: 70183 - DNA, 46 bp, Homo sapiens; identical to SEQ ID NO: 66525

SEQ ID NO: 70184 - DNA, 37 bp, Homo sapiens; identical to SEQ ID NO: 68801

SEQ ID NO: 70185 - DNA, 35 bp, Homo sapiens; identical to SEQ ID NO: 66436

SEQ ID NO: 70186 - DNA, 18 bp, Homo sapiens
gtcacgtcggggtcacca

SEQ ID NO: 70187 - DNA, 32 bp, Homo sapiens; identical to SEQ ID NO: 66517

SEQ ID NO: 70188 - DNA, 24 bp, Homo sapiens
gttcgattccccgacggggagcca

SEQ ID NO: 70189 - DNA, 21 bp, Homo sapiens
cgatccccggcatctccacca

SEQ ID NO: 70190 - DNA, 16 bp, Homo sapiens
ctctttacagtgacca

SEQ ID NO: 70191 - DNA, 40 bp, Homo sapiens; identical to SEQ ID NO: 66503

SEQ ID NO: 70192 - DNA, 18 bp, Homo sapiens
gagcccggtaatcgcata

SEQ ID NO: 70193 - DNA, 22 bp, Homo sapiens
tcgaatcccacttctgacacca

SEQ ID NO: 70194 - DNA, 40 bp, Homo sapiens; identical to SEQ ID NO: 67780

SEQ ID NO: 70195 - DNA, 35 bp, Homo sapiens; identical to SEQ ID NO: 67186

SEQ ID NO: 70196 - DNA, 31 bp, Homo sapiens; identical to SEQ ID NO: 66524

SEQ ID NO: 70197 - DNA, 39 bp, Homo sapiens; identical to SEQ ID NO: 67050

SEQ ID NO: 70198 - DNA, 29 bp, Homo sapiens
caaagcaatacactgaaaatgtttagacg

SEQ ID NO: 70199 - DNA, 36 bp, Homo sapiens; identical to SEQ ID NO: 66376

SEQ ID NO: 70200 - DNA, 33 bp, Homo sapiens; identical to SEQ ID NO: 66682

SEQ ID NO: 70201 - DNA, 33 bp, Homo sapiens; identical to SEQ ID NO: 66439

SEQ ID NO: 70202 - DNA, 19 bp, Homo sapiens
actcccggtgtgggaacca

SEQ ID NO: 70203 - DNA, 33 bp, Homo sapiens; identical to SEQ ID NO: 66570

SEQ ID NO: 70204 - DNA, 28 bp, Homo sapiens
accggagatgaaaacctttttccaagga

SEQ ID NO: 70205 - DNA, 31 bp, Homo sapiens; identical to SEQ ID NO: 66632

SEQ ID NO: 70206 - DNA, 21 bp, Homo sapiens
tgtcacgcgggagaccggggt

SEQ ID NO: 70207 - DNA, 36 bp, Homo sapiens; identical to SEQ ID NO: 67181

SEQ ID NO: 70208 - DNA, 31 bp, Homo sapiens; identical to SEQ ID NO: 66530

SEQ ID NO: 70209 - DNA, 23 bp, Homo sapiens
ccttccaagcagttgacccgggt

SEQ ID NO: 70210 - DNA, 18 bp, Homo sapiens
ctcccagtggggcctcca

SEQ ID NO: 70211 - DNA, 34 bp, Homo sapiens; identical to SEQ ID NO: 66545

SEQ ID NO: 70212 - DNA, 24 bp, Homo sapiens
aacttaacttgaccgctctgacca

SEQ ID NO: 70213 - DNA, 28 bp, Homo sapiens
acgggctcacatcaccccataaacacca

SEQ ID NO: 70214 - DNA, 35 bp, Homo sapiens; identical to SEQ ID NO: 66509

SEQ ID NO: 70215 - DNA, 36 bp, Homo sapiens; identical to SEQ ID NO: 67880

SEQ ID NO: 70216 - DNA, 30 bp, Homo sapiens; identical to SEQ ID NO: 66627

SEQ ID NO: 70217 - DNA, 21 bp, Homo sapiens
aacaacatggctttctcacca

SEQ ID NO: 70218 - DNA, 39 bp, Homo sapiens; identical to SEQ ID NO: 67082

SEQ ID NO: 70219 - DNA, 29 bp, Homo sapiens
gtccttgtagtataaactaatacaccagt

SEQ ID NO: 70220 - DNA, 21 bp, Homo sapiens
cgatccccagtacctccacca

SEQ ID NO: 70221 - DNA, 36 bp, Homo sapiens; identical to SEQ ID NO: 66536

SEQ ID NO: 70222 - DNA, 26 bp, Homo sapiens
gaaaatgtttagacgggctcacatca

SEQ ID NO: 70223 - DNA, 33 bp, Homo sapiens; identical to SEQ ID NO: 66417

SEQ ID NO: 70224 - DNA, 18 bp, Homo sapiens
tcctcgctggggcctcca

SEQ ID NO: 70225 - DNA, 39 bp, Homo sapiens; identical to SEQ ID NO: 66742

SEQ ID NO: 70226 - DNA, 23 bp, Homo sapiens
tcccacatggtctagcggttagg

SEQ ID NO: 70227 - DNA, 22 bp, Homo sapiens
caacattcaaaaaagagtacca

SEQ ID NO: 70228 - DNA, 40 bp, Homo sapiens; identical to SEQ ID NO: 66779

SEQ ID NO: 70229 - DNA, 38 bp, Homo sapiens; identical to SEQ ID NO: 66441

SEQ ID NO: 70230 - DNA, 43 bp, Homo sapiens; identical to SEQ ID NO: 69611

SEQ ID NO: 70231 - DNA, 29 bp, Homo sapiens
gcccggctagctcagtcggtagagcatgg

SEQ ID NO: 70232 - DNA, 39 bp, Homo sapiens; identical to SEQ ID NO: 66445

SEQ ID NO: 70233 - DNA, 23 bp, Homo sapiens
gtcgtggttgtagtccgtgcgag

SEQ ID NO: 70234 - DNA, 30 bp, Homo sapiens
acgcgggagaccggggttcgattccccgac

SEQ ID NO: 70235 - DNA, 18 bp, Homo sapiens
atcccagcgaggcctcca

SEQ ID NO: 70236 - DNA, 37 bp, Homo sapiens; identical to SEQ ID NO: 66520

SEQ ID NO: 70237 - DNA, 43 bp, Homo sapiens; identical to SEQ ID NO: 69670

SEQ ID NO: 70238 - DNA, 18 bp, Homo sapiens
atcccaccctcgtcgcca

SEQ ID NO: 70239 - DNA, 39 bp, Homo sapiens; identical to SEQ ID NO: 66661

SEQ ID NO: 70240 - DNA, 19 bp, Homo sapiens
gcccggatagctcagtcgg

SEQ ID NO: 70241 - DNA, 39 bp, Homo sapiens; identical to SEQ ID NO: 66736

SEQ ID NO: 70242 - DNA, 33 bp, Homo sapiens; identical to SEQ ID NO: 66617

SEQ ID NO: 70243 - DNA, 30 bp, Homo sapiens; identical to SEQ ID NO: 68746

SEQ ID NO: 70244 - DNA, 40 bp, Homo sapiens
cgcctgtcacgcgggagaccggggttcgattccccgacgg

SEQ ID NO: 70245 - DNA, 22 bp, Homo sapiens
tcgagcccacccagggacgcca

SEQ ID NO: 70246 - DNA, 18 bp, Homo sapiens
gaaaaagtcatggaggcc

SEQ ID NO: 70247 - DNA, 27 bp, Homo sapiens
gatgaaaacctttttccaaggacacca

SEQ ID NO: 70248 - DNA, 44 bp, Homo sapiens; identical to SEQ ID NO: 67155

SEQ ID NO: 70249 - DNA, 34 bp, Homo sapiens; identical to SEQ ID NO: 68860

SEQ ID NO: 70250 - DNA, 27 bp, Homo sapiens
ggagaccggggttcgattccccgacgg

SEQ ID NO: 70251 - DNA, 38 bp, Homo sapiens
gcacgaggccctgggttcaatccccagcacctccacca

SEQ ID NO: 70252 - DNA, 42 bp, Homo sapiens; identical to SEQ ID NO: 66534

SEQ ID NO: 70253 - DNA, 44 bp, Homo sapiens; identical to SEQ ID NO: 66598

SEQ ID NO: 70254 - DNA, 19 bp, Homo sapiens
agtccgtgcgagaatacca

SEQ ID NO: 70255 - DNA, 27 bp, Homo sapiens
gagaaagctcacaagaactgctaactc

SEQ ID NO: 70256 - DNA, 33 bp, Homo sapiens; identical to SEQ ID NO: 67038

SEQ ID NO: 70257 - DNA, 18 bp, Homo sapiens
ttcccggccaacgcacca

SEQ ID NO: 70258 - DNA, 27 bp, Homo sapiens
atgtctaacaacatggctttctcacca

SEQ ID NO: 70259 - DNA, 17 bp, Homo sapiens
tcccggcggagtcgcca

SEQ ID NO: 70260 - DNA, 24 bp, Homo sapiens
ggctcacatcaccccataaacacc

SEQ ID NO: 70261 - DNA, 39 bp, Homo sapiens; identical to SEQ ID NO: 69662

SEQ ID NO: 70262 - DNA, 22 bp, Homo sapiens
tcgatccccgacacctccacca

SEQ ID NO: 70263 - DNA, 21 bp, Homo sapiens
cgattccccgacggggagcca

SEQ ID NO: 70264 - DNA, 39 bp, Homo sapiens; identical to SEQ ID NO: 66707

SEQ ID NO: 70265 - DNA, 20 bp, Homo sapiens
gcaatacttaatttctgcca

SEQ ID NO: 70266 - DNA, 34 bp, Homo sapiens; identical to SEQ ID NO: 66593

SEQ ID NO: 70267 - DNA, 46 bp, Homo sapiens; identical to SEQ ID NO: 66805

SEQ ID NO: 70268 - DNA, 18 bp, Homo sapiens
atctcggtggaacctcca

SEQ ID NO: 70269 - DNA, 31 bp, Homo sapiens; identical to SEQ ID NO: 66675

SEQ ID NO: 70270 - DNA, 45 bp, Homo sapiens; identical to SEQ ID NO: 66653

SEQ ID NO: 70271 - DNA, 34 bp, Homo sapiens; identical to SEQ ID NO: 69618

SEQ ID NO: 70272 - DNA, 33 bp, Homo sapiens; identical to SEQ ID NO: 66710

SEQ ID NO: 70273 - DNA, 18 bp, Homo sapiens
gaccccttatttacccca

SEQ ID NO: 70274 - DNA, 33 bp, Homo sapiens; identical to SEQ ID NO: 69469

SEQ ID NO: 70275 - DNA, 39 bp, Homo sapiens; identical to SEQ ID NO: 68917

SEQ ID NO: 70276 - DNA, 34 bp, Homo sapiens; identical to SEQ ID NO: 69656

SEQ ID NO: 70277 - DNA, 42 bp, Homo sapiens; identical to SEQ ID NO: 66647

SEQ ID NO: 70278 - DNA, 26 bp, Homo sapiens
gaaccaacacctctttacagtgacca

SEQ ID NO: 70279 - DNA, 43 bp, Homo sapiens; identical to SEQ ID NO: 68873

SEQ ID NO: 70280 - DNA, 28 bp, Homo sapiens
gagaaagctcacaagaactgctaactca

SEQ ID NO: 70281 - DNA, 25 bp, Homo sapiens
tgacaacattcaaaaaagagtacca

SEQ ID NO: 70282 - DNA, 29 bp, Homo sapiens
ccgtgatcgtatagtggttagtactctgc

SEQ ID NO: 70283 - DNA, 42 bp, Homo sapiens; identical to SEQ ID NO: 69002

SEQ ID NO: 70284 - DNA, 22 bp, Homo sapiens
tcgatccccagcatctccacca

SEQ ID NO: 70285 - DNA, 35 bp, Homo sapiens; identical to SEQ ID NO: 66573

SEQ ID NO: 70286 - DNA, 35 bp, Homo sapiens; identical to SEQ ID NO: 66595

SEQ ID NO: 70287 - DNA, 36 bp, Homo sapiens; identical to SEQ ID NO: 66676

SEQ ID NO: 70288 - DNA, 25 bp, Homo sapiens
gagcccggtaatcgcataaaactta

SEQ ID NO: 70289 - DNA, 41 bp, Homo sapiens; identical to SEQ ID NO: 66412

SEQ ID NO: 70290 - DNA, 36 bp, Homo sapiens; identical to SEQ ID NO: 66813

SEQ ID NO: 70291 - DNA, 32 bp, Homo sapiens; identical to SEQ ID NO: 66789

SEQ ID NO: 70292 - DNA, 43 bp, Homo sapiens; identical to SEQ ID NO: 68429

SEQ ID NO: 70293 - DNA, 24 bp, Homo sapiens
ccttccaagcagttgacccgggtt

SEQ ID NO: 70294 - DNA, 17 bp, Homo sapiens
ccctgctcgctgcgcca

SEQ ID NO: 70295 - DNA, 25 bp, Homo sapiens
ggggttaggcctctttttaccacca

SEQ ID NO: 70296 - DNA, 41 bp, Homo sapiens; identical to SEQ ID NO: 68462

SEQ ID NO: 70297 - DNA, 29 bp, Homo sapiens
cagtaagttgcaatacttaatttctgcca

SEQ ID NO: 70298 - DNA, 22 bp, Homo sapiens
tcgattcccggtcagggaacca

SEQ ID NO: 70299 - DNA, 44 bp, Homo sapiens; identical to SEQ ID NO: 69797

SEQ ID NO: 70300 - DNA, 32 bp, Homo sapiens; identical to SEQ ID NO: 66714

SEQ ID NO: 70301 - DNA, 23 bp, Homo sapiens
gaaaatgtttagacgggctcaca

SEQ ID NO: 70302 - DNA, 39 bp, Homo sapiens
gcctgtcacgcgggagaccggggttcgattccccgacgg

SEQ ID NO: 70303 - DNA, 17 bp, Homo sapiens
tccgtgcgagaatacca

SEQ ID NO: 70304 - DNA, 17 bp, Homo sapiens
tcccggccaacgcacca

SEQ ID NO: 70305 - DNA, 32 bp, Homo sapiens; identical to SEQ ID NO: 66531

SEQ ID NO: 70306 - DNA, 23 bp, Homo sapiens
ctcacatcaccccataaacacca

SEQ ID NO: 70307 - DNA, 38 bp, Homo sapiens; identical to SEQ ID NO: 66575

SEQ ID NO: 70308 - DNA, 18 bp, Homo sapiens
catcaccccataaacacc

SEQ ID NO: 70309 - DNA, 24 bp, Homo sapiens
gggttaggcctctttttaccacca

SEQ ID NO: 70310 - DNA, 26 bp, Homo sapiens
aggcttacgaccccttatttacccca

SEQ ID NO: 70311 - DNA, 43 bp, Homo sapiens; identical to SEQ ID NO: 67993

SEQ ID NO: 70312 - DNA, 20 bp, Homo sapiens
gagaaagctcacaagaactg

SEQ ID NO: 70313 - DNA, 26 bp, Homo sapiens
tcaacttaacttgaccgctctgacca

SEQ ID NO: 70314 - DNA, 20 bp, Homo sapiens
aacacctctttacagtgacc

SEQ ID NO: 70315 - DNA, 37 bp, Homo sapiens; identical to SEQ ID NO: 67782

SEQ ID NO: 70316 - DNA, 24 bp, Homo sapiens
ggttatacccttcccgtactacca

SEQ ID NO: 70317 - DNA, 32 bp, Homo sapiens; identical to SEQ ID NO: 66516

SEQ ID NO: 70318 - DNA, 19 bp, Homo sapiens
cattcaaaaaagagtacca

SEQ ID NO: 70319 - DNA, 38 bp, Homo sapiens; identical to SEQ ID NO: 66668

SEQ ID NO: 70320 - DNA, 43 bp, Homo sapiens; identical to SEQ ID NO: 66539

SEQ ID NO: 70321 - DNA, 29 bp, Homo sapiens
gcgggagaccggggttcgattccccgacg

SEQ ID NO: 70322 - DNA, 28 bp, Homo sapiens
gtttccgtagtgtagtggtcatcacgtt

SEQ ID NO: 70323 - DNA, 17 bp, Homo sapiens
acgcgggagaccggggt

SEQ ID NO: 70324 - DNA, 21 bp, Homo sapiens
cgattcccggccaacgcacca

SEQ ID NO: 70325 - DNA, 18 bp, Homo sapiens
gtcccggcggagtcgcca

SEQ ID NO: 70326 - DNA, 37 bp, Homo sapiens; identical to SEQ ID NO: 66635

SEQ ID NO: 70327 - DNA, 39 bp, Homo sapiens; identical to SEQ ID NO: 68554

SEQ ID NO: 70328 - DNA, 39 bp, Homo sapiens; identical to SEQ ID NO: 67903

SEQ ID NO: 70329 - DNA, 19 bp, Homo sapiens
cgaccccttatttacccca

SEQ ID NO: 70330 - DNA, 36 bp, Homo sapiens; identical to SEQ ID NO: 66532

SEQ ID NO: 70331 - DNA, 24 bp, Homo sapiens
agttgcaatacttaatttctgcca

SEQ ID NO: 70332 - DNA, 25 bp, Homo sapiens
ggcttacgaccccttatttacccca

SEQ ID NO: 70333 - DNA, 44 bp, Homo sapiens; identical to SEQ ID NO: 69359

SEQ ID NO: 70334 - DNA, 25 bp, Homo sapiens
ggagaccggggttcgattccccgac

SEQ ID NO: 70335 - DNA, 35 bp, Homo sapiens; identical to SEQ ID NO: 66758

SEQ ID NO: 70336 - DNA, 17 bp, Homo sapiens
tctcggtggaacctcca

SEQ ID NO: 70337 - DNA, 44 bp, Homo sapiens; identical to SEQ ID NO: 66604

SEQ ID NO: 70338 - DNA, 30 bp, Homo sapiens; identical to SEQ ID NO: 66372

SEQ ID NO: 70339 - DNA, 25 bp, Homo sapiens
aaccaacacctctttacagtgacca

SEQ ID NO: 70340 - DNA, 40 bp, Homo sapiens; identical to SEQ ID NO: 66652

SEQ ID NO: 70341 - DNA, 21 bp, Homo sapiens
gagaaagctcacaagaactgc

SEQ ID NO: 70342 - DNA, 23 bp, Homo sapiens
gttatacccttcccgtactacca

SEQ ID NO: 70343 - DNA, 31 bp, Homo sapiens; identical to SEQ ID NO: 67651

SEQ ID NO: 70344 - DNA, 35 bp, Homo sapiens; identical to SEQ ID NO: 66634

SEQ ID NO: 70345 - DNA, 33 bp, Homo sapiens; identical to SEQ ID NO: 69701

SEQ ID NO: 70346 - DNA, 18 bp, Homo sapiens
aggggtatgattctcggt

SEQ ID NO: 70347 - DNA, 34 bp, Homo sapiens; identical to SEQ ID NO: 67718

SEQ ID NO: 70348 - DNA, 22 bp, Homo sapiens
tcaaatccgggtgccccctcca

SEQ ID NO: 70349 - DNA, 29 bp, Homo sapiens
cgcgggagaccggggttcgattccccgac

SEQ ID NO: 70350 - DNA, 37 bp, Homo sapiens; identical to SEQ ID NO: 66756

SEQ ID NO: 70351 - DNA, 31 bp, Homo sapiens; identical to SEQ ID NO: 66502

SEQ ID NO: 70352 - DNA, 27 bp, Homo sapiens
aagcaatacactgaaaatgtttagacg

SEQ ID NO: 70353 - DNA, 22 bp, Homo sapiens
cttaacttgaccgctctgacca

SEQ ID NO: 70354 - DNA, 22 bp, Homo sapiens
tcgaaaccgggcggaaacacca

SEQ ID NO: 70355 - DNA, 30 bp, Homo sapiens; identical to SEQ ID NO: 66754

SEQ ID NO: 70356 - DNA, 37 bp, Homo sapiens; identical to SEQ ID NO: 66493

SEQ ID NO: 70357 - DNA, 46 bp, Homo sapiens; identical to SEQ ID NO: 66679

SEQ ID NO: 70358 - DNA, 22 bp, Homo sapiens
tcgaatccgagtcacggcacca

SEQ ID NO: 70359 - DNA, 34 bp, Homo sapiens; identical to SEQ ID NO: 68779

SEQ ID NO: 70360 - DNA, 36 bp, Homo sapiens
tgtcacgcgggagaccggggttcgattccccgacgg

SEQ ID NO: 70361 - DNA, 44 bp, Homo sapiens; identical to SEQ ID NO: 68984

SEQ ID NO: 70362 - DNA, 18 bp, Homo sapiens
agtggttagtatccccgc

SEQ ID NO: 70363 - DNA, 35 bp, Homo sapiens; identical to SEQ ID NO: 68991

SEQ ID NO: 70364 - DNA, 18 bp, Homo sapiens
ggcctctttttaccacca

SEQ ID NO: 70365 - DNA, 33 bp, Homo sapiens; identical to SEQ ID NO: 68994

SEQ ID NO: 70366 - DNA, 22 bp, Homo sapiens
tcgagtcccacctggggtacca

SEQ ID NO: 70367 - DNA, 18 bp, Homo sapiens
acgcgggagaccggggtt

SEQ ID NO: 70368 - DNA, 18 bp, Homo sapiens
acttgaccgctctgacca

SEQ ID NO: 70369 - DNA, 44 bp, Homo sapiens
ggtttttcatatcattggtcgtggttgtagtccgtgcgagaata

SEQ ID NO: 70370 - DNA, 35 bp, Homo sapiens; identical to SEQ ID NO: 66622

SEQ ID NO: 70371 - DNA, 21 bp, Homo sapiens
tacgaccccttatttacccca

SEQ ID NO: 70372 - DNA, 34 bp, Homo sapiens; identical to SEQ ID NO: 66589

SEQ ID NO: 70373 - DNA, 28 bp, Homo sapiens
agatgaaaacctttttccaaggacacca

SEQ ID NO: 70374 - DNA, 32 bp, Homo sapiens; identical to SEQ ID NO: 66473

SEQ ID NO: 70375 - DNA, 40 bp, Homo sapiens; identical to SEQ ID NO: 66602

SEQ ID NO: 70376 - DNA, 30 bp, Homo sapiens; identical to SEQ ID NO: 66435

SEQ ID NO: 70377 - DNA, 22 bp, Homo sapiens
tcgatcccgggcggaaacacca

SEQ ID NO: 70378 - DNA, 31 bp, Homo sapiens; identical to SEQ ID NO: 66568

SEQ ID NO: 70379 - DNA, 34 bp, Homo sapiens; identical to SEQ ID NO: 69607

SEQ ID NO: 70380 - DNA, 40 bp, Homo sapiens; identical to SEQ ID NO: 66731

SEQ ID NO: 70381 - DNA, 32 bp, Homo sapiens; identical to SEQ ID NO: 66474

SEQ ID NO: 70382 - DNA, 35 bp, Homo sapiens; identical to SEQ ID NO: 67952

SEQ ID NO: 70383 - DNA, 40 bp, Homo sapiens; identical to SEQ ID NO: 66649

SEQ ID NO: 70384 - DNA, 35 bp, Homo sapiens; identical to SEQ ID NO: 66614

SEQ ID NO: 70385 - DNA, 22 bp, Homo sapiens
tcgatgcccgcatcctccacca

SEQ ID NO: 70386 - DNA, 29 bp, Homo sapiens
cggatagctcagtcggtagagcatcagac

SEQ ID NO: 70387 - DNA, 33 bp, Homo sapiens; identical to SEQ ID NO: 69833

SEQ ID NO: 70388 - DNA, 23 bp, Homo sapiens
gagaaagctcacaagaactgcta

SEQ ID NO: 70389 - DNA, 36 bp, Homo sapiens; identical to SEQ ID NO: 66792

SEQ ID NO: 70390 - DNA, 25 bp, Homo sapiens
gtcgtggttgtagtccgtgcgagaa

SEQ ID NO: 70391 - DNA, 27 bp, Homo sapiens
agaaccaacacctctttacagtgacca

SEQ ID NO: 70392 - DNA, 35 bp, Homo sapiens; identical to SEQ ID NO: 66631

SEQ ID NO: 70393 - DNA, 23 bp, Homo sapiens
gttgcaatacttaatttctgcca

SEQ ID NO: 70394 - DNA, 22 bp, Homo sapiens
tcgagtcccatctggggtgcca

SEQ ID NO: 70395 - DNA, 33 bp, Homo sapiens; identical to SEQ ID NO: 66790

SEQ ID NO: 70396 - DNA, 25 bp, Homo sapiens
gagaaagctcacaagaactgctaac

SEQ ID NO: 70397 - DNA, 31 bp, Homo sapiens; identical to SEQ ID NO: 66588

SEQ ID NO: 70398 - DNA, 17 bp, Homo sapiens
ctcccggtgtgggaacc

SEQ ID NO: 70399 - DNA, 28 bp, Homo sapiens
cattggtcgtggttgtagtccgtgcgag

SEQ ID NO: 70400 - DNA, 25 bp, Homo sapiens
tccaatggggtttccccgcacaggt

SEQ ID NO: 70401 - DNA, 41 bp, Homo sapiens; identical to SEQ ID NO: 66470

SEQ ID NO: 70402 - DNA, 27 bp, Homo sapiens
ttcaacttaacttgaccgctctgacca

SEQ ID NO: 70403 - DNA, 45 bp, Homo sapiens; identical to SEQ ID NO: 66753

SEQ ID NO: 70404 - DNA, 17 bp, Homo sapiens
atcatatttaccaacca

SEQ ID NO: 70405 - DNA, 31 bp, Homo sapiens; identical to SEQ ID NO: 66477

SEQ ID NO: 70406 - DNA, 36 bp, Homo sapiens; identical to SEQ ID NO: 66834

SEQ ID NO: 70407 - DNA, 32 bp, Homo sapiens; identical to SEQ ID NO: 66821

SEQ ID NO: 70408 - DNA, 35 bp, Homo sapiens; identical to SEQ ID NO: 67858

SEQ ID NO: 70409 - DNA, 44 bp, Homo sapiens
acactgaaaatgtttagacgggctcacatcaccccataaacacc

SEQ ID NO: 70410 - DNA, 26 bp, Homo sapiens
tggttgtagtccgtgcgagaatacca

SEQ ID NO: 70411 - DNA, 36 bp, Homo sapiens; identical to SEQ ID NO: 69784

SEQ ID NO: 70412 - DNA, 20 bp, Homo sapiens
aactccaaataaaagtacca

SEQ ID NO: 70413 - DNA, 30 bp, Homo sapiens; identical to SEQ ID NO: 67964

SEQ ID NO: 70414 - DNA, 22 bp, Homo sapiens
caacacctctttacagtgacca

SEQ ID NO: 70415 - DNA, 25 bp, Homo sapiens
ggttcaatccccggcacctccacca

SEQ ID NO: 70416 - DNA, 33 bp, Homo sapiens; identical to SEQ ID NO: 67017

SEQ ID NO: 70417 - DNA, 30 bp, Homo sapiens; identical to SEQ ID NO: 66691

SEQ ID NO: 70418 - DNA, 32 bp, Homo sapiens; identical to SEQ ID NO: 66817

SEQ ID NO: 70419 - DNA, 39 bp, Homo sapiens
aatccagcgatccgagttcaaatctcggtggaacctcca

SEQ ID NO: 70420 - DNA, 35 bp, Homo sapiens; identical to SEQ ID NO: 66559

SEQ ID NO: 70421 - DNA, 30 bp, Homo sapiens; identical to SEQ ID NO: 66514

SEQ ID NO: 70422 - DNA, 35 bp, Homo sapiens; identical to SEQ ID NO: 66708

SEQ ID NO: 70423 - DNA, 41 bp, Homo sapiens; identical to SEQ ID NO: 66656

SEQ ID NO: 70424 - DNA, 39 bp, Homo sapiens; identical to SEQ ID NO: 66654

SEQ ID NO: 70425 - DNA, 30 bp, Homo sapiens; identical to SEQ ID NO: 66644

SEQ ID NO: 70426 - DNA, 22 bp, Homo sapiens
tcgagtcccttcgtggtcgcca

SEQ ID NO: 70427 - DNA, 36 bp, Homo sapiens
atgtttagacgggctcacatcaccccataaacacca

SEQ ID NO: 70428 - DNA, 43 bp, Homo sapiens; identical to SEQ ID NO: 66558

SEQ ID NO: 70429 - DNA, 35 bp, Homo sapiens; identical to SEQ ID NO: 66553

SEQ ID NO: 70430 - DNA, 30 bp, Homo sapiens
cggatagctcagtcggtagagcatcagact

SEQ ID NO: 70431 - DNA, 28 bp, Homo sapiens
gggtatagctcagcggtagagcgcgtgc

SEQ ID NO: 70432 - DNA, 32 bp, Homo sapiens
ggttccatagtgtagtggttatcacatctgct

SEQ ID NO: 70433 - DNA, 38 bp, Homo sapiens; identical to SEQ ID NO: 66744

SEQ ID NO: 70434 - DNA, 29 bp, Homo sapiens
gacaggggttaggcctctttttaccacca

SEQ ID NO: 70435 - DNA, 38 bp, Homo sapiens; identical to SEQ ID NO: 66623

SEQ ID NO: 70436 - DNA, 25 bp, Homo sapiens
ggttgtagtccgtgcgagaatacca

SEQ ID NO: 70437 - DNA, 17 bp, Homo sapiens
tcctgccgcggtcgcca

SEQ ID NO: 70438 - DNA, 40 bp, Homo sapiens; identical to SEQ ID NO: 68925

SEQ ID NO: 70439 - DNA, 16 bp, Homo sapiens
cctgccgactacgcca

SEQ ID NO: 70440 - DNA, 19 bp, Homo sapiens
caatacttaatttctgcca

SEQ ID NO: 70441 - DNA, 32 bp, Homo sapiens; identical to SEQ ID NO: 67158

SEQ ID NO: 70442 - DNA, 29 bp, Homo sapiens
ggagatgaaaacctttttccaaggacacc

SEQ ID NO: 70443 - DNA, 31 bp, Homo sapiens; identical to SEQ ID NO: 66783

SEQ ID NO: 70444 - DNA, 17 bp, Homo sapiens
atcctgccgactacgcc

SEQ ID NO: 70445 - DNA, 19 bp, Homo sapiens
ccttccaagcagttgaccc

SEQ ID NO: 70446 - DNA, 35 bp, Homo sapiens; identical to SEQ ID NO: 66607

SEQ ID NO: 70447 - DNA, 32 bp, Homo sapiens; identical to SEQ ID NO: 68716

SEQ ID NO: 70448 - DNA, 25 bp, Homo sapiens
ggttcaattccccgacggggagcca

SEQ ID NO: 70449 - DNA, 20 bp, Homo sapiens
acgaccccttatttacccca

SEQ ID NO: 70450 - DNA, 23 bp, Homo sapiens
ggttaggcctctttttaccacca

SEQ ID NO: 70451 - DNA, 33 bp, Homo sapiens; identical to SEQ ID NO: 66694

SEQ ID NO: 70452 - DNA, 34 bp, Homo sapiens; identical to SEQ ID NO: 66655

SEQ ID NO: 70453 - DNA, 33 bp, Homo sapiens
ggttccatagtgtagtggttatcacatctgctt

SEQ ID NO: 70454 - DNA, 34 bp, Homo sapiens; identical to SEQ ID NO: 68650

SEQ ID NO: 70455 - DNA, 31 bp, Homo sapiens; identical to SEQ ID NO: 66722

SEQ ID NO: 70456 - DNA, 28 bp, Homo sapiens
gggagaccggggttcgattccccgacgg

SEQ ID NO: 70457 - DNA, 21 bp, Homo sapiens
caactccaaataaaagtacca

SEQ ID NO: 70458 - DNA, 40 bp, Homo sapiens; identical to SEQ ID NO: 66840

SEQ ID NO: 70459 - DNA, 30 bp, Homo sapiens; identical to SEQ ID NO: 66551

SEQ ID NO: 70460 - DNA, 29 bp, Homo sapiens
aaccggagatgaaaacctttttccaagga

SEQ ID NO: 70461 - DNA, 18 bp, Homo sapiens
acgcgaaaggtccccggt

SEQ ID NO: 70462 - DNA, 25 bp, Homo sapiens
gcgccgctggtgtagtggtatcatg

SEQ ID NO: 70463 - DNA, 41 bp, Homo sapiens; identical to SEQ ID NO: 67266

SEQ ID NO: 70464 - DNA, 18 bp, Homo sapiens
aatcatatttaccaacca

SEQ ID NO: 70465 - DNA, 38 bp, Homo sapiens; identical to SEQ ID NO: 66659

SEQ ID NO: 70466 - DNA, 18 bp, Homo sapiens
tagtggttagtatccccg

SEQ ID NO: 70467 - DNA, 34 bp, Homo sapiens; identical to SEQ ID NO: 66697

SEQ ID NO: 70468 - DNA, 37 bp, Homo sapiens; identical to SEQ ID NO: 66650

SEQ ID NO: 70469 - DNA, 41 bp, Homo sapiens; identical to SEQ ID NO: 66611

SEQ ID NO: 70470 - DNA, 25 bp, Homo sapiens
gtctaacaacatggctttctcacca

SEQ ID NO: 70471 - DNA, 23 bp, Homo sapiens
gcccggctagctcagtcggtaga

SEQ ID NO: 70472 - DNA, 42 bp, Homo sapiens; identical to SEQ ID NO: 67031

SEQ ID NO: 70473 - DNA, 36 bp, Homo sapiens
ggttagcactctggactttgaatccagcgatccgag

SEQ ID NO: 70474 - DNA, 24 bp, Homo sapiens
gcttacgaccccttatttacccca

SEQ ID NO: 70475 - DNA, 23 bp, Homo sapiens
tgcaactccaaataaaagtacca

SEQ ID NO: 70476 - DNA, 22 bp, Homo sapiens
tcacacgcgaaaggtccccggt

SEQ ID NO: 70477 - DNA, 24 bp, Homo sapiens
cctgtcacgcgggagaccggggtt

SEQ ID NO: 70478 - DNA, 32 bp, Homo sapiens
gtcacgcgggagaccggggttcgattccccga

SEQ ID NO: 70479 - DNA, 38 bp, Homo sapiens; identical to SEQ ID NO: 67783

SEQ ID NO: 70480 - DNA, 21 bp, Homo sapiens
gtcgtggttgtagtccgtgcg

SEQ ID NO: 70481 - DNA, 29 bp, Homo sapiens
agcatagctgccttccaagcagttgaccc

SEQ ID NO: 70482 - DNA, 42 bp, Homo sapiens; identical to SEQ ID NO: 67194

SEQ ID NO: 70483 - DNA, 20 bp, Homo sapiens
gtcacgcgggagaccggggt

SEQ ID NO: 70484 - DNA, 28 bp, Homo sapiens
gcgggagaccggggttcgattccccgac

SEQ ID NO: 70485 - DNA, 36 bp, Homo sapiens
gtcacgcgggagaccggggttcgattccccgacggg

SEQ ID NO: 70486 - DNA, 19 bp, Homo sapiens
aacttgaccgctctgacca

SEQ ID NO: 70487 - DNA, 29 bp, Homo sapiens
gagaaagctcacaagaactgctaactcat

SEQ ID NO: 70488 - DNA, 17 bp, Homo sapiens
cctcagagggggcacca

SEQ ID NO: 70489 - DNA, 30 bp, Homo sapiens; identical to SEQ ID NO: 66785

SEQ ID NO: 70490 - DNA, 27 bp, Homo sapiens
gaaaaagtcatggaggccatggggttg

SEQ ID NO: 70491 - DNA, 32 bp, Homo sapiens; identical to SEQ ID NO: 67946

SEQ ID NO: 70492 - DNA, 39 bp, Homo sapiens
tgtatgaggtcccgggttcgatccccggcatctccacca

SEQ ID NO: 70493 - DNA, 21 bp, Homo sapiens
gtagtccgtgcgagaatacca

SEQ ID NO: 70494 - DNA, 31 bp, Homo sapiens; identical to SEQ ID NO: 66740

SEQ ID NO: 70495 - DNA, 27 bp, Homo sapiens
gtcgtggttgtagtccgtgcgagaata

SEQ ID NO: 70496 - DNA, 37 bp, Homo sapiens; identical to SEQ ID NO: 68979

SEQ ID NO: 70497 - DNA, 40 bp, Homo sapiens; identical to SEQ ID NO: 67802

SEQ ID NO: 70498 - DNA, 43 bp, Homo sapiens; identical to SEQ ID NO: 68374

SEQ ID NO: 70499 - DNA, 18 bp, Homo sapiens
gtcctgccgcggtcgcca

SEQ ID NO: 70500 - DNA, 38 bp, Homo sapiens; identical to SEQ ID NO: 69583

SEQ ID NO: 70501 - DNA, 31 bp, Homo sapiens; identical to SEQ ID NO: 69625

SEQ ID NO: 70502 - DNA, 17 bp, Homo sapiens
gcccggctagctcagtc

SEQ ID NO: 70503 - DNA, 28 bp, Homo sapiens
ggctagctcagtcggtagagcatgagac

SEQ ID NO: 70504 - DNA, 37 bp, Homo sapiens; identical to SEQ ID NO: 67003

SEQ ID NO: 70505 - DNA, 45 bp, Homo sapiens
tacctcctcaaagcaatacactgaaaatgtttagacgggctcaca

SEQ ID NO: 70506 - DNA, 18 bp, Homo sapiens
atccccggcacctccacc

SEQ ID NO: 70507 - DNA, 37 bp, Homo sapiens; identical to SEQ ID NO: 66564

SEQ ID NO: 70508 - DNA, 32 bp, Homo sapiens; identical to SEQ ID NO: 66830

SEQ ID NO: 70509 - DNA, 29 bp, Homo sapiens
atttcaacttaacttgaccgctctgacca

SEQ ID NO: 70510 - DNA, 30 bp, Homo sapiens; identical to SEQ ID NO: 66555

SEQ ID NO: 70511 - DNA, 20 bp, Homo sapiens
acaacatggctttctcacca

SEQ ID NO: 70512 - DNA, 33 bp, Homo sapiens
gcgttggtggtatagtggtaagcatagctgcct

SEQ ID NO: 70513 - DNA, 21 bp, Homo sapiens
tgccacgcgggaggcccgggt

SEQ ID NO: 70514 - DNA, 34 bp, Homo sapiens; identical to SEQ ID NO: 66667

SEQ ID NO: 70515 - DNA, 33 bp, Homo sapiens; identical to SEQ ID NO: 66693

SEQ ID NO: 70516 - DNA, 23 bp, Homo sapiens
ctaacaacatggctttctcacca

SEQ ID NO: 70517 - DNA, 26 bp, Homo sapiens
gggagaccggggttcgattccccgac

SEQ ID NO: 70518 - DNA, 37 bp, Homo sapiens; identical to SEQ ID NO: 67045

SEQ ID NO: 70519 - DNA, 31 bp, Homo sapiens
ggttccatagtgtagcggttatcacgtctgc

SEQ ID NO: 70520 - DNA, 34 bp, Homo sapiens
cgcgggagaccggggttcaattccccgacgggga

SEQ ID NO: 70521 - DNA, 19 bp, Homo sapiens
gccccagtggcctaatgga

SEQ ID NO: 70522 - DNA, 37 bp, Homo sapiens; identical to SEQ ID NO: 66809

SEQ ID NO: 70523 - DNA, 18 bp, Homo sapiens
tacctcctcaaagcaata

SEQ ID NO: 70524 - DNA, 43 bp, Homo sapiens; identical to SEQ ID NO: 69605

SEQ ID NO: 70525 - DNA, 32 bp, Homo sapiens; identical to SEQ ID NO: 68011

SEQ ID NO: 70526 - DNA, 18 bp, Homo sapiens
cttccaagcagttgaccc

SEQ ID NO: 70527 - DNA, 28 bp, Homo sapiens
ggattcggcgctctcaccgccgcggccc

SEQ ID NO: 70528 - DNA, 18 bp, Homo sapiens
atcctgtcggctacgcca

SEQ ID NO: 70529 - DNA, 32 bp, Homo sapiens; identical to SEQ ID NO: 69699

SEQ ID NO: 70530 - DNA, 35 bp, Homo sapiens
gcctggatagctcagtcggtagagcatcagacttt

SEQ ID NO: 70531 - DNA, 36 bp, Homo sapiens; identical to SEQ ID NO: 68467

SEQ ID NO: 70532 - DNA, 22 bp, Homo sapiens
agaccggggttcaattccccga

SEQ ID NO: 70533 - DNA, 34 bp, Homo sapiens; identical to SEQ ID NO: 68500

SEQ ID NO: 70534 - DNA, 39 bp, Homo sapiens
accgccgcggcccgggttcgattcccggtcagggaacca

SEQ ID NO: 70535 - DNA, 36 bp, Homo sapiens; identical to SEQ ID NO: 66762

SEQ ID NO: 70536 - DNA, 29 bp, Homo sapiens
cattggtcgtggttgtagtccgtgcgaga

SEQ ID NO: 70537 - DNA, 17 bp, Homo sapiens
agtggttagtatccccg

SEQ ID NO: 70538 - DNA, 46 bp, Homo sapiens; identical to SEQ ID NO: 67119

SEQ ID NO: 70539 - DNA, 37 bp, Homo sapiens
agcccggatagctcagtcggtagagcatcagactttt

SEQ ID NO: 70540 - DNA, 18 bp, Homo sapiens
agtcggtagagcatcaga

SEQ ID NO: 70541 - DNA, 23 bp, Homo sapiens
tggtgagtatccccgcctgtcac

SEQ ID NO: 70542 - DNA, 37 bp, Homo sapiens; identical to SEQ ID NO: 66549

SEQ ID NO: 70543 - DNA, 38 bp, Homo sapiens; identical to SEQ ID NO: 67816

SEQ ID NO: 70544 - DNA, 30 bp, Homo sapiens
gcgttggtggtatagtggtaagcatagctg

SEQ ID NO: 70545 - DNA, 32 bp, Homo sapiens
acgcgggagaccggggttcaattccccgacgg

SEQ ID NO: 70546 - DNA, 46 bp, Homo sapiens; identical to SEQ ID NO: 68789

SEQ ID NO: 70547 - DNA, 19 bp, Homo sapiens
tagtggttagtatccccgc

SEQ ID NO: 70548 - DNA, 33 bp, Homo sapiens; identical to SEQ ID NO: 66774

SEQ ID NO: 70549 - DNA, 37 bp, Homo sapiens; identical to SEQ ID NO: 66831

SEQ ID NO: 70550 - DNA, 35 bp, Homo sapiens
gtcacgcgggagaccggggttcaattccccgacgg

SEQ ID NO: 70551 - DNA, 19 bp, Homo sapiens
gtgagtatccccgcctgtc

SEQ ID NO: 70552 - DNA, 34 bp, Homo sapiens; identical to SEQ ID NO: 66735

SEQ ID NO: 70553 - DNA, 19 bp, Homo sapiens
caacatggctttctcacca

SEQ ID NO: 70554 - DNA, 39 bp, Homo sapiens; identical to SEQ ID NO: 67972

SEQ ID NO: 70555 - DNA, 32 bp, Homo sapiens
aggcggcccgggttcgactcccggtgtgggaa

SEQ ID NO: 70556 - DNA, 35 bp, Homo sapiens; identical to SEQ ID NO: 66747

SEQ ID NO: 70557 - DNA, 38 bp, Homo sapiens; identical to SEQ ID NO: 67159

SEQ ID NO: 70558 - DNA, 31 bp, Homo sapiens; identical to SEQ ID NO: 66690

SEQ ID NO: 70559 - DNA, 24 bp, Homo sapiens
gagaccggggttcaattccccgac

SEQ ID NO: 70560 - DNA, 20 bp, Homo sapiens
ctaagccagggattgtgggt

SEQ ID NO: 70561 - DNA, 25 bp, Homo sapiens
agcttaaacccccttatttctacca

SEQ ID NO: 70562 - DNA, 19 bp, Homo sapiens
tcccacatggtctagcggt

SEQ ID NO: 70563 - DNA, 21 bp, Homo sapiens
tgcaatacttaatttctgcca

SEQ ID NO: 70564 - DNA, 29 bp, Homo sapiens
cagaggcttacgaccccttatttacccca

SEQ ID NO: 70565 - DNA, 24 bp, Homo sapiens
gcctgtcacgcgggagaccggggt

SEQ ID NO: 70566 - DNA, 38 bp, Homo sapiens
atccagcgatccgagttcaaatctcggtggaacctcca

SEQ ID NO: 70567 - DNA, 25 bp, Homo sapiens
aggctaaatcctatatatcttacca

SEQ ID NO: 70568 - DNA, 43 bp, Homo sapiens
tgccacgcgggaggcccgggttcgattcccggccaatgcacca

SEQ ID NO: 70569 - DNA, 36 bp, Homo sapiens
gtttatgtagcttacctcctcaaagcaatacactga

SEQ ID NO: 70570 - DNA, 21 bp, Homo sapiens
cgattcccggcccatgcacca

SEQ ID NO: 70571 - DNA, 29 bp, Homo sapiens
ggctagctcagtcggtagagcatgggact

SEQ ID NO: 70572 - DNA, 35 bp, Homo sapiens
tcccatatggtctagcggttaggattcctggtttt

SEQ ID NO: 70573 - DNA, 22 bp, Homo sapiens
tcgaatcctgccgactacgcca

SEQ ID NO: 70574 - DNA, 35 bp, Homo sapiens; identical to SEQ ID NO: 68565

SEQ ID NO: 70575 - DNA, 41 bp, Homo sapiens; identical to SEQ ID NO: 68897

SEQ ID NO: 70576 - DNA, 32 bp, Homo sapiens; identical to SEQ ID NO: 68980

SEQ ID NO: 70577 - DNA, 39 bp, Homo sapiens; identical to SEQ ID NO: 70419

SEQ ID NO: 70578 - DNA, 38 bp, Homo sapiens; identical to SEQ ID NO: 68726

SEQ ID NO: 70579 - DNA, 38 bp, Homo sapiens; identical to SEQ ID NO: 68732

SEQ ID NO: 70580 - DNA, 19 bp, Homo sapiens
acaacatggctttctcacc

SEQ ID NO: 70581 - DNA, 18 bp, Homo sapiens
acacctctttacagtgac

SEQ ID NO: 70582 - DNA, 44 bp, Homo sapiens; identical to SEQ ID NO: 70409

SEQ ID NO: 70583 - DNA, 39 bp, Homo sapiens; identical to SEQ ID NO: 68620

SEQ ID NO: 70584 - DNA, 32 bp, Homo sapiens; identical to SEQ ID NO: 70545

SEQ ID NO: 70585 - DNA, 34 bp, Homo sapiens; identical to SEQ ID NO: 69004

SEQ ID NO: 70586 - DNA, 46 bp, Homo sapiens; identical to SEQ ID NO: 68832

SEQ ID NO: 70587 - DNA, 40 bp, Homo sapiens; identical to SEQ ID NO: 68918

SEQ ID NO: 70588 - DNA, 28 bp, Homo sapiens
agaatcttagctttgggtgctaatggtg

SEQ ID NO: 70589 - DNA, 34 bp, Homo sapiens; identical to SEQ ID NO: 68910

SEQ ID NO: 70590 - DNA, 38 bp, Homo sapiens; identical to SEQ ID NO: 68986

SEQ ID NO: 70591 - DNA, 22 bp, Homo sapiens
agaccggggttcaattccccga

SEQ ID NO: 70592 - DNA, 27 bp, Homo sapiens
agcattaaccttttaagttaaagatta

SEQ ID NO: 70593 - DNA, 37 bp, Homo sapiens; identical to SEQ ID NO: 70539

SEQ ID NO: 70594 - DNA, 24 bp, Homo sapiens
agcccggtaatcgcataaaactta

SEQ ID NO: 70595 - DNA, 45 bp, Homo sapiens; identical to SEQ ID NO: 68866

SEQ ID NO: 70596 - DNA, 31 bp, Homo sapiens; identical to SEQ ID NO: 68995

SEQ ID NO: 70597 - DNA, 41 bp, Homo sapiens; identical to SEQ ID NO: 68803

SEQ ID NO: 70598 - DNA, 33 bp, Homo sapiens; identical to SEQ ID NO: 68675

SEQ ID NO: 70599 - DNA, 32 bp, Homo sapiens; identical to SEQ ID NO: 70555

SEQ ID NO: 70600 - DNA, 43 bp, Homo sapiens; identical to SEQ ID NO: 68776

SEQ ID NO: 70601 - DNA, 41 bp, Homo sapiens; identical to SEQ ID NO: 68846

SEQ ID NO: 70602 - DNA, 38 bp, Homo sapiens; identical to SEQ ID NO: 70566

SEQ ID NO: 70603 - DNA, 33 bp, Homo sapiens; identical to SEQ ID NO: 68816

SEQ ID NO: 70604 - DNA, 36 bp, Homo sapiens; identical to SEQ ID NO: 70427

SEQ ID NO: 70605 - DNA, 25 bp, Homo sapiens
cagagaatagtttaaattagaatct

SEQ ID NO: 70606 - DNA, 34 bp, Homo sapiens; identical to SEQ ID NO: 68924

SEQ ID NO: 70607 - DNA, 27 bp, Homo sapiens
ccggagatgaaaacctttttccaagga

SEQ ID NO: 70608 - DNA, 28 bp, Homo sapiens
cgaaaatgttggttatacccttcccgta

SEQ ID NO: 70609 - DNA, 40 bp, Homo sapiens; identical to SEQ ID NO: 70244

SEQ ID NO: 70610 - DNA, 34 bp, Homo sapiens; identical to SEQ ID NO: 70520

SEQ ID NO: 70611 - DNA, 29 bp, Homo sapiens
cgcgggagaccggggttcgattccccgac

SEQ ID NO: 70612 - DNA, 37 bp, Homo sapiens; identical to SEQ ID NO: 68689

SEQ ID NO: 70613 - DNA, 24 bp, Homo sapiens
gagaccggggttcaattccccgac

SEQ ID NO: 70614 - DNA, 38 bp, Homo sapiens; identical to SEQ ID NO: 68809

SEQ ID NO: 70615 - DNA, 44 bp, Homo sapiens; identical to SEQ ID NO: 68982

SEQ ID NO: 70616 - DNA, 38 bp, Homo sapiens; identical to SEQ ID NO: 70251

SEQ ID NO: 70617 - DNA, 26 bp, Homo sapiens
gcattaaccttttaagttaaagatta

SEQ ID NO: 70618 - DNA, 35 bp, Homo sapiens; identical to SEQ ID NO: 68985

SEQ ID NO: 70619 - DNA, 31 bp, Homo sapiens; identical to SEQ ID NO: 68949

SEQ ID NO: 70620 - DNA, 36 bp, Homo sapiens; identical to SEQ ID NO: 68736

SEQ ID NO: 70621 - DNA, 35 bp, Homo sapiens; identical to SEQ ID NO: 70530

SEQ ID NO: 70622 - DNA, 39 bp, Homo sapiens; identical to SEQ ID NO: 70302

SEQ ID NO: 70623 - DNA, 28 bp, Homo sapiens
gcgggagaccggggttcgattccccgac

SEQ ID NO: 70624 - DNA, 33 bp, Homo sapiens; identical to SEQ ID NO: 70512

SEQ ID NO: 70625 - DNA, 46 bp, Homo sapiens; identical to SEQ ID NO: 68789

SEQ ID NO: 70626 - DNA, 18 bp, Homo sapiens
ggagcttaaaccccctta

SEQ ID NO: 70627 - DNA, 42 bp, Homo sapiens; identical to SEQ ID NO: 68915

SEQ ID NO: 70628 - DNA, 26 bp, Homo sapiens
gggagaccggggttcgattccccgac

SEQ ID NO: 70629 - DNA, 28 bp, Homo sapiens
gggagaccggggttcgattccccgacgg

SEQ ID NO: 70630 - DNA, 33 bp, Homo sapiens; identical to SEQ ID NO: 68786

SEQ ID NO: 70631 - DNA, 25 bp, Homo sapiens
ggtgcaactccaaataaaagtacca

SEQ ID NO: 70632 - DNA, 25 bp, Homo sapiens
ggttcaattccccgacggggagcca

SEQ ID NO: 70633 - DNA, 31 bp, Homo sapiens; identical to SEQ ID NO: 70519

SEQ ID NO: 70634 - DNA, 32 bp, Homo sapiens; identical to SEQ ID NO: 70432

SEQ ID NO: 70635 - DNA, 33 bp, Homo sapiens; identical to SEQ ID NO: 70453

SEQ ID NO: 70636 - DNA, 34 bp, Homo sapiens; identical to SEQ ID NO: 68987

SEQ ID NO: 70637 - DNA, 35 bp, Homo sapiens; identical to SEQ ID NO: 70550

SEQ ID NO: 70638 - DNA, 32 bp, Homo sapiens; identical to SEQ ID NO: 70478

SEQ ID NO: 70639 - DNA, 33 bp, Homo sapiens; identical to SEQ ID NO: 69960

SEQ ID NO: 70640 - DNA, 36 bp, Homo sapiens; identical to SEQ ID NO: 70485

SEQ ID NO: 70641 - DNA, 42 bp, Homo sapiens; identical to SEQ ID NO: 68810

SEQ ID NO: 70642 - DNA, 35 bp, Homo sapiens; identical to SEQ ID NO: 68936

SEQ ID NO: 70643 - DNA, 36 bp, Homo sapiens; identical to SEQ ID NO: 70569

SEQ ID NO: 70644 - DNA, 40 bp, Homo sapiens; identical to SEQ ID NO: 68905

SEQ ID NO: 70645 - DNA, 22 bp, Homo sapiens
tacctcctcaaagcaatacact

SEQ ID NO: 70646 - DNA, 45 bp, Homo sapiens; identical to SEQ ID NO: 70505

SEQ ID NO: 70647 - DNA, 37 bp, Homo sapiens; identical to SEQ ID NO: 68695

SEQ ID NO: 70648 - DNA, 29 bp, Homo sapiens
tcagggatgggttcgattctcatagtcct

SEQ ID NO: 70649 - DNA, 30 bp, Homo sapiens; identical to SEQ ID NO: 68852

SEQ ID NO: 70650 - DNA, 22 bp, Homo sapiens
tcgattcccggtcagggaacca

SEQ ID NO: 70651 - DNA, 34 bp, Homo sapiens; identical to SEQ ID NO: 68940

SEQ ID NO: 70652 - DNA, 44 bp, Homo sapiens; identical to SEQ ID NO: 68808

SEQ ID NO: 70653 - DNA, 21 bp, Homo sapiens
tgccacgcgggaggcccgggt

SEQ ID NO: 70654 - DNA, 43 bp, Homo sapiens; identical to SEQ ID NO: 70568

SEQ ID NO: 70655 - DNA, 32 bp, Homo sapiens; identical to SEQ ID NO: 68725

SEQ ID NO: 70656 - DNA, 26 bp, Homo sapiens
tggtgcaactccaaataaaagtacca

SEQ ID NO: 70657 - DNA, 39 bp, Homo sapiens; identical to SEQ ID NO: 70492

SEQ ID NO: 70658 - DNA, 36 bp, Homo sapiens; identical to SEQ ID NO: 70360

SEQ ID NO: 70659 - DNA, 21 bp, Homo sapiens
ttaggcctctttttaccacca

SEQ ID NO: 70660 - DNA, 42 bp, Homo sapiens; identical to SEQ ID NO: 68703

SEQ ID NO: 70661 - DNA, 28 bp, Homo sapiens
aagcaatacactgaaaatgtttagacgg

SEQ ID NO: 70662 - DNA, 33 bp, Homo sapiens; identical to SEQ ID NO: 68044

SEQ ID NO: 70663 - DNA, 42 bp, Homo sapiens; identical to SEQ ID NO: 69706

SEQ ID NO: 70664 - DNA, 32 bp, Homo sapiens; identical to SEQ ID NO: 67924

SEQ ID NO: 70665 - DNA, 33 bp, Homo sapiens; identical to SEQ ID NO: 67992

SEQ ID NO: 70666 - DNA, 40 bp, Homo sapiens; identical to SEQ ID NO: 69824

SEQ ID NO: 70667 - DNA, 36 bp, Homo sapiens; identical to SEQ ID NO: 69741

SEQ ID NO: 70668 - DNA, 34 bp, Homo sapiens; identical to SEQ ID NO: 67917

SEQ ID NO: 70669 - DNA, 34 bp, Homo sapiens; identical to SEQ ID NO: 69689

SEQ ID NO: 70670 - DNA, 44 bp, Homo sapiens; identical to SEQ ID NO: 69660

SEQ ID NO: 70671 - DNA, 17 bp, Homo sapiens
agctttggggggttcga

SEQ ID NO: 70672 - DNA, 30 bp, Homo sapiens; identical to SEQ ID NO: 67932

SEQ ID NO: 70673 - DNA, 32 bp, Homo sapiens; identical to SEQ ID NO: 67997

SEQ ID NO: 70674 - DNA, 45 bp, Homo sapiens; identical to SEQ ID NO: 69695

SEQ ID NO: 70675 - DNA, 40 bp, Homo sapiens; identical to SEQ ID NO: 69750

SEQ ID NO: 70676 - DNA, 46 bp, Homo sapiens; identical to SEQ ID NO: 69770

SEQ ID NO: 70677 - DNA, 19 bp, Homo sapiens
cacgcgaaaggtccccggt

SEQ ID NO: 70678 - DNA, 18 bp, Homo sapiens
cagagcccggtaatcgca

SEQ ID NO: 70679 - DNA, 31 bp, Homo sapiens; identical to SEQ ID NO: 68010

SEQ ID NO: 70680 - DNA, 32 bp, Homo sapiens; identical to SEQ ID NO: 69655

SEQ ID NO: 70681 - DNA, 32 bp, Homo sapiens; identical to SEQ ID NO: 69642

SEQ ID NO: 70682 - DNA, 32 bp, Homo sapiens; identical to SEQ ID NO: 67974

SEQ ID NO: 70683 - DNA, 45 bp, Homo sapiens; identical to SEQ ID NO: 69640

SEQ ID NO: 70684 - DNA, 17 bp, Homo sapiens
cgcgaaaggtccccggt

SEQ ID NO: 70685 - DNA, 36 bp, Homo sapiens; identical to SEQ ID NO: 69796

SEQ ID NO: 70686 - DNA, 16 bp, Homo sapiens
cggttatcacgtctgc

SEQ ID NO: 70687 - DNA, 31 bp, Homo sapiens; identical to SEQ ID NO: 69738

SEQ ID NO: 70688 - DNA, 39 bp, Homo sapiens; identical to SEQ ID NO: 67937

SEQ ID NO: 70689 - DNA, 35 bp, Homo sapiens; identical to SEQ ID NO: 68040

SEQ ID NO: 70690 - DNA, 38 bp, Homo sapiens; identical to SEQ ID NO: 69715

SEQ ID NO: 70691 - DNA, 39 bp, Homo sapiens; identical to SEQ ID NO: 69745

SEQ ID NO: 70692 - DNA, 38 bp, Homo sapiens; identical to SEQ ID NO: 69705

SEQ ID NO: 70693 - DNA, 24 bp, Homo sapiens
gaaaacctttttccaaggacacca

SEQ ID NO: 70694 - DNA, 22 bp, Homo sapiens
gacaacagaggcttacgacccc

SEQ ID NO: 70695 - DNA, 26 bp, Homo sapiens
gaccaagagccttcaaagccctcagt

SEQ ID NO: 70696 - DNA, 32 bp, Homo sapiens; identical to SEQ ID NO: 69635

SEQ ID NO: 70697 - DNA, 31 bp, Homo sapiens; identical to SEQ ID NO: 67681

SEQ ID NO: 70698 - DNA, 28 bp, Homo sapiens
gagatgaaaacctttttccaaggacacc

SEQ ID NO: 70699 - DNA, 23 bp, Homo sapiens
gagcccggtaatcgcataaaact

SEQ ID NO: 70700 - DNA, 43 bp, Homo sapiens; identical to SEQ ID NO: 69593

SEQ ID NO: 70701 - DNA, 45 bp, Homo sapiens; identical to SEQ ID NO: 69685

SEQ ID NO: 70702 - DNA, 16 bp, Homo sapiens
gaggcttacgacccct

SEQ ID NO: 70703 - DNA, 38 bp, Homo sapiens; identical to SEQ ID NO: 69712

SEQ ID NO: 70704 - DNA, 42 bp, Homo sapiens; identical to SEQ ID NO: 69807

SEQ ID NO: 70705 - DNA, 37 bp, Homo sapiens; identical to SEQ ID NO: 69584

SEQ ID NO: 70706 - DNA, 40 bp, Homo sapiens; identical to SEQ ID NO: 69804

SEQ ID NO: 70707 - DNA, 37 bp, Homo sapiens; identical to SEQ ID NO: 69722

SEQ ID NO: 70708 - DNA, 39 bp, Homo sapiens; identical to SEQ ID NO: 69823

SEQ ID NO: 70709 - DNA, 17 bp, Homo sapiens
gccctcagtaagttgca

SEQ ID NO: 70710 - DNA, 42 bp, Homo sapiens; identical to SEQ ID NO: 69564

SEQ ID NO: 70711 - DNA, 31 bp, Homo sapiens; identical to SEQ ID NO: 69764

SEQ ID NO: 70712 - DNA, 44 bp, Homo sapiens; identical to SEQ ID NO: 69610

SEQ ID NO: 70713 - DNA, 16 bp, Homo sapiens
ggagcttaaaccccct

SEQ ID NO: 70714 - DNA, 40 bp, Homo sapiens; identical to SEQ ID NO: 69688

SEQ ID NO: 70715 - DNA, 39 bp, Homo sapiens; identical to SEQ ID NO: 69827

SEQ ID NO: 70716 - DNA, 25 bp, Homo sapiens
ggttcgattctcatagtcctagcca

SEQ ID NO: 70717 - DNA, 31 bp, Homo sapiens; identical to SEQ ID NO: 68043

SEQ ID NO: 70718 - DNA, 31 bp, Homo sapiens; identical to SEQ ID NO: 69801

SEQ ID NO: 70719 - DNA, 39 bp, Homo sapiens; identical to SEQ ID NO: 69773

SEQ ID NO: 70720 - DNA, 23 bp, Homo sapiens
gtttccgtagtgtagtggttatt

SEQ ID NO: 70721 - DNA, 45 bp, Homo sapiens; identical to SEQ ID NO: 69690

SEQ ID NO: 70722 - DNA, 43 bp, Homo sapiens; identical to SEQ ID NO: 69639

SEQ ID NO: 70723 - DNA, 30 bp, Homo sapiens; identical to SEQ ID NO: 69774

SEQ ID NO: 70724 - DNA, 38 bp, Homo sapiens; identical to SEQ ID NO: 68033

SEQ ID NO: 70725 - DNA, 35 bp, Homo sapiens; identical to SEQ ID NO: 69789

SEQ ID NO: 70726 - DNA, 34 bp, Homo sapiens; identical to SEQ ID NO: 69817

SEQ ID NO: 70727 - DNA, 37 bp, Homo sapiens; identical to SEQ ID NO: 69788

SEQ ID NO: 70728 - DNA, 17 bp, Homo sapiens
tcccacccggggtacca

SEQ ID NO: 70729 - DNA, 40 bp, Homo sapiens; identical to SEQ ID NO: 69828

SEQ ID NO: 70730 - DNA, 44 bp, Homo sapiens; identical to SEQ ID NO: 69667

SEQ ID NO: 70731 - DNA, 44 bp, Homo sapiens; identical to SEQ ID NO: 69627

SEQ ID NO: 70732 - DNA, 31 bp, Homo sapiens; identical to SEQ ID NO: 69649

SEQ ID NO: 70733 - DNA, 41 bp, Homo sapiens; identical to SEQ ID NO: 69829

SEQ ID NO: 70734 - DNA, 36 bp, Homo sapiens; identical to SEQ ID NO: 69810

SEQ ID NO: 70735 - DNA, 27 bp, Homo sapiens
tttgacaacattcaaaaaagagtacca

SEQ ID NO: 70736 - DNA, 20 bp, Homo sapiens
aaacccccttatttctacca

SEQ ID NO: 70737 - DNA, 28 bp, Homo sapiens
aaagcaatacactgaaaatgtttagacg

SEQ ID NO: 70738 - DNA, 44 bp, Homo sapiens; identical to SEQ ID NO: 69797

SEQ ID NO: 70739 - DNA, 27 bp, Homo sapiens
aaccggagatgaaaacctttttccaag

SEQ ID NO: 70740 - DNA, 20 bp, Homo sapiens
aactccaaataaaagtacca

SEQ ID NO: 70741 - DNA, 40 bp, Homo sapiens; identical to SEQ ID NO: 68857

SEQ ID NO: 70742 - DNA, 36 bp, Homo sapiens; identical to SEQ ID NO: 68492

SEQ ID NO: 70743 - DNA, 38 bp, Homo sapiens; identical to SEQ ID NO: 67816

SEQ ID NO: 70744 - DNA, 45 bp, Homo sapiens; identical to SEQ ID NO: 68885

SEQ ID NO: 70745 - DNA, 45 bp, Homo sapiens; identical to SEQ ID NO: 69737

SEQ ID NO: 70746 - DNA, 28 bp, Homo sapiens
acaggggttaggcctctttttaccacca

SEQ ID NO: 70747 - DNA, 34 bp, Homo sapiens; identical to SEQ ID NO: 67808

SEQ ID NO: 70748 - DNA, 34 bp, Homo sapiens; identical to SEQ ID NO: 67941

SEQ ID NO: 70749 - DNA, 37 bp, Homo sapiens; identical to SEQ ID NO: 67905

SEQ ID NO: 70750 - DNA, 17 bp, Homo sapiens
accggagatgaaaacct

SEQ ID NO: 70751 - DNA, 26 bp, Homo sapiens
accggagatgaaaacctttttccaag

SEQ ID NO: 70752 - DNA, 29 bp, Homo sapiens
accggagatgaaaacctttttccaaggac

SEQ ID NO: 70753 - DNA, 31 bp, Homo sapiens; identical to SEQ ID NO: 68836

SEQ ID NO: 70754 - DNA, 40 bp, Homo sapiens; identical to SEQ ID NO: 68925

SEQ ID NO: 70755 - DNA, 43 bp, Homo sapiens; identical to SEQ ID NO: 69611

SEQ ID NO: 70756 - DNA, 45 bp, Homo sapiens; identical to SEQ ID NO: 68799

SEQ ID NO: 70757 - DNA, 39 bp, Homo sapiens; identical to SEQ ID NO: 68554

SEQ ID NO: 70758 - DNA, 29 bp, Homo sapiens
agaatcttagctttgggtgctaatggtgg

SEQ ID NO: 70759 - DNA, 35 bp, Homo sapiens; identical to SEQ ID NO: 67952

SEQ ID NO: 70760 - DNA, 26 bp, Homo sapiens
agcaatacactgaaaatgtttagacg

SEQ ID NO: 70761 - DNA, 36 bp, Homo sapiens; identical to SEQ ID NO: 68467

SEQ ID NO: 70762 - DNA, 18 bp, Homo sapiens
agcccggtaatcgcataa

SEQ ID NO: 70763 - DNA, 40 bp, Homo sapiens; identical to SEQ ID NO: 68955

SEQ ID NO: 70764 - DNA, 18 bp, Homo sapiens
agccctcagtaagttgca

SEQ ID NO: 70765 - DNA, 42 bp, Homo sapiens; identical to SEQ ID NO: 68848

SEQ ID NO: 70766 - DNA, 28 bp, Homo sapiens
aggagcttaaacccccttatttctacca

SEQ ID NO: 70767 - DNA, 25 bp, Homo sapiens
aggctaaatcctatatatcttacca

SEQ ID NO: 70768 - DNA, 34 bp, Homo sapiens; identical to SEQ ID NO: 68833

SEQ ID NO: 70769 - DNA, 35 bp, Homo sapiens; identical to SEQ ID NO: 68532

SEQ ID NO: 70770 - DNA, 29 bp, Homo sapiens
atcgcataaaacttaaaactttacagtca

SEQ ID NO: 70771 - DNA, 30 bp, Homo sapiens; identical to SEQ ID NO: 68895

SEQ ID NO: 70772 - DNA, 37 bp, Homo sapiens; identical to SEQ ID NO: 67782

SEQ ID NO: 70773 - DNA, 37 bp, Homo sapiens; identical to SEQ ID NO: 68863

SEQ ID NO: 70774 - DNA, 39 bp, Homo sapiens; identical to SEQ ID NO: 68917

SEQ ID NO: 70775 - DNA, 45 bp, Homo sapiens; identical to SEQ ID NO: 68888

SEQ ID NO: 70776 - DNA, 40 bp, Homo sapiens; identical to SEQ ID NO: 67802

SEQ ID NO: 70777 - DNA, 39 bp, Homo sapiens; identical to SEQ ID NO: 67903

SEQ ID NO: 70778 - DNA, 29 bp, Homo sapiens
cagaggcttacgaccccttatttacccca

SEQ ID NO: 70779 - DNA, 27 bp, Homo sapiens
cagagtggggttttgcagtccttacca

SEQ ID NO: 70780 - DNA, 28 bp, Homo sapiens
cagggatgggttcgattctcatagtcct

SEQ ID NO: 70781 - DNA, 33 bp, Homo sapiens; identical to SEQ ID NO: 68741

SEQ ID NO: 70782 - DNA, 33 bp, Homo sapiens; identical to SEQ ID NO: 67831

SEQ ID NO: 70783 - DNA, 31 bp, Homo sapiens; identical to SEQ ID NO: 68770

SEQ ID NO: 70784 - DNA, 34 bp, Homo sapiens; identical to SEQ ID NO: 67909

SEQ ID NO: 70785 - DNA, 43 bp, Homo sapiens; identical to SEQ ID NO: 68904

SEQ ID NO: 70786 - DNA, 31 bp, Homo sapiens; identical to SEQ ID NO: 67651

SEQ ID NO: 70787 - DNA, 31 bp, Homo sapiens; identical to SEQ ID NO: 68058

SEQ ID NO: 70788 - DNA, 33 bp, Homo sapiens; identical to SEQ ID NO: 67986

SEQ ID NO: 70789 - DNA, 31 bp, Homo sapiens; identical to SEQ ID NO: 69625

SEQ ID NO: 70790 - DNA, 34 bp, Homo sapiens; identical to SEQ ID NO: 68929

SEQ ID NO: 70791 - DNA, 30 bp, Homo sapiens; identical to SEQ ID NO: 68746

SEQ ID NO: 70792 - DNA, 26 bp, Homo sapiens
cggagatgaaaacctttttccaagga

SEQ ID NO: 70793 - DNA, 29 bp, Homo sapiens
cgggagaccggggttcgattccccgacgg

SEQ ID NO: 70794 - DNA, 34 bp, Homo sapiens; identical to SEQ ID NO: 67922

SEQ ID NO: 70795 - DNA, 34 bp, Homo sapiens; identical to SEQ ID NO: 68688

SEQ ID NO: 70796 - DNA, 42 bp, Homo sapiens; identical to SEQ ID NO: 68668

SEQ ID NO: 70797 - DNA, 38 bp, Homo sapiens; identical to SEQ ID NO: 68759

SEQ ID NO: 70798 - DNA, 30 bp, Homo sapiens; identical to SEQ ID NO: 68899

SEQ ID NO: 70799 - DNA, 43 bp, Homo sapiens; identical to SEQ ID NO: 67993

SEQ ID NO: 70800 - DNA, 39 bp, Homo sapiens; identical to SEQ ID NO: 68790

SEQ ID NO: 70801 - DNA, 46 bp, Homo sapiens; identical to SEQ ID NO: 68485

SEQ ID NO: 70802 - DNA, 30 bp, Homo sapiens; identical to SEQ ID NO: 67964

SEQ ID NO: 70803 - DNA, 39 bp, Homo sapiens; identical to SEQ ID NO: 69008

SEQ ID NO: 70804 - DNA, 28 bp, Homo sapiens
gaatcttagctttgggtgctaatggtgg

SEQ ID NO: 70805 - DNA, 33 bp, Homo sapiens; identical to SEQ ID NO: 68583

SEQ ID NO: 70806 - DNA, 21 bp, Homo sapiens
gacaacagaggcttacgaccc

SEQ ID NO: 70807 - DNA, 31 bp, Homo sapiens; identical to SEQ ID NO: 67690

SEQ ID NO: 70808 - DNA, 27 bp, Homo sapiens
gaccaagagccttcaaagccctcagta

SEQ ID NO: 70809 - DNA, 34 bp, Homo sapiens; identical to SEQ ID NO: 67718

SEQ ID NO: 70810 - DNA, 38 bp, Homo sapiens; identical to SEQ ID NO: 68663

SEQ ID NO: 70811 - DNA, 43 bp, Homo sapiens; identical to SEQ ID NO: 68873

SEQ ID NO: 70812 - DNA, 33 bp, Homo sapiens; identical to SEQ ID NO: 68994

SEQ ID NO: 70813 - DNA, 35 bp, Homo sapiens; identical to SEQ ID NO: 68027

SEQ ID NO: 70814 - DNA, 38 bp, Homo sapiens; identical to SEQ ID NO: 67783

SEQ ID NO: 70815 - DNA, 42 bp, Homo sapiens; identical to SEQ ID NO: 68616

SEQ ID NO: 70816 - DNA, 25 bp, Homo sapiens
gaggcttacgaccccttatttaccc

SEQ ID NO: 70817 - DNA, 43 bp, Homo sapiens; identical to SEQ ID NO: 68374

SEQ ID NO: 70818 - DNA, 41 bp, Homo sapiens; identical to SEQ ID NO: 68920

SEQ ID NO: 70819 - DNA, 38 bp, Homo sapiens; identical to SEQ ID NO: 69790

SEQ ID NO: 70820 - DNA, 42 bp, Homo sapiens; identical to SEQ ID NO: 69002

SEQ ID NO: 70821 - DNA, 38 bp, Homo sapiens; identical to SEQ ID NO: 69583

SEQ ID NO: 70822 - DNA, 34 bp, Homo sapiens; identical to SEQ ID NO: 69656

SEQ ID NO: 70823 - DNA, 31 bp, Homo sapiens; identical to SEQ ID NO: 69514

SEQ ID NO: 70824 - DNA, 29 bp, Homo sapiens
gcgggagaccggggttcgattccccgacg

SEQ ID NO: 70825 - DNA, 36 bp, Homo sapiens; identical to SEQ ID NO: 69784

SEQ ID NO: 70826 - DNA, 46 bp, Homo sapiens; identical to SEQ ID NO: 68674

SEQ ID NO: 70827 - DNA, 34 bp, Homo sapiens; identical to SEQ ID NO: 68650

SEQ ID NO: 70828 - DNA, 34 bp, Homo sapiens; identical to SEQ ID NO: 68860

SEQ ID NO: 70829 - DNA, 25 bp, Homo sapiens
ggagatgaaaacctttttccaagga

SEQ ID NO: 70830 - DNA, 39 bp, Homo sapiens; identical to SEQ ID NO: 67999

SEQ ID NO: 70831 - DNA, 41 bp, Homo sapiens; identical to SEQ ID NO: 68893

SEQ ID NO: 70832 - DNA, 46 bp, Homo sapiens; identical to SEQ ID NO: 68629

SEQ ID NO: 70833 - DNA, 33 bp, Homo sapiens; identical to SEQ ID NO: 68745

SEQ ID NO: 70834 - DNA, 35 bp, Homo sapiens; identical to SEQ ID NO: 68971

SEQ ID NO: 70835 - DNA, 34 bp, Homo sapiens; identical to SEQ ID NO: 68771

SEQ ID NO: 70836 - DNA, 43 bp, Homo sapiens; identical to SEQ ID NO: 68446

SEQ ID NO: 70837 - DNA, 34 bp, Homo sapiens; identical to SEQ ID NO: 68779

SEQ ID NO: 70838 - DNA, 38 bp, Homo sapiens; identical to SEQ ID NO: 67895

SEQ ID NO: 70839 - DNA, 25 bp, Homo sapiens
tccaatggggtttccccgcacaggt

SEQ ID NO: 70840 - DNA, 41 bp, Homo sapiens; identical to SEQ ID NO: 68462

SEQ ID NO: 70841 - DNA, 34 bp, Homo sapiens; identical to SEQ ID NO: 69618

SEQ ID NO: 70842 - DNA, 35 bp, Homo sapiens; identical to SEQ ID NO: 68991

SEQ ID NO: 70843 - DNA, 33 bp, Homo sapiens; identical to SEQ ID NO: 67849

SEQ ID NO: 70844 - DNA, 36 bp, Homo sapiens; identical to SEQ ID NO: 68939

SEQ ID NO: 70845 - DNA, 39 bp, Homo sapiens; identical to SEQ ID NO: 69662

SEQ ID NO: 70846 - DNA, 43 bp, Homo sapiens; identical to SEQ ID NO: 69605

SEQ ID NO: 70847 - DNA, 43 bp, Homo sapiens; identical to SEQ ID NO: 69670

SEQ ID NO: 70848 - DNA, 43 bp, Homo sapiens; identical to SEQ ID NO: 68517

SEQ ID NO: 70849 - DNA, 43 bp, Homo sapiens; identical to SEQ ID NO: 68429

SEQ ID NO: 70850 - DNA, 44 bp, Homo sapiens; identical to SEQ ID NO: 69007

SEQ ID NO: 70851 - DNA, 44 bp, Homo sapiens; identical to SEQ ID NO: 69359

SEQ ID NO: 70852 - DNA, 38 bp, Homo sapiens; identical to SEQ ID NO: 57060

SEQ ID NO: 70853 - DNA, 21 bp, Homo sapiens
aaaagctcgtagttggatctt

SEQ ID NO: 70854 - DNA, 27 bp, Homo sapiens
aaacatataactgaactcctcacaccc

SEQ ID NO: 70855 - DNA, 19 bp, Homo sapiens
aaacgagaactttgaaggc

SEQ ID NO: 70856 - DNA, 22 bp, Homo sapiens
aaaggaactcggcaaatcttac

SEQ ID NO: 70857 - DNA, 26 bp, Homo sapiens
aacatataactgaactcctcacaccc

SEQ ID NO: 70858 - DNA, 18 bp, Homo sapiens
aactagttacgcgacccc

SEQ ID NO: 70859 - DNA, 41 bp, Homo sapiens
aagaacgcagctagctgcgagaattaatgtgaattgcagga

SEQ ID NO: 70860 - DNA, 43 bp, Homo sapiens; identical to SEQ ID NO: 57240

SEQ ID NO: 70861 - DNA, 17 bp, Homo sapiens
aagaagcccggctcgct

SEQ ID NO: 70862 - DNA, 20 bp, Homo sapiens
aagtccttctgatcgaggcc

SEQ ID NO: 70863 - DNA, 45 bp, Homo sapiens
aagtcggcaagccggatccgtaacttcgggataaggattggctct

SEQ ID NO: 70864 - DNA, 19 bp, Homo sapiens
aatagaagccggcgtaaag

SEQ ID NO: 70865 - DNA, 17 bp, Homo sapiens
aataggaccgcggttct

SEQ ID NO: 70866 - DNA, 40 bp, Homo sapiens
aatgggtaagaagcccggctcgctggcgtggagccgggcg

SEQ ID NO: 70867 - DNA, 16 bp, Homo sapiens
aatgtgaattgcagga

SEQ ID NO: 70868 - DNA, 41 bp, Homo sapiens
aattctagagctaatacatgccgacgggcgctgaccccctt

SEQ ID NO: 70869 - DNA, 41 bp, Homo sapiens; identical to SEQ ID NO: 58840

SEQ ID NO: 70870 - DNA, 31 bp, Homo sapiens; identical to SEQ ID NO: 13413

SEQ ID NO: 70871 - DNA, 24 bp, Homo sapiens
acatgtggcgtacggaagacccgc

SEQ ID NO: 70872 - DNA, 28 bp, Homo sapiens
accaattaagaaagcgttcaagctcaac

SEQ ID NO: 70873 - DNA, 25 bp, Homo sapiens
accaccaggagtggagcctgcggct

SEQ ID NO: 70874 - DNA, 21 bp, Homo sapiens
acccattcgaacgtctgccct

SEQ ID NO: 70875 - DNA, 21 bp, Homo sapiens
accctgttgagcttgactcta

SEQ ID NO: 70876 - DNA, 35 bp, Homo sapiens
accgatcccggagaagccggcgggagccccgggga

SEQ ID NO: 70877 - DNA, 20 bp, Homo sapiens
accgggtgctgtaggctttt

SEQ ID NO: 70878 - DNA, 21 bp, Homo sapiens
accgggtgctgtaggcttttt

SEQ ID NO: 70879 - DNA, 23 bp, Homo sapiens
accgggtgctgtaggctttttct

SEQ ID NO: 70880 - DNA, 26 bp, Homo sapiens
accgggtgctgtaggctttttctttg

SEQ ID NO: 70881 - DNA, 16 bp, Homo sapiens
acctcggagcagaacc

SEQ ID NO: 70882 - DNA, 22 bp, Homo sapiens
acctgcttctgggtcggggttt

SEQ ID NO: 70883 - DNA, 20 bp, Homo sapiens
acgcctgtctgagcgtcgct

SEQ ID NO: 70884 - DNA, 26 bp, Homo sapiens
acgcgacccccgagcggtcggcgtcc

SEQ ID NO: 70885 - DNA, 20 bp, Homo sapiens
acggtcgaacttgactatct

SEQ ID NO: 70886 - DNA, 22 bp, Homo sapiens
acggtcgaacttgactatctag

SEQ ID NO: 70887 - DNA, 25 bp, Homo sapiens
acggtcgaacttgactatctagagg

SEQ ID NO: 70888 - DNA, 28 bp, Homo sapiens
acggtcgaacttgactatctagaggaag

SEQ ID NO: 70889 - DNA, 29 bp, Homo sapiens
acggtcgaacttgactatctagaggaagt

SEQ ID NO: 70890 - DNA, 17 bp, Homo sapiens
actagttacgcgacccc

SEQ ID NO: 70891 - DNA, 27 bp, Homo sapiens
actttaaatcctttaacgaggatccat

SEQ ID NO: 70892 - DNA, 16 bp, Homo sapiens
agaacagggtttgtta

SEQ ID NO: 70893 - DNA, 21 bp, Homo sapiens
agaagggcaaaagctcgcttg

SEQ ID NO: 70894 - DNA, 24 bp, Homo sapiens
agaggaaactctggtggaggtccg

SEQ ID NO: 70895 - DNA, 38 bp, Homo sapiens
agatgggcgccgcgaggcgtccagtgcggtaacgcgac

SEQ ID NO: 70896 - DNA, 37 bp, Homo sapiens
agccctgaaaatggatggcgctggagcgtcgggccca

SEQ ID NO: 70897 - DNA, 18 bp, Homo sapiens
agctccctcgctgcgatc

SEQ ID NO: 70898 - DNA, 30 bp, Homo sapiens; identical to SEQ ID NO: 55994

SEQ ID NO: 70899 - DNA, 16 bp, Homo sapiens
agggtcgggcctggtt

SEQ ID NO: 70900 - DNA, 38 bp, Homo sapiens
aggtggagcacgagcgcacgtgttaggacccgaaagat

SEQ ID NO: 70901 - DNA, 35 bp, Homo sapiens; identical to SEQ ID NO: 57181

SEQ ID NO: 70902 - DNA, 18 bp, Homo sapiens
agtgcggtaacgcgaccg

SEQ ID NO: 70903 - DNA, 30 bp, Homo sapiens
agttacgcgacccccgagcggtcggcgtcc

SEQ ID NO: 70904 - DNA, 34 bp, Homo sapiens
ataacaatacaggactctttcgaggccctgtaat

SEQ ID NO: 70905 - DNA, 28 bp, Homo sapiens
atacaggactctttcgaggccctgtaat

SEQ ID NO: 70906 - DNA, 29 bp, Homo sapiens
ataccaccctgaacgcgcccgatctcgtc

SEQ ID NO: 70907 - DNA, 22 bp, Homo sapiens
atagctggcgctctcgcagacc

SEQ ID NO: 70908 - DNA, 23 bp, Homo sapiens
atagctggcgctctcgcagaccc

SEQ ID NO: 70909 - DNA, 24 bp, Homo sapiens
atagctggcgctctcgcagacccg

SEQ ID NO: 70910 - DNA, 25 bp, Homo sapiens
atagctggcgctctcgcagacccga

SEQ ID NO: 70911 - DNA, 27 bp, Homo sapiens
atagctggcgctctcgcagacccgacg

SEQ ID NO: 70912 - DNA, 45 bp, Homo sapiens
atagctggcgctctcgcagacccgacgcacccccgccacgcagtt

SEQ ID NO: 70913 - DNA, 30 bp, Homo sapiens
atggagctttaatttattaatgcaaacagt

SEQ ID NO: 70914 - DNA, 42 bp, Homo sapiens
atgtaggtaagggaagtcggcaagccggatccgtaacttcgg

SEQ ID NO: 70915 - DNA, 21 bp, Homo sapiens
attgaaagtcagccctcgaca

SEQ ID NO: 70916 - DNA, 23 bp, Homo sapiens
attgaaagtcagccctcgacaca

SEQ ID NO: 70917 - DNA, 25 bp, Homo sapiens
attgaaagtcagccctcgacacaag

SEQ ID NO: 70918 - DNA, 31 bp, Homo sapiens; identical to SEQ ID NO: 6510

SEQ ID NO: 70919 - DNA, 32 bp, Homo sapiens; identical to SEQ ID NO: 6511

SEQ ID NO: 70920 - DNA, 20 bp, Homo sapiens
caagtccttctgatcgaggc

SEQ ID NO: 70921 - DNA, 21 bp, Homo sapiens
caagtccttctgatcgaggcc

SEQ ID NO: 70922 - DNA, 22 bp, Homo sapiens
caagtccttctgatcgaggccc

SEQ ID NO: 70923 - DNA, 23 bp, Homo sapiens
cacacccgtctatgtagcaaaat

SEQ ID NO: 70924 - DNA, 26 bp, Homo sapiens
caccaccaggagtggagcctgcggct

SEQ ID NO: 70925 - DNA, 27 bp, Homo sapiens
caccaccaggagtggagcctgcggctt

SEQ ID NO: 70926 - DNA, 21 bp, Homo sapiens
cagaggaaactctggtggagg

SEQ ID NO: 70927 - DNA, 22 bp, Homo sapiens
cagaggaaactctggtggaggt

SEQ ID NO: 70928 - DNA, 25 bp, Homo sapiens
cagaggaaactctggtggaggtccg

SEQ ID NO: 70929 - DNA, 35 bp, Homo sapiens
cagaggaaactctggtggaggtccgtagcggtcct

SEQ ID NO: 70930 - DNA, 25 bp, Homo sapiens
caggactctttcgaggccctgtaat

SEQ ID NO: 70931 - DNA, 19 bp, Homo sapiens
cagtgcggtaacgcgaccg

SEQ ID NO: 70932 - DNA, 23 bp, Homo sapiens
catgtggcgtacggaagacccgc

SEQ ID NO: 70933 - DNA, 24 bp, Homo sapiens
catgtggcgtacggaagacccgct

SEQ ID NO: 70934 - DNA, 23 bp, Homo sapiens
catttatatagaggagacaagtc

SEQ ID NO: 70935 - DNA, 27 bp, Homo sapiens
ccaaagtctttgggttccggggggagt

SEQ ID NO: 70936 - DNA, 17 bp, Homo sapiens
ccaagtccttctgatcg

SEQ ID NO: 70937 - DNA, 18 bp, Homo sapiens
ccaagtccttctgatcga

SEQ ID NO: 70938 - DNA, 21 bp, Homo sapiens
ccaagtccttctgatcgaggc

SEQ ID NO: 70939 - DNA, 22 bp, Homo sapiens
ccaagtccttctgatcgaggcc

SEQ ID NO: 70940 - DNA, 23 bp, Homo sapiens
ccaagtccttctgatcgaggccc

SEQ ID NO: 70941 - DNA, 29 bp, Homo sapiens
ccactactctgatcgttttttcactgacc

SEQ ID NO: 70942 - DNA, 31 bp, Homo sapiens; identical to SEQ ID NO: 26287

SEQ ID NO: 70943 - DNA, 33 bp, Homo sapiens; identical to SEQ ID NO: 26289

SEQ ID NO: 70944 - DNA, 21 bp, Homo sapiens
ccatacccggccgtcgccggc

SEQ ID NO: 70945 - DNA, 29 bp, Homo sapiens
ccatacccggccgtcgccggcagtcgaga

SEQ ID NO: 70946 - DNA, 23 bp, Homo sapiens
cccaagtccttctgatcgaggcc

SEQ ID NO: 70947 - DNA, 24 bp, Homo sapiens
cccaagtccttctgatcgaggccc

SEQ ID NO: 70948 - DNA, 27 bp, Homo sapiens
ccccgcccccggagccccgcggacgct

SEQ ID NO: 70949 - DNA, 30 bp, Homo sapiens
cccgggccgggtccgagccgcgacgggcga

SEQ ID NO: 70950 - DNA, 24 bp, Homo sapiens
cccggggagagttctcttttcttt

SEQ ID NO: 70951 - DNA, 40 bp, Homo sapiens; identical to SEQ ID NO: 57292

SEQ ID NO: 70952 - DNA, 41 bp, Homo sapiens; identical to SEQ ID NO: 57293

SEQ ID NO: 70953 - DNA, 24 bp, Homo sapiens
cccttcccgtggatcgccccagct

SEQ ID NO: 70954 - DNA, 22 bp, Homo sapiens
ccgccggtgaaataccactact

SEQ ID NO: 70955 - DNA, 25 bp, Homo sapiens
ccgggtcttcccggagtcgggttgc

SEQ ID NO: 70956 - DNA, 39 bp, Homo sapiens; identical to SEQ ID NO: 57294

SEQ ID NO: 70957 - DNA, 40 bp, Homo sapiens
ccgggttcctcccggggctacgcctgtctgagcgtcgctt

SEQ ID NO: 70958 - DNA, 42 bp, Homo sapiens
cctccgaagtttccctcaggatagctggcgctctcgcagacc

SEQ ID NO: 70959 - DNA, 19 bp, Homo sapiens
cctcgacacaagggtttgt

SEQ ID NO: 70960 - DNA, 16 bp, Homo sapiens
cctgtctgagcgtcgc

SEQ ID NO: 70961 - DNA, 17 bp, Homo sapiens
cctgtctgagcgtcgct

SEQ ID NO: 70962 - DNA, 23 bp, Homo sapiens
ccttcccgtggatcgccccagct

SEQ ID NO: 70963 - DNA, 18 bp, Homo sapiens
cctttaacgaggatccat

SEQ ID NO: 70964 - DNA, 43 bp, Homo sapiens
cgaaagatggtgaactatgcctgggcagggcgaagccagagga

SEQ ID NO: 70965 - DNA, 22 bp, Homo sapiens
cgacccccgagcggtcggcgtc

SEQ ID NO: 70966 - DNA, 21 bp, Homo sapiens
cgccggtgaaataccactact

SEQ ID NO: 70967 - DNA, 22 bp, Homo sapiens
cgccggtgaaataccactactc

SEQ ID NO: 70968 - DNA, 19 bp, Homo sapiens
cgcctgtctgagcgtcgct

SEQ ID NO: 70969 - DNA, 39 bp, Homo sapiens
cgctaaggagtgtgtaacaactcacctgccgaatcaact

SEQ ID NO: 70970 - DNA, 28 bp, Homo sapiens
cgctacactgactggctcagcgtgtgcc

SEQ ID NO: 70971 - DNA, 37 bp, Homo sapiens
cggaagacccgctccccggcgccgctcgtggggggcc

SEQ ID NO: 70972 - DNA, 32 bp, Homo sapiens
cgggacggctgggaaggcccggcggggaaggt

SEQ ID NO: 70973 - DNA, 38 bp, Homo sapiens; identical to SEQ ID NO: 57295

SEQ ID NO: 70974 - DNA, 19 bp, Homo sapiens
cggtcgaacttgactatct

SEQ ID NO: 70975 - DNA, 24 bp, Homo sapiens
cggtcgaacttgactatctagagg

SEQ ID NO: 70976 - DNA, 28 bp, Homo sapiens
cggtcgaacttgactatctagaggaagt

SEQ ID NO: 70977 - DNA, 21 bp, Homo sapiens
cggtgagctctcgctggccct

SEQ ID NO: 70978 - DNA, 22 bp, Homo sapiens
cggtgagctctcgctggccctt

SEQ ID NO: 70979 - DNA, 27 bp, Homo sapiens
cggttggggcgacctcggagcagaacc

SEQ ID NO: 70980 - DNA, 17 bp, Homo sapiens
cgtacggaagacccgct

SEQ ID NO: 70981 - DNA, 28 bp, Homo sapiens
cgtaggtgaacctgcggaaggatcatta

SEQ ID NO: 70982 - DNA, 36 bp, Homo sapiens
cgtcacgcaccgcacgttcgtggggaacctggcgct

SEQ ID NO: 70983 - DNA, 23 bp, Homo sapiens
cgtccggtgagctctcgctggcc

SEQ ID NO: 70984 - DNA, 24 bp, Homo sapiens
cgtccggtgagctctcgctggccc

SEQ ID NO: 70985 - DNA, 26 bp, Homo sapiens
cgtccggtgagctctcgctggccctt

SEQ ID NO: 70986 - DNA, 33 bp, Homo sapiens
cgtcgatgaagaacgcagctagctgcgagaatt

SEQ ID NO: 70987 - DNA, 22 bp, Homo sapiens
cgtgttaggacccgaaagatgg

SEQ ID NO: 70988 - DNA, 20 bp, Homo sapiens
ctaactagttacgcgacccc

SEQ ID NO: 70989 - DNA, 24 bp, Homo sapiens
ctacgcctgtctgagcgtcgcttg

SEQ ID NO: 70990 - DNA, 35 bp, Homo sapiens
ctattctagagtccatatcaacaatagggtttacg

SEQ ID NO: 70991 - DNA, 18 bp, Homo sapiens
ctcgacacaagggtttgt

SEQ ID NO: 70992 - DNA, 24 bp, Homo sapiens
ctctagaggagcctgttctgtaat

SEQ ID NO: 70993 - DNA, 19 bp, Homo sapiens
ctggccggcctgaggcaac

SEQ ID NO: 70994 - DNA, 27 bp, Homo sapiens
ctggccggcctgaggcaaccccctctc

SEQ ID NO: 70995 - DNA, 30 bp, Homo sapiens; identical to SEQ ID NO: 29160

SEQ ID NO: 70996 - DNA, 39 bp, Homo sapiens
ctggcggagcgctgagaagacggtcgaacttgactatct

SEQ ID NO: 70997 - DNA, 16 bp, Homo sapiens
ctgtctgagcgtcgct

SEQ ID NO: 70998 - DNA, 48 bp, Homo sapiens; identical to SEQ ID NO: 57283

SEQ ID NO: 70999 - DNA, 49 bp, Homo sapiens; identical to SEQ ID NO: 57284

SEQ ID NO: 71000 - DNA, 18 bp, Homo sapiens
cttggaaagcgtcgcggt

SEQ ID NO: 71001 - DNA, 42 bp, Homo sapiens; identical to SEQ ID NO: 56871

SEQ ID NO: 71002 - DNA, 43 bp, Homo sapiens; identical to SEQ ID NO: 6981

SEQ ID NO: 71003 - DNA, 44 bp, Homo sapiens; identical to SEQ ID NO: 6982

SEQ ID NO: 71004 - DNA, 32 bp, Homo sapiens
cttggcggaatcagcggggaaagaagaccctg

SEQ ID NO: 71005 - DNA, 28 bp, Homo sapiens
gaaagtcagccctcgacacaagggtttg

SEQ ID NO: 71006 - DNA, 29 bp, Homo sapiens
gaaagtcagccctcgacacaagggtttgt

SEQ ID NO: 71007 - DNA, 17 bp, Homo sapiens
gaaagttgaaaagaact

SEQ ID NO: 71008 - DNA, 18 bp, Homo sapiens
gaaagttgaaaagaactt

SEQ ID NO: 71009 - DNA, 19 bp, Homo sapiens
gaacagctctttggacact

SEQ ID NO: 71010 - DNA, 26 bp, Homo sapiens
gaagaacgcagctagctgcgagaatt

SEQ ID NO: 71011 - DNA, 26 bp, Homo sapiens
gaagagcccagcgccgaatccccgcc

SEQ ID NO: 71012 - DNA, 31 bp, Homo sapiens
gaagagcccagcgccgaatccccgccccgcg

SEQ ID NO: 71013 - DNA, 32 bp, Homo sapiens
gaagagcccagcgccgaatccccgccccgcgg

SEQ ID NO: 71014 - DNA, 17 bp, Homo sapiens
gaaggatcattaacgga

SEQ ID NO: 71015 - DNA, 18 bp, Homo sapiens
gaaggatcattaacggag

SEQ ID NO: 71016 - DNA, 20 bp, Homo sapiens
gaaggatcattaacggagcc

SEQ ID NO: 71017 - DNA, 21 bp, Homo sapiens
gaaggatcattaacggagccc

SEQ ID NO: 71018 - DNA, 38 bp, Homo sapiens
gaagtttccctcaggatagctggcgctctcgcagaccc

SEQ ID NO: 71019 - DNA, 39 bp, Homo sapiens
gaagtttccctcaggatagctggcgctctcgcagacccg

SEQ ID NO: 71020 - DNA, 29 bp, Homo sapiens
gacagattgatagctctttctcgattccg

SEQ ID NO: 71021 - DNA, 25 bp, Homo sapiens
gacatgtggcgtacggaagacccgc

SEQ ID NO: 71022 - DNA, 21 bp, Homo sapiens
gacggtcgaacttgactatct

SEQ ID NO: 71023 - DNA, 26 bp, Homo sapiens
gacggtcgaacttgactatctagagg

SEQ ID NO: 71024 - DNA, 34 bp, Homo sapiens; identical to SEQ ID NO: 57102

SEQ ID NO: 71025 - DNA, 39 bp, Homo sapiens
gagatgggcgccgcgaggcgtccagtgcggtaacgcgac

SEQ ID NO: 71026 - DNA, 41 bp, Homo sapiens
gagatgggcgccgcgaggcgtccagtgcggtaacgcgaccg

SEQ ID NO: 71027 - DNA, 33 bp, Homo sapiens; identical to SEQ ID NO: 17049

SEQ ID NO: 71028 - DNA, 34 bp, Homo sapiens
gaggtgaaattcttggaccggcgcaagacggacc

SEQ ID NO: 71029 - DNA, 26 bp, Homo sapiens
gatgaagaacgcagctagctgcgaga

SEQ ID NO: 71030 - DNA, 41 bp, Homo sapiens
gatggcctccgttgccctcggccgatcgaaagggagtcggg

SEQ ID NO: 71031 - DNA, 33 bp, Homo sapiens; identical to SEQ ID NO: 22738

SEQ ID NO: 71032 - DNA, 37 bp, Homo sapiens
gatgggcgccgcgaggcgtccagtgcggtaacgcgac

SEQ ID NO: 71033 - DNA, 20 bp, Homo sapiens
gattatgactgaacgcctct

SEQ ID NO: 71034 - DNA, 23 bp, Homo sapiens
gcacgtgttaggacccgaaagat

SEQ ID NO: 71035 - DNA, 25 bp, Homo sapiens
gcacgttcgtggggaacctggcgct

SEQ ID NO: 71036 - DNA, 22 bp, Homo sapiens
gcagaagggcaaaagctcgctt

SEQ ID NO: 71037 - DNA, 35 bp, Homo sapiens; identical to SEQ ID NO: 59231

SEQ ID NO: 71038 - DNA, 20 bp, Homo sapiens
gcagctccctcgctgcgatc

SEQ ID NO: 71039 - DNA, 31 bp, Homo sapiens
gcagctccctcgctgcgatctattgaaagtc

SEQ ID NO: 71040 - DNA, 20 bp, Homo sapiens
gcaggttcagacatttggtg

SEQ ID NO: 71041 - DNA, 40 bp, Homo sapiens
gcatgctaactagttacgcgacccccgagcggtcggcgtc

SEQ ID NO: 71042 - DNA, 36 bp, Homo sapiens; identical to SEQ ID NO: 64366

SEQ ID NO: 71043 - DNA, 27 bp, Homo sapiens
gcccggcggatctttcccgccccccgt

SEQ ID NO: 71044 - DNA, 21 bp, Homo sapiens
gccctcgacacaagggtttgt

SEQ ID NO: 71045 - DNA, 19 bp, Homo sapiens
gccgaaacgatctcaacct

SEQ ID NO: 71046 - DNA, 38 bp, Homo sapiens
gccgctcgtggggggcccaagtccttctgatcgaggcc

SEQ ID NO: 71047 - DNA, 39 bp, Homo sapiens
gccgctcgtggggggcccaagtccttctgatcgaggccc

SEQ ID NO: 71048 - DNA, 20 bp, Homo sapiens
gccggtgaaataccactact

SEQ ID NO: 71049 - DNA, 21 bp, Homo sapiens
gccggtgaaataccactactc

SEQ ID NO: 71050 - DNA, 28 bp, Homo sapiens
gcctgggaataccgggtgctgtaggctt

SEQ ID NO: 71051 - DNA, 34 bp, Homo sapiens
gcgacgtcgctttttgatccttcgatgtcggctc

SEQ ID NO: 71052 - DNA, 46 bp, Homo sapiens
gcgactctggacgcgagccgggcccttcccgtggatcgccccagct

SEQ ID NO: 71053 - DNA, 22 bp, Homo sapiens
gcggaaggatcattaacggagc

SEQ ID NO: 71054 - DNA, 36 bp, Homo sapiens
gcggagcgctgagaagacggtcgaacttgactatct

SEQ ID NO: 71055 - DNA, 44 bp, Homo sapiens
gcggccccgggttcctcccggggctacgcctgtctgagcgtcgc

SEQ ID NO: 71056 - DNA, 45 bp, Homo sapiens; identical to SEQ ID NO: 17969

SEQ ID NO: 71057 - DNA, 35 bp, Homo sapiens
gcggcgactctggacgcgagccgggcccttcccgt

SEQ ID NO: 71058 - DNA, 49 bp, Homo sapiens
gcggcgactctggacgcgagccgggcccttcccgtggatcgccccagct

SEQ ID NO: 71059 - DNA, 17 bp, Homo sapiens
gcggtaacgcgaccgat

SEQ ID NO: 71060 - DNA, 16 bp, Homo sapiens
gcggtaattccagctc

SEQ ID NO: 71061 - DNA, 38 bp, Homo sapiens; identical to SEQ ID NO: 23194

SEQ ID NO: 71062 - DNA, 39 bp, Homo sapiens; identical to SEQ ID NO: 23195

SEQ ID NO: 71063 - DNA, 16 bp, Homo sapiens
gcgtacggaagacccg

SEQ ID NO: 71064 - DNA, 24 bp, Homo sapiens
gcgtccggtgagctctcgctggcc

SEQ ID NO: 71065 - DNA, 25 bp, Homo sapiens
gcgtccggtgagctctcgctggccc

SEQ ID NO: 71066 - DNA, 26 bp, Homo sapiens
gcgtccggtgagctctcgctggccct

SEQ ID NO: 71067 - DNA, 36 bp, Homo sapiens
gctaactagttacgcgacccccgagcggtcggcgtc

SEQ ID NO: 71068 - DNA, 36 bp, Homo sapiens; identical to SEQ ID NO: 57008

SEQ ID NO: 71069 - DNA, 26 bp, Homo sapiens
gctgacacgctgtcctctggcgacct

SEQ ID NO: 71070 - DNA, 29 bp, Homo sapiens
gctgagaagacggtcgaacttgactatct

SEQ ID NO: 71071 - DNA, 21 bp, Homo sapiens
gctggcgctctcgcagacccg

SEQ ID NO: 71072 - DNA, 22 bp, Homo sapiens
gctggcgctctcgcagacccga

SEQ ID NO: 71073 - DNA, 20 bp, Homo sapiens
ggaaggatcattaacggagc

SEQ ID NO: 71074 - DNA, 38 bp, Homo sapiens; identical to SEQ ID NO: 57063

SEQ ID NO: 71075 - DNA, 16 bp, Homo sapiens
ggacacggacaggatt

SEQ ID NO: 71076 - DNA, 26 bp, Homo sapiens
ggacatgtggcgtacggaagacccgc

SEQ ID NO: 71077 - DNA, 40 bp, Homo sapiens
ggagatgggcgccgcgaggcgtccagtgcggtaacgcgac

SEQ ID NO: 71078 - DNA, 41 bp, Homo sapiens
ggagatgggcgccgcgaggcgtccagtgcggtaacgcgacc

SEQ ID NO: 71079 - DNA, 42 bp, Homo sapiens
ggagatgggcgccgcgaggcgtccagtgcggtaacgcgaccg

SEQ ID NO: 71080 - DNA, 17 bp, Homo sapiens
ggagccccggggagagt

SEQ ID NO: 71081 - DNA, 30 bp, Homo sapiens
ggagcgagcgcacggggtcggcggcgacgt

SEQ ID NO: 71082 - DNA, 35 bp, Homo sapiens
ggagcgagcgcacggggtcggcggcgacgtcggct

SEQ ID NO: 71083 - DNA, 43 bp, Homo sapiens
ggagcgctgagaagacggtcgaacttgactatctagaggaagt

SEQ ID NO: 71084 - DNA, 16 bp, Homo sapiens
ggatcattaacggagc

SEQ ID NO: 71085 - DNA, 39 bp, Homo sapiens; identical to SEQ ID NO: 56880

SEQ ID NO: 71086 - DNA, 34 bp, Homo sapiens
ggattgacagattgatagctctttctcgattccg

SEQ ID NO: 71087 - DNA, 27 bp, Homo sapiens
ggccccgtccgtccgtccgtccgtcct

SEQ ID NO: 71088 - DNA, 47 bp, Homo sapiens
ggcgactctggacgcgagccgggcccttcccgtggatcgccccagct

SEQ ID NO: 71089 - DNA, 22 bp, Homo sapiens
ggcgctggagcgtcgggcccat

SEQ ID NO: 71090 - DNA, 45 bp, Homo sapiens
ggcggagatgggcgccgcgaggcgtccagtgcggtaacgcgaccg

SEQ ID NO: 71091 - DNA, 28 bp, Homo sapiens
ggcggagcgctgagaagacggtcgaact

SEQ ID NO: 71092 - DNA, 28 bp, Homo sapiens
ggcggggcgcgggacatgtggcgtacgg

SEQ ID NO: 71093 - DNA, 17 bp, Homo sapiens
ggcgggtccggccgtgt

SEQ ID NO: 71094 - DNA, 26 bp, Homo sapiens
ggcgtccggtgagctctcgctggccc

SEQ ID NO: 71095 - DNA, 27 bp, Homo sapiens
ggcgtccggtgagctctcgctggccct

SEQ ID NO: 71096 - DNA, 24 bp, Homo sapiens
ggctacgcctgtctgagcgtcgct

SEQ ID NO: 71097 - DNA, 24 bp, Homo sapiens
gggaaagaagaccctgttgagctt

SEQ ID NO: 71098 - DNA, 32 bp, Homo sapiens
gggaagtcggcaagccggatccgtaacttcgg

SEQ ID NO: 71099 - DNA, 27 bp, Homo sapiens
gggacatgtggcgtacggaagacccgc

SEQ ID NO: 71100 - DNA, 31 bp, Homo sapiens
gggacggctgggaaggcccggcggggaaggt

SEQ ID NO: 71101 - DNA, 26 bp, Homo sapiens
gggagtatggttgcaaagctgaaact

SEQ ID NO: 71102 - DNA, 20 bp, Homo sapiens
gggcccatacccggccgtcg

SEQ ID NO: 71103 - DNA, 33 bp, Homo sapiens; identical to SEQ ID NO: 22011

SEQ ID NO: 71104 - DNA, 28 bp, Homo sapiens
gggccccgtccgtccgtccgtccgtcct

SEQ ID NO: 71105 - DNA, 23 bp, Homo sapiens
ggggaaagaagaccctgttgagc

SEQ ID NO: 71106 - DNA, 25 bp, Homo sapiens
ggggaaagaagaccctgttgagctt

SEQ ID NO: 71107 - DNA, 21 bp, Homo sapiens
ggtcagtcggtcctgagagat

SEQ ID NO: 71108 - DNA, 29 bp, Homo sapiens
ggtccggccgtgtcggcggcccggcggat

SEQ ID NO: 71109 - DNA, 31 bp, Homo sapiens
ggtccggccgtgtcggcggcccggcggatct

SEQ ID NO: 71110 - DNA, 28 bp, Homo sapiens
ggtcttggggccgaaacgatctcaacct

SEQ ID NO: 71111 - DNA, 20 bp, Homo sapiens
ggtgaaataccactactctg

SEQ ID NO: 71112 - DNA, 24 bp, Homo sapiens
ggtgaacctgcggaaggatcatta

SEQ ID NO: 71113 - DNA, 19 bp, Homo sapiens
ggtgagctctcgctggccc

SEQ ID NO: 71114 - DNA, 21 bp, Homo sapiens
ggtgagctctcgctggccctt

SEQ ID NO: 71115 - DNA, 37 bp, Homo sapiens
ggtggagcacgagcgcacgtgttaggacccgaaagat

SEQ ID NO: 71116 - DNA, 24 bp, Homo sapiens
ggtttacgacctcgatgttggatc

SEQ ID NO: 71117 - DNA, 34 bp, Homo sapiens
ggtttccgtaggtgaacctgcggaaggatcatta

SEQ ID NO: 71118 - DNA, 17 bp, Homo sapiens
gtaactatgactctctt

SEQ ID NO: 71119 - DNA, 16 bp, Homo sapiens
gtacggaagacccgct

SEQ ID NO: 71120 - DNA, 29 bp, Homo sapiens
gtacggaagacccgctccccggcgccgct

SEQ ID NO: 71121 - DNA, 45 bp, Homo sapiens; identical to SEQ ID NO: 56861

SEQ ID NO: 71122 - DNA, 16 bp, Homo sapiens
gtagacgacctgcttc

SEQ ID NO: 71123 - DNA, 27 bp, Homo sapiens
gtaggtgaacctgcggaaggatcatta

SEQ ID NO: 71124 - DNA, 34 bp, Homo sapiens
gtaggtgaacctgcggaaggatcattaacggagc

SEQ ID NO: 71125 - DNA, 40 bp, Homo sapiens; identical to SEQ ID NO: 57767

SEQ ID NO: 71126 - DNA, 25 bp, Homo sapiens
gtccgcgcagtccgcccggaggatt

SEQ ID NO: 71127 - DNA, 21 bp, Homo sapiens
gtccggtgagctctcgctggc

SEQ ID NO: 71128 - DNA, 22 bp, Homo sapiens
gtccggtgagctctcgctggcc

SEQ ID NO: 71129 - DNA, 23 bp, Homo sapiens
gtccggtgagctctcgctggccc

SEQ ID NO: 71130 - DNA, 24 bp, Homo sapiens
gtccggtgagctctcgctggccct

SEQ ID NO: 71131 - DNA, 25 bp, Homo sapiens
gtccggtgagctctcgctggccctt

SEQ ID NO: 71132 - DNA, 17 bp, Homo sapiens
gtcgaacttgactatct

SEQ ID NO: 71133 - DNA, 28 bp, Homo sapiens
gtcgatgaagaacgcagctagctgcgag

SEQ ID NO: 71134 - DNA, 30 bp, Homo sapiens
gtcgatgaagaacgcagctagctgcgagaa

SEQ ID NO: 71135 - DNA, 17 bp, Homo sapiens
gtcgccggcagtcgaga

SEQ ID NO: 71136 - DNA, 40 bp, Homo sapiens
gtcgcggttccggcggcgtccggtgagctctcgctggccc

SEQ ID NO: 71137 - DNA, 41 bp, Homo sapiens
gtcgcggttccggcggcgtccggtgagctctcgctggccct

SEQ ID NO: 71138 - DNA, 42 bp, Homo sapiens
gtcgcggttccggcggcgtccggtgagctctcgctggccctt

SEQ ID NO: 71139 - DNA, 16 bp, Homo sapiens
gtcgctactaccgatt

SEQ ID NO: 71140 - DNA, 18 bp, Homo sapiens
gtcgctcgctcctctcct

SEQ ID NO: 71141 - DNA, 23 bp, Homo sapiens
gtcgggcctggttagtacttgga

SEQ ID NO: 71142 - DNA, 16 bp, Homo sapiens
gtcgtgagacaggtta

SEQ ID NO: 71143 - DNA, 18 bp, Homo sapiens
gtcgtgagacaggttagt

SEQ ID NO: 71144 - DNA, 19 bp, Homo sapiens
gtcgtgagacaggttagtt

SEQ ID NO: 71145 - DNA, 21 bp, Homo sapiens
gtcgtgagacaggttagtttt

SEQ ID NO: 71146 - DNA, 31 bp, Homo sapiens
gtgaagcagaattcaccaagcgttggattgt

SEQ ID NO: 71147 - DNA, 40 bp, Homo sapiens; identical to SEQ ID NO: 27114

SEQ ID NO: 71148 - DNA, 18 bp, Homo sapiens
gtgagctctcgctggccc

SEQ ID NO: 71149 - DNA, 19 bp, Homo sapiens
gtgagctctcgctggccct

SEQ ID NO: 71150 - DNA, 20 bp, Homo sapiens
gtgagctctcgctggccctt

SEQ ID NO: 71151 - DNA, 18 bp, Homo sapiens
gtgttcaaagcaggcccg

SEQ ID NO: 71152 - DNA, 17 bp, Homo sapiens
gttaggacccgaaagat

SEQ ID NO: 71153 - DNA, 16 bp, Homo sapiens
gttcaaagcaggcccg

SEQ ID NO: 71154 - DNA, 19 bp, Homo sapiens
gttccatgtgaacagcagt

SEQ ID NO: 71155 - DNA, 20 bp, Homo sapiens
gttccatgtgaacagcagtt

SEQ ID NO: 71156 - DNA, 46 bp, Homo sapiens
gttccctccgaagtttccctcaggatagctggcgctctcgcagacc

SEQ ID NO: 71157 - DNA, 47 bp, Homo sapiens
gttccctccgaagtttccctcaggatagctggcgctctcgcagaccc

SEQ ID NO: 71158 - DNA, 49 bp, Homo sapiens
gttccctccgaagtttccctcaggatagctggcgctctcgcagacccga

SEQ ID NO: 71159 - DNA, 20 bp, Homo sapiens
gttccgaagggacgggcgat

SEQ ID NO: 71160 - DNA, 27 bp, Homo sapiens
gttccgaagggacgggcgatggcctcc

SEQ ID NO: 71161 - DNA, 23 bp, Homo sapiens
gttcgattccggagagggagcct

SEQ ID NO: 71162 - DNA, 34 bp, Homo sapiens
gttcgattccggagagggagcctgagaaacggct

SEQ ID NO: 71163 - DNA, 17 bp, Homo sapiens
gttgcaaagctgaaact

SEQ ID NO: 71164 - DNA, 38 bp, Homo sapiens
gtttcgtacgtagcagagcagctccctcgctgcgatct

SEQ ID NO: 71165 - DNA, 16 bp, Homo sapiens
taaaactcaaaggacc

SEQ ID NO: 71166 - DNA, 17 bp, Homo sapiens
taaaactcaaaggacct

SEQ ID NO: 71167 - DNA, 21 bp, Homo sapiens
taaatagggacctgtatgaat

SEQ ID NO: 71168 - DNA, 19 bp, Homo sapiens
taactagttacgcgacccc

SEQ ID NO: 71169 - DNA, 18 bp, Homo sapiens
taacttgaccaacggaac

SEQ ID NO: 71170 - DNA, 16 bp, Homo sapiens
tacgtgatctgagttc

SEQ ID NO: 71171 - DNA, 20 bp, Homo sapiens
tagctggcgctctcgcagac

SEQ ID NO: 71172 - DNA, 21 bp, Homo sapiens
tagctggcgctctcgcagacc

SEQ ID NO: 71173 - DNA, 30 bp, Homo sapiens
tagttacgcgacccccgagcggtcggcgtc

SEQ ID NO: 71174 - DNA, 22 bp, Homo sapiens
tataactgaactcctcacaccc

SEQ ID NO: 71175 - DNA, 24 bp, Homo sapiens
tattgaaagtcagccctcgacaca

SEQ ID NO: 71176 - DNA, 26 bp, Homo sapiens
tattgaaagtcagccctcgacacaag

SEQ ID NO: 71177 - DNA, 31 bp, Homo sapiens; identical to SEQ ID NO: 28472

SEQ ID NO: 71178 - DNA, 33 bp, Homo sapiens; identical to SEQ ID NO: 6508

SEQ ID NO: 71179 - DNA, 28 bp, Homo sapiens
tcaagagggcgtgaaaccgttaagaggt

SEQ ID NO: 71180 - DNA, 24 bp, Homo sapiens
tcagccctcgacacaagggtttgt

SEQ ID NO: 71181 - DNA, 17 bp, Homo sapiens
tcataaggaaaggttaa

SEQ ID NO: 71182 - DNA, 17 bp, Homo sapiens
tccatgtgaacagcagt

SEQ ID NO: 71183 - DNA, 46 bp, Homo sapiens
tccctccgaagtttccctcaggatagctggcgctctcgcagacccg

SEQ ID NO: 71184 - DNA, 33 bp, Homo sapiens; identical to SEQ ID NO: 1830

SEQ ID NO: 71185 - DNA, 41 bp, Homo sapiens
tccgaagtttccctcaggatagctggcgctctcgcagaccc

SEQ ID NO: 71186 - DNA, 42 bp, Homo sapiens
tccgaagtttccctcaggatagctggcgctctcgcagacccg

SEQ ID NO: 71187 - DNA, 43 bp, Homo sapiens
tccgaagtttccctcaggatagctggcgctctcgcagacccga

SEQ ID NO: 71188 - DNA, 23 bp, Homo sapiens
tccgcgcagtccgcccggaggat

SEQ ID NO: 71189 - DNA, 17 bp, Homo sapiens
tccttctgatcgaggcc

SEQ ID NO: 71190 - DNA, 16 bp, Homo sapiens
tcgaacttgactatct

SEQ ID NO: 71191 - DNA, 32 bp, Homo sapiens; identical to SEQ ID NO: 13112

SEQ ID NO: 71192 - DNA, 29 bp, Homo sapiens
tcggaagctaagcagggtcgggcctggtt

SEQ ID NO: 71193 - DNA, 27 bp, Homo sapiens
tctgaatgtcaaagtgaagaaattcaa

SEQ ID NO: 71194 - DNA, 28 bp, Homo sapiens
tctggccggcctgaggcaaccccctctc

SEQ ID NO: 71195 - DNA, 33 bp, Homo sapiens
tctggccggcctgaggcaaccccctctcctctt

SEQ ID NO: 71196 - DNA, 19 bp, Homo sapiens
tcttgattttcagtacgaa

SEQ ID NO: 71197 - DNA, 36 bp, Homo sapiens
tgaaaagaactttgaagagagagttcaagagggcgt

SEQ ID NO: 71198 - DNA, 16 bp, Homo sapiens
tgaaaccgttaagagg

SEQ ID NO: 71199 - DNA, 17 bp, Homo sapiens
tgaaaccgttaagaggt

SEQ ID NO: 71200 - DNA, 16 bp, Homo sapiens
tgaaataccactactc

SEQ ID NO: 71201 - DNA, 38 bp, Homo sapiens
tgaacagggaagagcccagcgccgaatccccgccccgc

SEQ ID NO: 71202 - DNA, 34 bp, Homo sapiens; identical to SEQ ID NO: 6851

SEQ ID NO: 71203 - DNA, 16 bp, Homo sapiens
tgcggaaggatcatta

SEQ ID NO: 71204 - DNA, 23 bp, Homo sapiens
tgcggaaggatcattaacggagc

SEQ ID NO: 71205 - DNA, 24 bp, Homo sapiens
tgcggaaggatcattaacggagcc

SEQ ID NO: 71206 - DNA, 46 bp, Homo sapiens; identical to SEQ ID NO: 17968

SEQ ID NO: 71207 - DNA, 19 bp, Homo sapiens
tggcgctctcgcagacccg

SEQ ID NO: 71208 - DNA, 29 bp, Homo sapiens
tggcggagcgctgagaagacggtcgaact

SEQ ID NO: 71209 - DNA, 38 bp, Homo sapiens
tggcggagcgctgagaagacggtcgaacttgactatct

SEQ ID NO: 71210 - DNA, 19 bp, Homo sapiens
tggcgtacggaagacccgc

SEQ ID NO: 71211 - DNA, 18 bp, Homo sapiens
tgttaggacccgaaagat

SEQ ID NO: 71212 - DNA, 24 bp, Homo sapiens
ttaaatcctttaacgaggatccat

SEQ ID NO: 71213 - DNA, 43 bp, Homo sapiens
ttaaatgggtaagaagcccggctcgctggcgtggagccgggcg

SEQ ID NO: 71214 - DNA, 29 bp, Homo sapiens
ttcaagagggcgtgaaaccgttaagaggt

SEQ ID NO: 71215 - DNA, 45 bp, Homo sapiens
ttccctccgaagtttccctcaggatagctggcgctctcgcagacc

SEQ ID NO: 71216 - DNA, 28 bp, Homo sapiens
ttgcaaggagagccaaagctaagacccc

SEQ ID NO: 71217 - DNA, 33 bp, Homo sapiens; identical to SEQ ID NO: 9401

SEQ ID NO: 71218 - DNA, 31 bp, Homo sapiens
ttgtacacaccgcccgtcgctactaccgatt

SEQ ID NO: 71219 - DNA, 32 bp, Homo sapiens; identical to SEQ ID NO: 3525

SEQ ID NO: 71220 - DNA, 24 bp, Homo sapiens
aaaaataacaatacaggactcttt

SEQ ID NO: 71221 - DNA, 25 bp, Homo sapiens
aaaaataacaatacaggactctttc

SEQ ID NO: 71222 - DNA, 27 bp, Homo sapiens
aaaaataacaatacaggactctttcga

SEQ ID NO: 71223 - DNA, 27 bp, Homo sapiens
aaaactcacctgagttgtaaaaaactc

SEQ ID NO: 71224 - DNA, 21 bp, Homo sapiens
aaaagctcgtagttggatctt

SEQ ID NO: 71225 - DNA, 24 bp, Homo sapiens
aaaataacaatacaggactctttc

SEQ ID NO: 71226 - DNA, 28 bp, Homo sapiens
aaagtcagccctcgacacaagggtttgt

SEQ ID NO: 71227 - DNA, 22 bp, Homo sapiens
aaatcctttaacgaggatccat

SEQ ID NO: 71228 - DNA, 18 bp, Homo sapiens
aactagttacgcgacccc

SEQ ID NO: 71229 - DNA, 17 bp, Homo sapiens
aagaacagggtttgtta

SEQ ID NO: 71230 - DNA, 18 bp, Homo sapiens
aagaacagggtttgttaa

SEQ ID NO: 71231 - DNA, 27 bp, Homo sapiens
aagtcagccctcgacacaagggtttgt

SEQ ID NO: 71232 - DNA, 21 bp, Homo sapiens
aatcctttaacgaggatccat

SEQ ID NO: 71233 - DNA, 27 bp, Homo sapiens
aatgattagaggtcttggggccgaaac

SEQ ID NO: 71234 - DNA, 23 bp, Homo sapiens
aattctagagctaatacatgccg

SEQ ID NO: 71235 - DNA, 16 bp, Homo sapiens
acagggtttgttaaga

SEQ ID NO: 71236 - DNA, 21 bp, Homo sapiens
acctcgggccgatcgcacgcc

SEQ ID NO: 71237 - DNA, 16 bp, Homo sapiens
actagttacgcgaccc

SEQ ID NO: 71238 - DNA, 17 bp, Homo sapiens
actagttacgcgacccc

SEQ ID NO: 71239 - DNA, 18 bp, Homo sapiens
actagttacgcgaccccc

SEQ ID NO: 71240 - DNA, 18 bp, Homo sapiens
actctttcgaggccctgt

SEQ ID NO: 71241 - DNA, 21 bp, Homo sapiens
actctttcgaggccctgtaat

SEQ ID NO: 71242 - DNA, 33 bp, Homo sapiens; identical to SEQ ID NO: 12587

SEQ ID NO: 71243 - DNA, 16 bp, Homo sapiens
agaacagggtttgtta

SEQ ID NO: 71244 - DNA, 17 bp, Homo sapiens
agaacagggtttgttaa

SEQ ID NO: 71245 - DNA, 23 bp, Homo sapiens
agcatatgcttgtctcaaagatt

SEQ ID NO: 71246 - DNA, 22 bp, Homo sapiens
agccctcgacacaagggtttgt

SEQ ID NO: 71247 - DNA, 35 bp, Homo sapiens
aggaacagctctttggacactaggaaaaaaccttg

SEQ ID NO: 71248 - DNA, 31 bp, Homo sapiens; identical to SEQ ID NO: 58705

SEQ ID NO: 71249 - DNA, 33 bp, Homo sapiens
agttgaacatgggtcagtcggtcctgagagatg

SEQ ID NO: 71250 - DNA, 34 bp, Homo sapiens
agttttatccggtaaagcgaatgattagaggtct

SEQ ID NO: 71251 - DNA, 36 bp, Homo sapiens
ataaacgatgccgaccggcgatgcggcggcgttatt

SEQ ID NO: 71252 - DNA, 19 bp, Homo sapiens
ataacaatacaggactctt

SEQ ID NO: 71253 - DNA, 24 bp, Homo sapiens
ataatatagcaaggactaacccct

SEQ ID NO: 71254 - DNA, 18 bp, Homo sapiens
ataccactactctgatcg

SEQ ID NO: 71255 - DNA, 29 bp, Homo sapiens
atacccacacccacccaagaacagggttt

SEQ ID NO: 71256 - DNA, 33 bp, Homo sapiens; identical to SEQ ID NO: 11848

SEQ ID NO: 71257 - DNA, 19 bp, Homo sapiens
atagcaaggactaacccct

SEQ ID NO: 71258 - DNA, 28 bp, Homo sapiens
atagctggcgctctcgcagacccgacgc

SEQ ID NO: 71259 - DNA, 21 bp, Homo sapiens
atatagcaaggactaacccct

SEQ ID NO: 71260 - DNA, 32 bp, Homo sapiens
attatacccacacccacccaagaacagggttt

SEQ ID NO: 71261 - DNA, 20 bp, Homo sapiens
attcgtagacgacctgcttc

SEQ ID NO: 71262 - DNA, 32 bp, Homo sapiens; identical to SEQ ID NO: 6511

SEQ ID NO: 71263 - DNA, 23 bp, Homo sapiens
cagccctcgacacaagggtttgt

SEQ ID NO: 71264 - DNA, 38 bp, Homo sapiens
ccactactctgatcgttttttcactgacccggtgaggc

SEQ ID NO: 71265 - DNA, 28 bp, Homo sapiens
ccagacgagctacctaagaacagctaaa

SEQ ID NO: 71266 - DNA, 26 bp, Homo sapiens
cccacacccacccaagaacagggttt

SEQ ID NO: 71267 - DNA, 30 bp, Homo sapiens; identical to SEQ ID NO: 11849

SEQ ID NO: 71268 - DNA, 20 bp, Homo sapiens
cccccgaagagggggacggc

SEQ ID NO: 71269 - DNA, 40 bp, Homo sapiens; identical to SEQ ID NO: 57292

SEQ ID NO: 71270 - DNA, 28 bp, Homo sapiens
ccgcataagcctgcgtcagattaaaaca

SEQ ID NO: 71271 - DNA, 39 bp, Homo sapiens; identical to SEQ ID NO: 57294

SEQ ID NO: 71272 - DNA, 40 bp, Homo sapiens; identical to SEQ ID NO: 70957

SEQ ID NO: 71273 - DNA, 18 bp, Homo sapiens
ccgtcgtgagacaggtta

SEQ ID NO: 71274 - DNA, 19 bp, Homo sapiens
cctcgacacaagggtttgt

SEQ ID NO: 71275 - DNA, 18 bp, Homo sapiens
cctgtctgagcgtcgctt

SEQ ID NO: 71276 - DNA, 20 bp, Homo sapiens
cgcctgtctgagcgtcgctt

SEQ ID NO: 71277 - DNA, 34 bp, Homo sapiens
cggccgtcgccggcagtcgagagtggacgggagc

SEQ ID NO: 71278 - DNA, 24 bp, Homo sapiens
cgttccgaagggacgggcgatggc

SEQ ID NO: 71279 - DNA, 20 bp, Homo sapiens
ctaactagttacgcgacccc

SEQ ID NO: 71280 - DNA, 21 bp, Homo sapiens
ctaactagttacgcgaccccc

SEQ ID NO: 71281 - DNA, 35 bp, Homo sapiens
ctaactagttacgcgacccccgagcggtcggcgtc

SEQ ID NO: 71282 - DNA, 36 bp, Homo sapiens
ctcctccgcataagcctgcgtcagattaaaacactg

SEQ ID NO: 71283 - DNA, 32 bp, Homo sapiens
ctggccggcctgaggcaaccccctctcctctt

SEQ ID NO: 71284 - DNA, 17 bp, Homo sapiens
ctgtctgagcgtcgctt

SEQ ID NO: 71285 - DNA, 30 bp, Homo sapiens
gaaagaagggcgtgtcgttggtgtgcgcgt

SEQ ID NO: 71286 - DNA, 28 bp, Homo sapiens
gaaagtcagccctcgacacaagggtttg

SEQ ID NO: 71287 - DNA, 29 bp, Homo sapiens
gaaagtcagccctcgacacaagggtttgt

SEQ ID NO: 71288 - DNA, 24 bp, Homo sapiens
gaagaacgcagctagctgcgagaa

SEQ ID NO: 71289 - DNA, 16 bp, Homo sapiens
gaatgattagaggtct

SEQ ID NO: 71290 - DNA, 17 bp, Homo sapiens
gaatgattagaggtctt

SEQ ID NO: 71291 - DNA, 28 bp, Homo sapiens
gaatgattagaggtcttggggccgaaac

SEQ ID NO: 71292 - DNA, 20 bp, Homo sapiens
gaccgatcccggagaagccg

SEQ ID NO: 71293 - DNA, 27 bp, Homo sapiens
gagaattaatgtgaattgcaggacaca

SEQ ID NO: 71294 - DNA, 36 bp, Homo sapiens; identical to SEQ ID NO: 58688

SEQ ID NO: 71295 - DNA, 37 bp, Homo sapiens
gaggtagtgacgaaaaataacaatacaggactctttc

SEQ ID NO: 71296 - DNA, 20 bp, Homo sapiens
gatatcatctcaacttagta

SEQ ID NO: 71297 - DNA, 23 bp, Homo sapiens
gcaatgaaggtgaaggccggcgc

SEQ ID NO: 71298 - DNA, 24 bp, Homo sapiens
gcagaacccaacctccgagcagta

SEQ ID NO: 71299 - DNA, 32 bp, Homo sapiens
gccgtcgccggcagtcgagagtggacgggagc

SEQ ID NO: 71300 - DNA, 19 bp, Homo sapiens
gcctgtctgagcgtcgctt

SEQ ID NO: 71301 - DNA, 23 bp, Homo sapiens
gcggtaacgcgaccgatcccgga

SEQ ID NO: 71302 - DNA, 24 bp, Homo sapiens
gctacgcctgtctgagcgtcgctt

SEQ ID NO: 71303 - DNA, 36 bp, Homo sapiens; identical to SEQ ID NO: 57008

SEQ ID NO: 71304 - DNA, 37 bp, Homo sapiens; identical to SEQ ID NO: 58533

SEQ ID NO: 71305 - DNA, 26 bp, Homo sapiens
gctgacacgctgtcctctggcgacct

SEQ ID NO: 71306 - DNA, 39 bp, Homo sapiens; identical to SEQ ID NO: 63022

SEQ ID NO: 71307 - DNA, 24 bp, Homo sapiens
gctggcgctctcgcagacccgacg

SEQ ID NO: 71308 - DNA, 25 bp, Homo sapiens
gctggcgctctcgcagacccgacgc

SEQ ID NO: 71309 - DNA, 26 bp, Homo sapiens
ggacatgtggcgtacggaagacccgc

SEQ ID NO: 71310 - DNA, 40 bp, Homo sapiens
ggagcctcggttggcctcggatagccggtcccccgcctgt

SEQ ID NO: 71311 - DNA, 39 bp, Homo sapiens; identical to SEQ ID NO: 56880

SEQ ID NO: 71312 - DNA, 40 bp, Homo sapiens
ggcagacagccctcgctgtcgcctccagtggttgtcgact

SEQ ID NO: 71313 - DNA, 27 bp, Homo sapiens
ggccggccgtccggccgcgtcggggcc

SEQ ID NO: 71314 - DNA, 24 bp, Homo sapiens
ggctacgcctgtctgagcgtcgct

SEQ ID NO: 71315 - DNA, 37 bp, Homo sapiens
gggcaccgcggtccgcctctcgctcgccgcccggacg

SEQ ID NO: 71316 - DNA, 25 bp, Homo sapiens
gggttcagatccccgaatccggagt

SEQ ID NO: 71317 - DNA, 33 bp, Homo sapiens; identical to SEQ ID NO: 58693

SEQ ID NO: 71318 - DNA, 35 bp, Homo sapiens
ggtagtgacgaaaaataacaatacaggactctttc

SEQ ID NO: 71319 - DNA, 31 bp, Homo sapiens
ggtcggcgtcccccaacttcttagagggaca

SEQ ID NO: 71320 - DNA, 22 bp, Homo sapiens
ggtgaaataccactactctgat

SEQ ID NO: 71321 - DNA, 32 bp, Homo sapiens
ggtgaacctgcggaaggatcattaacggagcc

SEQ ID NO: 71322 - DNA, 28 bp, Homo sapiens
ggtgtagaataagtgggaggcccccggc

SEQ ID NO: 71323 - DNA, 28 bp, Homo sapiens
gtacggaagacccgctccccggcgccgc

SEQ ID NO: 71324 - DNA, 29 bp, Homo sapiens
gtacggaagacccgctccccggcgccgct

SEQ ID NO: 71325 - DNA, 36 bp, Homo sapiens
gtagaataagtgggaggcccccggcgcccccccggt

SEQ ID NO: 71326 - DNA, 16 bp, Homo sapiens
gtagacgacctgcttc

SEQ ID NO: 71327 - DNA, 25 bp, Homo sapiens
gtcagccctcgacacaagggtttgt

SEQ ID NO: 71328 - DNA, 17 bp, Homo sapiens
gtcgtgagacaggttag

SEQ ID NO: 71329 - DNA, 20 bp, Homo sapiens
gtgaaataccactactctga

SEQ ID NO: 71330 - DNA, 17 bp, Homo sapiens
gtgaattgcaggacaca

SEQ ID NO: 71331 - DNA, 29 bp, Homo sapiens
gtgacgaaaaataacaatacaggactctt

SEQ ID NO: 71332 - DNA, 30 bp, Homo sapiens; identical to SEQ ID NO: 13341

SEQ ID NO: 71333 - DNA, 31 bp, Homo sapiens; identical to SEQ ID NO: 13648

SEQ ID NO: 71334 - DNA, 23 bp, Homo sapiens
gttccgaagggacgggcgatggc

SEQ ID NO: 71335 - DNA, 19 bp, Homo sapiens
taacaatacaggactcttt

SEQ ID NO: 71336 - DNA, 32 bp, Homo sapiens
tacccacacccacccaagaacagggtttgtta

SEQ ID NO: 71337 - DNA, 31 bp, Homo sapiens; identical to SEQ ID NO: 58699

SEQ ID NO: 71338 - DNA, 32 bp, Homo sapiens; identical to SEQ ID NO: 58700

SEQ ID NO: 71339 - DNA, 33 bp, Homo sapiens
tagtgacgaaaaataacaatacaggactctttc

SEQ ID NO: 71340 - DNA, 30 bp, Homo sapiens; identical to SEQ ID NO: 71173

SEQ ID NO: 71341 - DNA, 24 bp, Homo sapiens
tattgaaagtcagccctcgacaca

SEQ ID NO: 71342 - DNA, 33 bp, Homo sapiens; identical to SEQ ID NO: 6508

SEQ ID NO: 71343 - DNA, 37 bp, Homo sapiens
tccccggagtggggggttggccggagccgatcggctc

SEQ ID NO: 71344 - DNA, 18 bp, Homo sapiens
tcgacacaagggtttgtc

SEQ ID NO: 71345 - DNA, 33 bp, Homo sapiens; identical to SEQ ID NO: 71195

SEQ ID NO: 71346 - DNA, 29 bp, Homo sapiens
tgaaaagaactttgaagagagagttcaag

SEQ ID NO: 71347 - DNA, 26 bp, Homo sapiens
tgaatggatgaacgagattcccactg

SEQ ID NO: 71348 - DNA, 16 bp, Homo sapiens
tgaattgcaggacaca

SEQ ID NO: 71349 - DNA, 42 bp, Homo sapiens
tgcggccccgggttcctcccggggctacgcctgtctgagcgt

SEQ ID NO: 71350 - DNA, 17 bp, Homo sapiens
tgcgtcagattaaaaca

SEQ ID NO: 71351 - DNA, 40 bp, Homo sapiens
tggtgactctagataacctcgggccgatcgcacgcccccc

SEQ ID NO: 71352 - DNA, 16 bp, Homo sapiens
tgtctgagcgtcgctt

SEQ ID NO: 71353 - DNA, 43 bp, Homo sapiens
ttgcggccccgggttcctcccggggctacgcctgtctgagcgt

SEQ ID NO: 71354 - DNA, 31 bp, Homo sapiens; identical to SEQ ID NO: 21165

SEQ ID NO: 71355 - DNA, 32 bp, Homo sapiens; identical to SEQ ID NO: 21166

SEQ ID NO: 71356 - DNA, 38 bp, Homo sapiens
tttatccggtaaagcgaatgattagaggtcttggggcc

SEQ ID NO: 71357 - DNA, 43 bp, Homo sapiens
tttatccggtaaagcgaatgattagaggtcttggggccgaaac

SEQ ID NO: 71358 - DNA, 30 bp, Homo sapiens; identical to SEQ ID NO: 52639

SEQ ID NO: 71359 - DNA, 30 bp, Homo sapiens
aaaaattttggtgcaactccaaataaaagt

SEQ ID NO: 71360 - DNA, 37 bp, Homo sapiens; identical to SEQ ID NO: 68717

SEQ ID NO: 71361 - DNA, 34 bp, Homo sapiens; identical to SEQ ID NO: 66170

SEQ ID NO: 71362 - DNA, 16 bp, Homo sapiens
aagagaaccaacacct

SEQ ID NO: 71363 - DNA, 36 bp, Homo sapiens; identical to SEQ ID NO: 66678

SEQ ID NO: 71364 - DNA, 32 bp, Homo sapiens; identical to SEQ ID NO: 68980

SEQ ID NO: 71365 - DNA, 36 bp, Homo sapiens; identical to SEQ ID NO: 68492

SEQ ID NO: 71366 - DNA, 33 bp, Homo sapiens; identical to SEQ ID NO: 66682

SEQ ID NO: 71367 - DNA, 20 bp, Homo sapiens
acccaacttacacttaggag

SEQ ID NO: 71368 - DNA, 30 bp, Homo sapiens
accgttaacttccaattaactagttttgac

SEQ ID NO: 71369 - DNA, 39 bp, Homo sapiens; identical to SEQ ID NO: 66190

SEQ ID NO: 71370 - DNA, 23 bp, Homo sapiens
acttaacttgaccgctctgacca

SEQ ID NO: 71371 - DNA, 23 bp, Homo sapiens
actttgtcaaagttaaattatag

SEQ ID NO: 71372 - DNA, 25 bp, Homo sapiens
actttgtcaaagttaaattataggc

SEQ ID NO: 71373 - DNA, 29 bp, Homo sapiens
agaccggggttcgattccccgacggggag

SEQ ID NO: 71374 - DNA, 30 bp, Homo sapiens
agaccggggttcgattccccgacggggagc

SEQ ID NO: 71375 - DNA, 30 bp, Homo sapiens; identical to SEQ ID NO: 66337

SEQ ID NO: 71376 - DNA, 28 bp, Homo sapiens
agatgaaaacctttttccaaggacacca

SEQ ID NO: 71377 - DNA, 20 bp, Homo sapiens
agatttcaacttaacttgac

SEQ ID NO: 71378 - DNA, 31 bp, Homo sapiens; identical to SEQ ID NO: 66411

SEQ ID NO: 71379 - DNA, 21 bp, Homo sapiens
agcttcaaacctgccggggct

SEQ ID NO: 71380 - DNA, 35 bp, Homo sapiens; identical to SEQ ID NO: 66592

SEQ ID NO: 71381 - DNA, 34 bp, Homo sapiens; identical to SEQ ID NO: 66593

SEQ ID NO: 71382 - DNA, 35 bp, Homo sapiens
aggcggcccgggttcgactcccggtgtgggaacca

SEQ ID NO: 71383 - DNA, 20 bp, Homo sapiens
agggatgggttcgattctca

SEQ ID NO: 71384 - DNA, 22 bp, Homo sapiens
agggatgggttcgattctcata

SEQ ID NO: 71385 - DNA, 25 bp, Homo sapiens
agggatgggttcgattctcatagtc

SEQ ID NO: 71386 - DNA, 32 bp, Homo sapiens
agggatgggttcgattctcatagtcctagcca

SEQ ID NO: 71387 - DNA, 28 bp, Homo sapiens
agtaagttgcaatacttaatttctgcca

SEQ ID NO: 71388 - DNA, 25 bp, Homo sapiens
agtggttaggattcggcgctctcac

SEQ ID NO: 71389 - DNA, 35 bp, Homo sapiens; identical to SEQ ID NO: 68532

SEQ ID NO: 71390 - DNA, 24 bp, Homo sapiens
agttgcaatacttaatttctgcca

SEQ ID NO: 71391 - DNA, 42 bp, Homo sapiens
ataatctgaaggtcgtgagttcgagcctcacacggggcacca

SEQ ID NO: 71392 - DNA, 27 bp, Homo sapiens
atagctcagtcggtagagcatcagact

SEQ ID NO: 71393 - DNA, 36 bp, Homo sapiens
atgaggtcccgggttcgatccccagcatctccacca

SEQ ID NO: 71394 - DNA, 19 bp, Homo sapiens
atggataaggcattggcct

SEQ ID NO: 71395 - DNA, 26 bp, Homo sapiens
atggttagcactctggactctgaatc

SEQ ID NO: 71396 - DNA, 39 bp, Homo sapiens; identical to SEQ ID NO: 68917

SEQ ID NO: 71397 - DNA, 26 bp, Homo sapiens
caaagcacccaacttacacttaggag

SEQ ID NO: 71398 - DNA, 22 bp, Homo sapiens
cactctggactctgaatccagc

SEQ ID NO: 71399 - DNA, 16 bp, Homo sapiens
cactgtaaagctaact

SEQ ID NO: 71400 - DNA, 36 bp, Homo sapiens
caggagatcctgggttcgaatcccagcggtgcctcc

SEQ ID NO: 71401 - DNA, 36 bp, Homo sapiens
caggcggcccgggttcgactcccggtgtgggaacca

SEQ ID NO: 71402 - DNA, 22 bp, Homo sapiens
cagggatgggttcgattctcat

SEQ ID NO: 71403 - DNA, 23 bp, Homo sapiens
cagggatgggttcgattctcata

SEQ ID NO: 71404 - DNA, 25 bp, Homo sapiens
cagggatgggttcgattctcatagt

SEQ ID NO: 71405 - DNA, 29 bp, Homo sapiens
cagtaagttgcaatacttaatttctgcca

SEQ ID NO: 71406 - DNA, 16 bp, Homo sapiens
cccaccttcgtcgcca

SEQ ID NO: 71407 - DNA, 38 bp, Homo sapiens
cccaggcggcccgggttcgactcccggtgtgggaacca

SEQ ID NO: 71408 - DNA, 33 bp, Homo sapiens
cccggctagctcagtcggtagagcatgagactc

SEQ ID NO: 71409 - DNA, 16 bp, Homo sapiens
cccggtcagggaacca

SEQ ID NO: 71410 - DNA, 16 bp, Homo sapiens
cccggtgtgggaacca

SEQ ID NO: 71411 - DNA, 33 bp, Homo sapiens; identical to SEQ ID NO: 68727

SEQ ID NO: 71412 - DNA, 31 bp, Homo sapiens
cctcagtaagttgcaatacttaatttctgcc

SEQ ID NO: 71413 - DNA, 32 bp, Homo sapiens
cctcagtaagttgcaatacttaatttctgcca

SEQ ID NO: 71414 - DNA, 16 bp, Homo sapiens
cctttttccaaggaca

SEQ ID NO: 71415 - DNA, 33 bp, Homo sapiens
cgaagaagcagcttcaaacctgccggggcttcc

SEQ ID NO: 71416 - DNA, 21 bp, Homo sapiens
cgactcccggtgtgggaacca

SEQ ID NO: 71417 - DNA, 19 bp, Homo sapiens
cgattccccgacggggagc

SEQ ID NO: 71418 - DNA, 21 bp, Homo sapiens
cgattccccgacggggagcca

SEQ ID NO: 71419 - DNA, 21 bp, Homo sapiens
cgattccttccttttttgcca

SEQ ID NO: 71420 - DNA, 38 bp, Homo sapiens
cgcgggaggcccgggttcgattcccggccaatgcacca

SEQ ID NO: 71421 - DNA, 32 bp, Homo sapiens
cggcccgggttcgactcccggtgtgggaacca

SEQ ID NO: 71422 - DNA, 27 bp, Homo sapiens
cgggttcgactcccggtgtgggaacca

SEQ ID NO: 71423 - DNA, 17 bp, Homo sapiens
cggttagctcagtcggc

SEQ ID NO: 71424 - DNA, 17 bp, Homo sapiens
cgtagtcgtggccgagt

SEQ ID NO: 71425 - DNA, 33 bp, Homo sapiens
ctaaagacaggggttaggcctctttttaccacc

SEQ ID NO: 71426 - DNA, 34 bp, Homo sapiens; identical to SEQ ID NO: 68688

SEQ ID NO: 71427 - DNA, 42 bp, Homo sapiens
ctaagccagggattgtgggttcgagtcccacccggggtacca

SEQ ID NO: 71428 - DNA, 42 bp, Homo sapiens
ctaagccagggattgtgggttcgagtcccatctggggtgcca

SEQ ID NO: 71429 - DNA, 16 bp, Homo sapiens
ctaatggataaggcac

SEQ ID NO: 71430 - DNA, 18 bp, Homo sapiens
ctaatggataaggcactg

SEQ ID NO: 71431 - DNA, 21 bp, Homo sapiens
ctcagggatgggttcgattct

SEQ ID NO: 71432 - DNA, 31 bp, Homo sapiens; identical to SEQ ID NO: 68261

SEQ ID NO: 71433 - DNA, 16 bp, Homo sapiens
ctcatagtcctagcca

SEQ ID NO: 71434 - DNA, 28 bp, Homo sapiens
cttagctgttaactaagtgtttgtgggt

SEQ ID NO: 71435 - DNA, 16 bp, Homo sapiens
ctttgtcaaagttaaa

SEQ ID NO: 71436 - DNA, 17 bp, Homo sapiens
gaaaatgttggttatac

SEQ ID NO: 71437 - DNA, 17 bp, Homo sapiens
gacaacagaggcttacg

SEQ ID NO: 71438 - DNA, 29 bp, Homo sapiens
gaccggggttcgattccccgacggggagc

SEQ ID NO: 71439 - DNA, 29 bp, Homo sapiens
gacgggctcacatcaccccataaacacca

SEQ ID NO: 71440 - DNA, 31 bp, Homo sapiens
gagaccggggttcgattccccgacggggagc

SEQ ID NO: 71441 - DNA, 16 bp, Homo sapiens
gagaggtcccgggttc

SEQ ID NO: 71442 - DNA, 25 bp, Homo sapiens
gatgaaaacctttttccaaggacac

SEQ ID NO: 71443 - DNA, 34 bp, Homo sapiens; identical to SEQ ID NO: 66589

SEQ ID NO: 71444 - DNA, 20 bp, Homo sapiens
gattccccgacggggagcca

SEQ ID NO: 71445 - DNA, 19 bp, Homo sapiens
gatttcaacttaacttgac

SEQ ID NO: 71446 - DNA, 30 bp, Homo sapiens; identical to SEQ ID NO: 66576

SEQ ID NO: 71447 - DNA, 37 bp, Homo sapiens
gcaaattcgaagaagcagcttcaaacctgccggggct

SEQ ID NO: 71448 - DNA, 23 bp, Homo sapiens
gcactctggactctgaatccagc

SEQ ID NO: 71449 - DNA, 34 bp, Homo sapiens; identical to SEQ ID NO: 66183

SEQ ID NO: 71450 - DNA, 34 bp, Homo sapiens; identical to SEQ ID NO: 66188

SEQ ID NO: 71451 - DNA, 19 bp, Homo sapiens
gcggttatcacgtctgctt

SEQ ID NO: 71452 - DNA, 27 bp, Homo sapiens
gctggtgtagtggtatcatgcaagatt

SEQ ID NO: 71453 - DNA, 47 bp, Homo sapiens
gctggtgtagtggtatcatgcaagattcccattcttgcgacccgggt

SEQ ID NO: 71454 - DNA, 46 bp, Homo sapiens; identical to SEQ ID NO: 68674

SEQ ID NO: 71455 - DNA, 34 bp, Homo sapiens; identical to SEQ ID NO: 68650

SEQ ID NO: 71456 - DNA, 34 bp, Homo sapiens; identical to SEQ ID NO: 68860

SEQ ID NO: 71457 - DNA, 30 bp, Homo sapiens; identical to SEQ ID NO: 66169

SEQ ID NO: 71458 - DNA, 22 bp, Homo sapiens
ggagatttcaacttaacttgac

SEQ ID NO: 71459 - DNA, 33 bp, Homo sapiens; identical to SEQ ID NO: 66570

SEQ ID NO: 71460 - DNA, 31 bp, Homo sapiens
ggcccgggttcgactcccggtgtgggaacca

SEQ ID NO: 71461 - DNA, 16 bp, Homo sapiens
ggctagctcagtcggc

SEQ ID NO: 71462 - DNA, 35 bp, Homo sapiens
gggagaccggggttcgattccccgacggggagcca

SEQ ID NO: 71463 - DNA, 24 bp, Homo sapiens
gggcccataccccgaaaatgttgg

SEQ ID NO: 71464 - DNA, 26 bp, Homo sapiens
gggcccataccccgaaaatgttggtt

SEQ ID NO: 71465 - DNA, 28 bp, Homo sapiens
gggcccataccccgaaaatgttggttat

SEQ ID NO: 71466 - DNA, 30 bp, Homo sapiens
gggcccataccccgaaaatgttggttatac

SEQ ID NO: 71467 - DNA, 35 bp, Homo sapiens
ggggattgtgggttcgagtcccatctgggtcgcca

SEQ ID NO: 71468 - DNA, 26 bp, Homo sapiens
ggggttcgattccccgacggggagcc

SEQ ID NO: 71469 - DNA, 26 bp, Homo sapiens
gggttcgactcccggtgtgggaacca

SEQ ID NO: 71470 - DNA, 28 bp, Homo sapiens
ggtggtctagtggttaggattcggcgct

SEQ ID NO: 71471 - DNA, 27 bp, Homo sapiens
ggtggttcagtggtagaattctcgcct

SEQ ID NO: 71472 - DNA, 17 bp, Homo sapiens
ggttaaggcgttggact

SEQ ID NO: 71473 - DNA, 20 bp, Homo sapiens
ggttaaggcgttggacttaa

SEQ ID NO: 71474 - DNA, 16 bp, Homo sapiens
ggttagctcagtcggc

SEQ ID NO: 71475 - DNA, 16 bp, Homo sapiens
ggttaggattcggcgc

SEQ ID NO: 71476 - DNA, 22 bp, Homo sapiens
ggttaggattcggcgctctcac

SEQ ID NO: 71477 - DNA, 22 bp, Homo sapiens
ggttaggcctctttttaccacc

SEQ ID NO: 71478 - DNA, 25 bp, Homo sapiens
ggttcgattccttccttttttgcca

SEQ ID NO: 71479 - DNA, 18 bp, Homo sapiens
ggttcgattctcatagtc

SEQ ID NO: 71480 - DNA, 25 bp, Homo sapiens
ggttgtagtccgtgcgagaatacca

SEQ ID NO: 71481 - DNA, 32 bp, Homo sapiens
gtagtcgtggccgagtggttaaggtgatggac

SEQ ID NO: 71482 - DNA, 21 bp, Homo sapiens
gtagtggttatcacgtctgct

SEQ ID NO: 71483 - DNA, 22 bp, Homo sapiens
gtagtggttatcacgtctgctt

SEQ ID NO: 71484 - DNA, 22 bp, Homo sapiens
gtagtggttatcacgttcgcct

SEQ ID NO: 71485 - DNA, 18 bp, Homo sapiens
gtccgtgcgagaatacca

SEQ ID NO: 71486 - DNA, 21 bp, Homo sapiens
gtcggtagagcatcagacttt

SEQ ID NO: 71487 - DNA, 25 bp, Homo sapiens
gtcgtggttgtagtccgtgcgagaa

SEQ ID NO: 71488 - DNA, 27 bp, Homo sapiens
gtcgtggttgtagtccgtgcgagaata

SEQ ID NO: 71489 - DNA, 29 bp, Homo sapiens
gtcgtggttgtagtccgtgcgagaatacc

SEQ ID NO: 71490 - DNA, 30 bp, Homo sapiens; identical to SEQ ID NO: 66551

SEQ ID NO: 71491 - DNA, 24 bp, Homo sapiens
gtctagtggttaggattcggcgct

SEQ ID NO: 71492 - DNA, 24 bp, Homo sapiens
gtgcaactccaaataaaagtacca

SEQ ID NO: 71493 - DNA, 16 bp, Homo sapiens
gtggagttaaagactt

SEQ ID NO: 71494 - DNA, 19 bp, Homo sapiens
gtggggttttgcagtcctt

SEQ ID NO: 71495 - DNA, 20 bp, Homo sapiens
gtggttaggattcggcgctc

SEQ ID NO: 71496 - DNA, 24 bp, Homo sapiens
gtggttaggattcggcgctctcac

SEQ ID NO: 71497 - DNA, 19 bp, Homo sapiens
gtggttatcacgtctgctt

SEQ ID NO: 71498 - DNA, 20 bp, Homo sapiens
gtggttatcacgtctgcttt

SEQ ID NO: 71499 - DNA, 21 bp, Homo sapiens
gtggttatcacgttcgcctca

SEQ ID NO: 71500 - DNA, 26 bp, Homo sapiens
gtggttcagtggtagaattctcgcct

SEQ ID NO: 71501 - DNA, 25 bp, Homo sapiens
gtggttgtagtccgtgcgagaatac

SEQ ID NO: 71502 - DNA, 26 bp, Homo sapiens
gtgtagtggttatcacgttcgcctca

SEQ ID NO: 71503 - DNA, 34 bp, Homo sapiens; identical to SEQ ID NO: 68771

SEQ ID NO: 71504 - DNA, 17 bp, Homo sapiens
gttaaagactttttctc

SEQ ID NO: 71505 - DNA, 19 bp, Homo sapiens
gttaaagactttttctctg

SEQ ID NO: 71506 - DNA, 22 bp, Homo sapiens
gttaaagactttttctctgacc

SEQ ID NO: 71507 - DNA, 23 bp, Homo sapiens
gttagcactctggactctgaatc

SEQ ID NO: 71508 - DNA, 16 bp, Homo sapiens
gttatcacgtctgctt

SEQ ID NO: 71509 - DNA, 21 bp, Homo sapiens
gttcaaatcccggacgagccc

SEQ ID NO: 71510 - DNA, 23 bp, Homo sapiens
gttcagtggtagaattctcgcct

SEQ ID NO: 71511 - DNA, 21 bp, Homo sapiens
gttcgactcccggtgtgggaa

SEQ ID NO: 71512 - DNA, 24 bp, Homo sapiens
gttcgactcccggtgtgggaacca

SEQ ID NO: 71513 - DNA, 24 bp, Homo sapiens
gttcgattccttccttttttgcca

SEQ ID NO: 71514 - DNA, 23 bp, Homo sapiens
gttgcaatacttaatttctgcca

SEQ ID NO: 71515 - DNA, 24 bp, Homo sapiens
gttgtagtccgtgcgagaatacca

SEQ ID NO: 71516 - DNA, 24 bp, Homo sapiens
gtttaagtcccattggtctagcca

SEQ ID NO: 71517 - DNA, 24 bp, Homo sapiens
gtttagacgggctcacatcacccc

SEQ ID NO: 71518 - DNA, 18 bp, Homo sapiens
gtttatgtagcttacctc

SEQ ID NO: 71519 - DNA, 32 bp, Homo sapiens; identical to SEQ ID NO: 66516

SEQ ID NO: 71520 - DNA, 16 bp, Homo sapiens
taaagactttttctct

SEQ ID NO: 71521 - DNA, 20 bp, Homo sapiens
taaagactttttctctgacc

SEQ ID NO: 71522 - DNA, 38 bp, Homo sapiens
taaagattaagagaaccaacacctctttacagtgacca

SEQ ID NO: 71523 - DNA, 31 bp, Homo sapiens
taagagaaccaacacctctttacagtgacca

SEQ ID NO: 71524 - DNA, 17 bp, Homo sapiens
taatggataaggcactg

SEQ ID NO: 71525 - DNA, 30 bp, Homo sapiens
tagacgggctcacatcaccccataaacacc

SEQ ID NO: 71526 - DNA, 31 bp, Homo sapiens; identical to SEQ ID NO: 66463

SEQ ID NO: 71527 - DNA, 27 bp, Homo sapiens
tagctcagtcggtagagcatgggactc

SEQ ID NO: 71528 - DNA, 33 bp, Homo sapiens
tagctgttaactaagtgtttgtgggtttaagtc

SEQ ID NO: 71529 - DNA, 38 bp, Homo sapiens
tagtggttaggattcggcgctctcaccgccgcggcccg

SEQ ID NO: 71530 - DNA, 24 bp, Homo sapiens
tagtggttagtactctgcgttgtg

SEQ ID NO: 71531 - DNA, 21 bp, Homo sapiens
tagtggttatcacgtctgctt

SEQ ID NO: 71532 - DNA, 22 bp, Homo sapiens
tagtggttatcacgtctgcttt

SEQ ID NO: 71533 - DNA, 26 bp, Homo sapiens
tcaacttaacttgaccgctctgacca

SEQ ID NO: 71534 - DNA, 26 bp, Homo sapiens
tcagggatgggttcgattctcatagt

SEQ ID NO: 71535 - DNA, 30 bp, Homo sapiens; identical to SEQ ID NO: 68852

SEQ ID NO: 71536 - DNA, 23 bp, Homo sapiens
tcagtcggtagagcatcagactt

SEQ ID NO: 71537 - DNA, 21 bp, Homo sapiens
tcagtggtagaattctcgcct

SEQ ID NO: 71538 - DNA, 16 bp, Homo sapiens
tcccggtgtgggaacc

SEQ ID NO: 71539 - DNA, 18 bp, Homo sapiens
tcgactcattaaattatg

SEQ ID NO: 71540 - DNA, 21 bp, Homo sapiens
tcgattccccgacggggagcc

SEQ ID NO: 71541 - DNA, 24 bp, Homo sapiens
tctaacaacatggctttctcacca

SEQ ID NO: 71542 - DNA, 17 bp, Homo sapiens
tctcatagtcctagcca

SEQ ID NO: 71543 - DNA, 19 bp, Homo sapiens
tctggactctgaatccagc

SEQ ID NO: 71544 - DNA, 28 bp, Homo sapiens
tctggactctgaatccagcgatccgagt

SEQ ID NO: 71545 - DNA, 29 bp, Homo sapiens
tctggactctgaatccagcgatccgagtt

SEQ ID NO: 71546 - DNA, 21 bp, Homo sapiens
tgcaatacttaatttctgcca

SEQ ID NO: 71547 - DNA, 24 bp, Homo sapiens
tggtggagttaaagactttttctc

SEQ ID NO: 71548 - DNA, 28 bp, Homo sapiens
tggtggagttaaagactttttctctgac

SEQ ID NO: 71549 - DNA, 29 bp, Homo sapiens
tggtggagttaaagactttttctctgacc

SEQ ID NO: 71550 - DNA, 30 bp, Homo sapiens
tggtggagttaaagactttttctctgacca

SEQ ID NO: 71551 - DNA, 16 bp, Homo sapiens
tggttagcactctgga

SEQ ID NO: 71552 - DNA, 17 bp, Homo sapiens
tggttaggattcggcgc

SEQ ID NO: 71553 - DNA, 19 bp, Homo sapiens
tggttaggattcggcgctc

SEQ ID NO: 71554 - DNA, 23 bp, Homo sapiens
tggttaggattcggcgctctcac

SEQ ID NO: 71555 - DNA, 24 bp, Homo sapiens
tggttaggattcggcgctctcacc

SEQ ID NO: 71556 - DNA, 19 bp, Homo sapiens
tggttatcacgtctgcttt

SEQ ID NO: 71557 - DNA, 17 bp, Homo sapiens
tgtagtccgtgcgagaa

SEQ ID NO: 71558 - DNA, 29 bp, Homo sapiens
tgtgggtttaagtcccattggtctagcca

SEQ ID NO: 71559 - DNA, 44 bp, Homo sapiens; identical to SEQ ID NO: 69007

SEQ ID NO: 71560 - DNA, 34 bp, Homo sapiens
tgtttccgtagtgtagtggttatcacgttcgcct

SEQ ID NO: 71561 - DNA, 33 bp, Homo sapiens; identical to SEQ ID NO: 68778

SEQ ID NO: 71562 - DNA, 32 bp, Homo sapiens
ttaagagaaccaacacctctttacagtgacca

SEQ ID NO: 71563 - DNA, 22 bp, Homo sapiens
ttaagtcccattggtctagcca

SEQ ID NO: 71564 - DNA, 44 bp, Homo sapiens
ttagaatcttagctttgggtgctaatggtggagttaaagacttt

SEQ ID NO: 71565 - DNA, 30 bp, Homo sapiens
ttagacgggctcacatcaccccataaacac

SEQ ID NO: 71566 - DNA, 32 bp, Homo sapiens; identical to SEQ ID NO: 67946

SEQ ID NO: 71567 - DNA, 26 bp, Homo sapiens
ttagcactctggactctgaatccagc

SEQ ID NO: 71568 - DNA, 37 bp, Homo sapiens
ttagcactctggactctgaatccagcgatccgagttc

SEQ ID NO: 71569 - DNA, 46 bp, Homo sapiens
ttagctttgggtgctaatggtggagttaaagactttttctctgacc

SEQ ID NO: 71570 - DNA, 21 bp, Homo sapiens
ttaggattcggcgctctcacc

SEQ ID NO: 71571 - DNA, 20 bp, Homo sapiens
ttaggcctctttttaccacc

SEQ ID NO: 71572 - DNA, 42 bp, Homo sapiens
ttcacccaggcggcccgggttcgactcccggtgtgggaacca

SEQ ID NO: 71573 - DNA, 23 bp, Homo sapiens
ttcgactcccggtgtgggaacca

SEQ ID NO: 71574 - DNA, 23 bp, Homo sapiens
ttcgattccccgacggggagcca

SEQ ID NO: 71575 - DNA, 16 bp, Homo sapiens
ttcggctgttaaccga

SEQ ID NO: 71576 - DNA, 44 bp, Homo sapiens
ttgaattgcaaattcgaagaagcagcttcaaacctgccggggct

SEQ ID NO: 71577 - DNA, 22 bp, Homo sapiens
ttgcaatacttaatttctgcca

SEQ ID NO: 71578 - DNA, 23 bp, Homo sapiens
ttgtagtccgtgcgagaatacca

SEQ ID NO: 71579 - DNA, 29 bp, Homo sapiens
ttgtgaatctgacaacagaggcttacgac

SEQ ID NO: 71580 - DNA, 24 bp, Homo sapiens
tttaagttaaagattaagagaacc

SEQ ID NO: 71581 - DNA, 29 bp, Homo sapiens
tttagacgggctcacatcaccccataaac

SEQ ID NO: 71582 - DNA, 31 bp, Homo sapiens
tttagacgggctcacatcaccccataaacac

SEQ ID NO: 71583 - DNA, 33 bp, Homo sapiens
tttagacgggctcacatcaccccataaacacca

SEQ ID NO: 71584 - DNA, 28 bp, Homo sapiens
tttcaacttaacttgaccgctctgacca

SEQ ID NO: 71585 - DNA, 31 bp, Homo sapiens
tttgtgggtttaagtcccattggtctagcca

SEQ ID NO: 71586 - DNA, 44 bp, Homo sapiens
ttttcacccaggcggcccgggttcgactcccggtgtgggaacca

SEQ ID NO: 71587 - DNA, 32 bp, Homo sapiens
aaaatgttggttatacccttcccgtactacca

SEQ ID NO: 71588 - DNA, 20 bp, Homo sapiens
aaacccccttatttctacca

SEQ ID NO: 71589 - DNA, 22 bp, Homo sapiens
aacatcagattgtgaatctgac

SEQ ID NO: 71590 - DNA, 18 bp, Homo sapiens
aacatggctttctcacca

SEQ ID NO: 71591 - DNA, 19 bp, Homo sapiens
aacccccttatttctacca

SEQ ID NO: 71592 - DNA, 31 bp, Homo sapiens
aagaagcagcttcaaacctgccggggcttcc

SEQ ID NO: 71593 - DNA, 31 bp, Homo sapiens; identical to SEQ ID NO: 68549

SEQ ID NO: 71594 - DNA, 19 bp, Homo sapiens
aagactttttctctgacca

SEQ ID NO: 71595 - DNA, 36 bp, Homo sapiens; identical to SEQ ID NO: 66678

SEQ ID NO: 71596 - DNA, 20 bp, Homo sapiens
aagtcccattggtctagcca

SEQ ID NO: 71597 - DNA, 35 bp, Homo sapiens
aagtgtttgtgggtttaagtcccattggtctagcc

SEQ ID NO: 71598 - DNA, 36 bp, Homo sapiens; identical to SEQ ID NO: 68492

SEQ ID NO: 71599 - DNA, 24 bp, Homo sapiens
aatggctgagtgaagcattggact

SEQ ID NO: 71600 - DNA, 32 bp, Homo sapiens
aatggtggagttaaagactttttctctgacca

SEQ ID NO: 71601 - DNA, 18 bp, Homo sapiens
aatgtttagacgggctca

SEQ ID NO: 71602 - DNA, 19 bp, Homo sapiens
aatgtttagacgggctcac

SEQ ID NO: 71603 - DNA, 17 bp, Homo sapiens
acgaatgatttcgactc

SEQ ID NO: 71604 - DNA, 33 bp, Homo sapiens
acgatggtttttcatatcattggtcgtggttgt

SEQ ID NO: 71605 - DNA, 22 bp, Homo sapiens
actctgaatccagcgatccgag

SEQ ID NO: 71606 - DNA, 21 bp, Homo sapiens
actctggactctgaatccagc

SEQ ID NO: 71607 - DNA, 16 bp, Homo sapiens
actttttctctgacca

SEQ ID NO: 71608 - DNA, 36 bp, Homo sapiens
agaagattgagggttcgagtcccttcgtggtcgcca

SEQ ID NO: 71609 - DNA, 18 bp, Homo sapiens
agactttttctctgacca

SEQ ID NO: 71610 - DNA, 33 bp, Homo sapiens
agattgagggttcgagtcccttcgtggtcgcca

SEQ ID NO: 71611 - DNA, 18 bp, Homo sapiens
agattgtgaatctgacaa

SEQ ID NO: 71612 - DNA, 19 bp, Homo sapiens
agattgtgaatctgacaac

SEQ ID NO: 71613 - DNA, 24 bp, Homo sapiens
agctcagtcggtagagcatgagac

SEQ ID NO: 71614 - DNA, 26 bp, Homo sapiens
agctcagtcggtagagcatgagactc

SEQ ID NO: 71615 - DNA, 33 bp, Homo sapiens
aggagatttcaacttaacttgaccgctctgacc

SEQ ID NO: 71616 - DNA, 34 bp, Homo sapiens; identical to SEQ ID NO: 66593

SEQ ID NO: 71617 - DNA, 33 bp, Homo sapiens
agtaccgttaacttccaattaactagttttgac

SEQ ID NO: 71618 - DNA, 19 bp, Homo sapiens
agtcccattggtctagcca

SEQ ID NO: 71619 - DNA, 35 bp, Homo sapiens; identical to SEQ ID NO: 68532

SEQ ID NO: 71620 - DNA, 16 bp, Homo sapiens
ataagctatcgggccc

SEQ ID NO: 71621 - DNA, 20 bp, Homo sapiens
atacccttcccgtactacca

SEQ ID NO: 71622 - DNA, 18 bp, Homo sapiens
atagtaccgttaacttcc

SEQ ID NO: 71623 - DNA, 34 bp, Homo sapiens; identical to SEQ ID NO: 68892

SEQ ID NO: 71624 - DNA, 35 bp, Homo sapiens
atatcattggtcgtggttgtagtccgtgcgagaat

SEQ ID NO: 71625 - DNA, 24 bp, Homo sapiens
atgaaaacctttttccaaggacac

SEQ ID NO: 71626 - DNA, 33 bp, Homo sapiens
atgggtggttcagtggtagaattctcgcctgcc

SEQ ID NO: 71627 - DNA, 34 bp, Homo sapiens
atgggtggttcagtggtagaattctcgcctgcca

SEQ ID NO: 71628 - DNA, 30 bp, Homo sapiens
atggtggagttaaagactttttctctgacc

SEQ ID NO: 71629 - DNA, 31 bp, Homo sapiens
atggtggagttaaagactttttctctgacca

SEQ ID NO: 71630 - DNA, 21 bp, Homo sapiens
atggttagcactctggactct

SEQ ID NO: 71631 - DNA, 17 bp, Homo sapiens
atgtttagacgggctca

SEQ ID NO: 71632 - DNA, 18 bp, Homo sapiens
atgtttagacgggctcac

SEQ ID NO: 71633 - DNA, 20 bp, Homo sapiens
atgtttagacgggctcacat

SEQ ID NO: 71634 - DNA, 30 bp, Homo sapiens
atgtttagacgggctcacatcaccccataa

SEQ ID NO: 71635 - DNA, 31 bp, Homo sapiens
attaaattatgataatcatatttaccaacca

SEQ ID NO: 71636 - DNA, 16 bp, Homo sapiens
attagaatcttagctt

SEQ ID NO: 71637 - DNA, 18 bp, Homo sapiens
attcaaaaaagagtacca

SEQ ID NO: 71638 - DNA, 17 bp, Homo sapiens
attggactgtaaatcta

SEQ ID NO: 71639 - DNA, 32 bp, Homo sapiens
attggtggttcagtggtagaattctcgcctgc

SEQ ID NO: 71640 - DNA, 33 bp, Homo sapiens
attggtggttcagtggtagaattctcgcctgcc

SEQ ID NO: 71641 - DNA, 34 bp, Homo sapiens
attggtggttcagtggtagaattctcgcctgcca

SEQ ID NO: 71642 - DNA, 29 bp, Homo sapiens
caatacactgaaaatgtttagacgggctc

SEQ ID NO: 71643 - DNA, 21 bp, Homo sapiens
cacatcaccccataaacacca

SEQ ID NO: 71644 - DNA, 16 bp, Homo sapiens
caccccataaacacca

SEQ ID NO: 71645 - DNA, 31 bp, Homo sapiens
cagagtggcgcagcggaagcgtgctgggccc

SEQ ID NO: 71646 - DNA, 22 bp, Homo sapiens
cagctaaataagctatcgggcc

SEQ ID NO: 71647 - DNA, 29 bp, Homo sapiens
cagtaagttgcaatacttaatttctgcca

SEQ ID NO: 71648 - DNA, 21 bp, Homo sapiens
cagtggtagaattctcgcctc

SEQ ID NO: 71649 - DNA, 22 bp, Homo sapiens
cagtggtagaattctcgcctcc

SEQ ID NO: 71650 - DNA, 19 bp, Homo sapiens
cattcaaaaaagagtacca

SEQ ID NO: 71651 - DNA, 34 bp, Homo sapiens
cattggtggttcagtggtagaattctcgcctgcc

SEQ ID NO: 71652 - DNA, 35 bp, Homo sapiens
cattggtggttcagtggtagaattctcgcctgcca

SEQ ID NO: 71653 - DNA, 34 bp, Homo sapiens
ccacatggtctagcggttaggattcctggttttc

SEQ ID NO: 71654 - DNA, 35 bp, Homo sapiens
ccacatggtctagcggttaggattcctggttttca

SEQ ID NO: 71655 - DNA, 41 bp, Homo sapiens
ccattcttgcgacccgggttcgattcccgggcggcgcacca

SEQ ID NO: 71656 - DNA, 16 bp, Homo sapiens
cccagtagagcctcca

SEQ ID NO: 71657 - DNA, 16 bp, Homo sapiens
cccattggtctagcca

SEQ ID NO: 71658 - DNA, 16 bp, Homo sapiens
cccccttatttctacc

SEQ ID NO: 71659 - DNA, 17 bp, Homo sapiens
cccccttatttctacca

SEQ ID NO: 71660 - DNA, 16 bp, Homo sapiens
ccccttatttctacca

SEQ ID NO: 71661 - DNA, 16 bp, Homo sapiens
cccggcggagtcgcca

SEQ ID NO: 71662 - DNA, 34 bp, Homo sapiens
cccggctagctcagtcggtagagcatgagactct

SEQ ID NO: 71663 - DNA, 34 bp, Homo sapiens
cccggctagctcagtcggtagagcatgggactct

SEQ ID NO: 71664 - DNA, 34 bp, Homo sapiens
ccctggtggtctagtggttaggattcggcgctct

SEQ ID NO: 71665 - DNA, 35 bp, Homo sapiens
ccctggtggtctagtggttaggattcggcgctctc

SEQ ID NO: 71666 - DNA, 16 bp, Homo sapiens
ccctgttcaggcacca

SEQ ID NO: 71667 - DNA, 32 bp, Homo sapiens
ccgctggtgtagtggtatcatgcaagattccc

SEQ ID NO: 71668 - DNA, 33 bp, Homo sapiens
ccggctagctcagtcggtagagcatgagactct

SEQ ID NO: 71669 - DNA, 34 bp, Homo sapiens
ccggctagctcagtcggtagagcatgagactctt

SEQ ID NO: 71670 - DNA, 33 bp, Homo sapiens
ccggctagctcagtcggtagagcatgggactct

SEQ ID NO: 71671 - DNA, 34 bp, Homo sapiens
ccggctagctcagtcggtagagcatgggactctt

SEQ ID NO: 71672 - DNA, 29 bp, Homo sapiens
ccggggttcgattccccgacggggagcca

SEQ ID NO: 71673 - DNA, 29 bp, Homo sapiens
ccgttaacttccaattaactagttttgac

SEQ ID NO: 71674 - DNA, 32 bp, Homo sapiens; identical to SEQ ID NO: 71413

SEQ ID NO: 71675 - DNA, 34 bp, Homo sapiens
cctggtggtctagtggctaggattcggcgctttc

SEQ ID NO: 71676 - DNA, 26 bp, Homo sapiens
cctggtggtctagtggttaggattcg

SEQ ID NO: 71677 - DNA, 33 bp, Homo sapiens
cctggtggtctagtggttaggattcggcgctct

SEQ ID NO: 71678 - DNA, 34 bp, Homo sapiens
cctggtggtctagtggttaggattcggcgctctc

SEQ ID NO: 71679 - DNA, 37 bp, Homo sapiens
cctggtggtctagtggttaggattcggcgctctcacc

SEQ ID NO: 71680 - DNA, 28 bp, Homo sapiens
cggagatgaaaacctttttccaaggaca

SEQ ID NO: 71681 - DNA, 34 bp, Homo sapiens
cggatagctcagtcggtagagcatcagactttta

SEQ ID NO: 71682 - DNA, 32 bp, Homo sapiens
cggctagctcagtcggtagagcatgagactct

SEQ ID NO: 71683 - DNA, 33 bp, Homo sapiens
cggctagctcagtcggtagagcatgagactctt

SEQ ID NO: 71684 - DNA, 32 bp, Homo sapiens
cggctagctcagtcggtagagcatgggactct

SEQ ID NO: 71685 - DNA, 33 bp, Homo sapiens
cggctagctcagtcggtagagcatgggactctt

SEQ ID NO: 71686 - DNA, 27 bp, Homo sapiens
cgggctcacatcaccccataaacacca

SEQ ID NO: 71687 - DNA, 20 bp, Homo sapiens
cggtagagcatcagactttt

SEQ ID NO: 71688 - DNA, 21 bp, Homo sapiens
cggtagagcatcagactttta

SEQ ID NO: 71689 - DNA, 17 bp, Homo sapiens
cgtagtcgtggccgagt

SEQ ID NO: 71690 - DNA, 28 bp, Homo sapiens
cgttaacttccaattaactagttttgac

SEQ ID NO: 71691 - DNA, 33 bp, Homo sapiens
ctaatggtggagttaaagactttttctctgacc

SEQ ID NO: 71692 - DNA, 34 bp, Homo sapiens
ctaatggtggagttaaagactttttctctgacca

SEQ ID NO: 71693 - DNA, 31 bp, Homo sapiens; identical to SEQ ID NO: 68261

SEQ ID NO: 71694 - DNA, 25 bp, Homo sapiens
ctcagtcggtagagcatgagactct

SEQ ID NO: 71695 - DNA, 25 bp, Homo sapiens
ctcagtcggtagagcatgggactct

SEQ ID NO: 71696 - DNA, 18 bp, Homo sapiens
ctcccagtggggcctcca

SEQ ID NO: 71697 - DNA, 22 bp, Homo sapiens
ctccgaggtgattttcatattg

SEQ ID NO: 71698 - DNA, 34 bp, Homo sapiens
ctcgttagtatagtggtgagtatccccgcctgtc

SEQ ID NO: 71699 - DNA, 23 bp, Homo sapiens
ctgaaaatgtttagacgggctca

SEQ ID NO: 71700 - DNA, 18 bp, Homo sapiens
ctgagtgaagcattggac

SEQ ID NO: 71701 - DNA, 22 bp, Homo sapiens
ctgagtgaagcattggactgta

SEQ ID NO: 71702 - DNA, 33 bp, Homo sapiens
ctggtggtctagtggttaggattcggcgctctc

SEQ ID NO: 71703 - DNA, 22 bp, Homo sapiens
cttccaattaactagttttgac

SEQ ID NO: 71704 - DNA, 17 bp, Homo sapiens
cttgaccgctctgacca

SEQ ID NO: 71705 - DNA, 42 bp, Homo sapiens
ctttgggtgctaatggtggagttaaagactttttctctgacc

SEQ ID NO: 71706 - DNA, 43 bp, Homo sapiens
ctttgggtgctaatggtggagttaaagactttttctctgacca

SEQ ID NO: 71707 - DNA, 30 bp, Homo sapiens
gaaagctcacaagaactgctaactcatgcc

SEQ ID NO: 71708 - DNA, 33 bp, Homo sapiens
gaccacgtggcctaatggataaggcgtctgact

SEQ ID NO: 71709 - DNA, 24 bp, Homo sapiens
gactctgaatccagcgatccgagt

SEQ ID NO: 71710 - DNA, 31 bp, Homo sapiens
gagaatagtttaaattagaatcttagctttg

SEQ ID NO: 71711 - DNA, 16 bp, Homo sapiens
gagtgaagcattggac

SEQ ID NO: 71712 - DNA, 17 bp, Homo sapiens
gagtgaagcattggact

SEQ ID NO: 71713 - DNA, 19 bp, Homo sapiens
gagtgaagcattggactgt

SEQ ID NO: 71714 - DNA, 20 bp, Homo sapiens
gagtgaagcattggactgta

SEQ ID NO: 71715 - DNA, 21 bp, Homo sapiens
gagtgaagcattggactgtaa

SEQ ID NO: 71716 - DNA, 16 bp, Homo sapiens
gattgtgaatctgaca

SEQ ID NO: 71717 - DNA, 17 bp, Homo sapiens
gattgtgaatctgacaa

SEQ ID NO: 71718 - DNA, 32 bp, Homo sapiens
gcaatacactgaaaatgtttagacgggctcac

SEQ ID NO: 71719 - DNA, 23 bp, Homo sapiens
gcactctggactctgaatccagc

SEQ ID NO: 71720 - DNA, 23 bp, Homo sapiens
gcactctggactttgaatccagc

SEQ ID NO: 71721 - DNA, 32 bp, Homo sapiens
gcactggtggttcagtggtagaattctcgcct

SEQ ID NO: 71722 - DNA, 36 bp, Homo sapiens
gcattggtggttcagtggtagaattctcgcctgcca

SEQ ID NO: 71723 - DNA, 18 bp, Homo sapiens
gccccacgttgggcgcca

SEQ ID NO: 71724 - DNA, 34 bp, Homo sapiens; identical to SEQ ID NO: 66183

SEQ ID NO: 71725 - DNA, 32 bp, Homo sapiens
gccgctggtgtagtggtatcatgcaagattcc

SEQ ID NO: 71726 - DNA, 33 bp, Homo sapiens
gccgctggtgtagtggtatcatgcaagattccc

SEQ ID NO: 71727 - DNA, 21 bp, Homo sapiens
gctaaataagctatcgggccc

SEQ ID NO: 71728 - DNA, 23 bp, Homo sapiens
gctaaataagctatcgggcccat

SEQ ID NO: 71729 - DNA, 34 bp, Homo sapiens
gctaatggtggagttaaagactttttctctgacc

SEQ ID NO: 71730 - DNA, 35 bp, Homo sapiens
gctaatggtggagttaaagactttttctctgacca

SEQ ID NO: 71731 - DNA, 25 bp, Homo sapiens
gctcagtcggtagagcatgagactc

SEQ ID NO: 71732 - DNA, 19 bp, Homo sapiens
gctgagtgaagcattggac

SEQ ID NO: 71733 - DNA, 44 bp, Homo sapiens
gctttgggtgctaatggtggagttaaagactttttctctgacca

SEQ ID NO: 71734 - DNA, 25 bp, Homo sapiens
ggactctgaatccagcgatccgagt

SEQ ID NO: 71735 - DNA, 33 bp, Homo sapiens; identical to SEQ ID NO: 66570

SEQ ID NO: 71736 - DNA, 26 bp, Homo sapiens
ggagttaaagactttttctctgacca

SEQ ID NO: 71737 - DNA, 17 bp, Homo sapiens
ggattcggcgctttcac

SEQ ID NO: 71738 - DNA, 31 bp, Homo sapiens
ggctagctcagtcggtagagcatgagactct

SEQ ID NO: 71739 - DNA, 31 bp, Homo sapiens
ggctagctcagtcggtagagcatgggactct

SEQ ID NO: 71740 - DNA, 34 bp, Homo sapiens
ggctccatagctcaggggttagagcactggtctt

SEQ ID NO: 71741 - DNA, 33 bp, Homo sapiens
ggctcgttggtctaggggtatgattctcgcttc

SEQ ID NO: 71742 - DNA, 35 bp, Homo sapiens; identical to SEQ ID NO: 71462

SEQ ID NO: 71743 - DNA, 27 bp, Homo sapiens
ggggttcgattccccgacggggagcca

SEQ ID NO: 71744 - DNA, 39 bp, Homo sapiens; identical to SEQ ID NO: 69827

SEQ ID NO: 71745 - DNA, 29 bp, Homo sapiens
gggtgtgataggtggcacggagaattttg

SEQ ID NO: 71746 - DNA, 35 bp, Homo sapiens
ggtaaaatggctgagtgaagcattggactgtaaat

SEQ ID NO: 71747 - DNA, 38 bp, Homo sapiens
ggtgctaatggtggagttaaagactttttctctgacca

SEQ ID NO: 71748 - DNA, 25 bp, Homo sapiens
ggttcagtggtagaattctcgcctc

SEQ ID NO: 71749 - DNA, 29 bp, Homo sapiens
ggtttttcatatcattggtcgtggttgta

SEQ ID NO: 71750 - DNA, 24 bp, Homo sapiens
gtaatggttagcactctggactct

SEQ ID NO: 71751 - DNA, 37 bp, Homo sapiens
gtagaattctcgcctgccacgcgggaggcccgggttc

SEQ ID NO: 71752 - DNA, 32 bp, Homo sapiens; identical to SEQ ID NO: 71481

SEQ ID NO: 71753 - DNA, 33 bp, Homo sapiens
gtagtcgtggccgagtggttaaggtgatggact

SEQ ID NO: 71754 - DNA, 23 bp, Homo sapiens
gtagtggttatcacgttcgcctc

SEQ ID NO: 71755 - DNA, 23 bp, Homo sapiens
gtcaggatggccgagtggtctaa

SEQ ID NO: 71756 - DNA, 18 bp, Homo sapiens
gtcccattggtctagcca

SEQ ID NO: 71757 - DNA, 18 bp, Homo sapiens
gtccctgtccaggcgcca

SEQ ID NO: 71758 - DNA, 18 bp, Homo sapiens
gtccctgttcaggcacca

SEQ ID NO: 71759 - DNA, 21 bp, Homo sapiens
gtcggtagagcatcagacttt

SEQ ID NO: 71760 - DNA, 17 bp, Homo sapiens
gtgaagcattggactgt

SEQ ID NO: 71761 - DNA, 18 bp, Homo sapiens
gtgaagcattggactgta

SEQ ID NO: 71762 - DNA, 37 bp, Homo sapiens
gtgctaatggtggagttaaagactttttctctgacca

SEQ ID NO: 71763 - DNA, 27 bp, Homo sapiens
gtggagttaaagactttttctctgacc

SEQ ID NO: 71764 - DNA, 28 bp, Homo sapiens
gtggagttaaagactttttctctgacca

SEQ ID NO: 71765 - DNA, 16 bp, Homo sapiens
gtgggttcgaatccca

SEQ ID NO: 71766 - DNA, 16 bp, Homo sapiens
gtggtatgattctcgc

SEQ ID NO: 71767 - DNA, 20 bp, Homo sapiens
gtggttatcacgttcgcctc

SEQ ID NO: 71768 - DNA, 23 bp, Homo sapiens
gtgtagtggttatcacgttcgcc

SEQ ID NO: 71769 - DNA, 25 bp, Homo sapiens
gtgtagtggttatcacgttcgcctc

SEQ ID NO: 71770 - DNA, 34 bp, Homo sapiens; identical to SEQ ID NO: 68771

SEQ ID NO: 71771 - DNA, 24 bp, Homo sapiens
gttaaagattaagagaaccaacac

SEQ ID NO: 71772 - DNA, 35 bp, Homo sapiens
gttccatagtgtagtggttatcacgtctgctttac

SEQ ID NO: 71773 - DNA, 16 bp, Homo sapiens
gtttagacgggctcac

SEQ ID NO: 71774 - DNA, 17 bp, Homo sapiens
gtttagacgggctcaca

SEQ ID NO: 71775 - DNA, 18 bp, Homo sapiens
gtttagacgggctcacat

SEQ ID NO: 71776 - DNA, 17 bp, Homo sapiens
gtttatgtagcttacct

SEQ ID NO: 71777 - DNA, 32 bp, Homo sapiens; identical to SEQ ID NO: 66516

SEQ ID NO: 71778 - DNA, 30 bp, Homo sapiens
taaaatggctgagtgaagcattggactgta

SEQ ID NO: 71779 - DNA, 18 bp, Homo sapiens
taaaccggagatgaaaac

SEQ ID NO: 71780 - DNA, 38 bp, Homo sapiens; identical to SEQ ID NO: 71522

SEQ ID NO: 71781 - DNA, 25 bp, Homo sapiens
taacttccaattaactagttttgac

SEQ ID NO: 71782 - DNA, 31 bp, Homo sapiens; identical to SEQ ID NO: 71523

SEQ ID NO: 71783 - DNA, 16 bp, Homo sapiens
taagatggcagagccc

SEQ ID NO: 71784 - DNA, 18 bp, Homo sapiens
taaggtcagctaaataag

SEQ ID NO: 71785 - DNA, 29 bp, Homo sapiens
taaggtcagctaaataagctatcgggccc

SEQ ID NO: 71786 - DNA, 21 bp, Homo sapiens
taagtcccattggtctagcca

SEQ ID NO: 71787 - DNA, 37 bp, Homo sapiens
taagtgtttgtgggtttaagtcccattggtctagcca

SEQ ID NO: 71788 - DNA, 19 bp, Homo sapiens
taatctcagggtcgtgggt

SEQ ID NO: 71789 - DNA, 22 bp, Homo sapiens
taatggataaggcatcagcctc

SEQ ID NO: 71790 - DNA, 32 bp, Homo sapiens
taatggtggagttaaagactttttctctgacc

SEQ ID NO: 71791 - DNA, 33 bp, Homo sapiens
taatggtggagttaaagactttttctctgacca

SEQ ID NO: 71792 - DNA, 41 bp, Homo sapiens
taattcaaaggttgtgggttcgagtcccaccagagtcgcca

SEQ ID NO: 71793 - DNA, 31 bp, Homo sapiens
taccgttaacttccaattaactagttttgac

SEQ ID NO: 71794 - DNA, 38 bp, Homo sapiens
tagcggttaggattcctggttttcacccaggcggcccg

SEQ ID NO: 71795 - DNA, 27 bp, Homo sapiens
tagctcagtcggtagagcatgagactc

SEQ ID NO: 71796 - DNA, 28 bp, Homo sapiens
tagctcagtcggtagagcatgggactct

SEQ ID NO: 71797 - DNA, 27 bp, Homo sapiens
taggatggggtgtgataggtggcacgg

SEQ ID NO: 71798 - DNA, 29 bp, Homo sapiens
taggatggggtgtgataggtggcacggag

SEQ ID NO: 71799 - DNA, 31 bp, Homo sapiens
taggatggggtgtgataggtggcacggagaa

SEQ ID NO: 71800 - DNA, 36 bp, Homo sapiens
taggatggggtgtgataggtggcacggagaattttg

SEQ ID NO: 71801 - DNA, 37 bp, Homo sapiens
taggatggggtgtgataggtggcacggagaattttgg

SEQ ID NO: 71802 - DNA, 38 bp, Homo sapiens
taggatggggtgtgataggtggcacggagaattttgga

SEQ ID NO: 71803 - DNA, 39 bp, Homo sapiens
taggatggggtgtgataggtggcacggagaattttggat

SEQ ID NO: 71804 - DNA, 43 bp, Homo sapiens
taggatggggtgtgataggtggcacggagaattttggattctc

SEQ ID NO: 71805 - DNA, 44 bp, Homo sapiens
taggatggggtgtgataggtggcacggagaattttggattctca

SEQ ID NO: 71806 - DNA, 16 bp, Homo sapiens
tagtaccgttaacttc

SEQ ID NO: 71807 - DNA, 34 bp, Homo sapiens
tatcattggtcgtggttgtagtccgtgcgagaat

SEQ ID NO: 71808 - DNA, 36 bp, Homo sapiens
tatcattggtcgtggttgtagtccgtgcgagaatac

SEQ ID NO: 71809 - DNA, 20 bp, Homo sapiens
tatccattggtcttaggccc

SEQ ID NO: 71810 - DNA, 24 bp, Homo sapiens
tcacacgcgaaaggtccccggttt

SEQ ID NO: 71811 - DNA, 22 bp, Homo sapiens
tcacatcaccccataaacacca

SEQ ID NO: 71812 - DNA, 17 bp, Homo sapiens
tcaccccataaacacca

SEQ ID NO: 71813 - DNA, 41 bp, Homo sapiens; identical to SEQ ID NO: 66209

SEQ ID NO: 71814 - DNA, 26 bp, Homo sapiens
tcagctaaataagctatcgggcccat

SEQ ID NO: 71815 - DNA, 30 bp, Homo sapiens; identical to SEQ ID NO: 68852

SEQ ID NO: 71816 - DNA, 23 bp, Homo sapiens
tcagtcggtagagcatgagactc

SEQ ID NO: 71817 - DNA, 22 bp, Homo sapiens
tcagtggtagaattctcgcctg

SEQ ID NO: 71818 - DNA, 17 bp, Homo sapiens
tcccattggtctagcca

SEQ ID NO: 71819 - DNA, 33 bp, Homo sapiens
tccgtagtgtagtggttatcacgttcgcctcac

SEQ ID NO: 71820 - DNA, 17 bp, Homo sapiens
tcggctgttaaccgaaa

SEQ ID NO: 71821 - DNA, 17 bp, Homo sapiens
tctggactctgaatcca

SEQ ID NO: 71822 - DNA, 19 bp, Homo sapiens
tctggactctgaatccagc

SEQ ID NO: 71823 - DNA, 23 bp, Homo sapiens
tgaaaatgtttagacgggctcac

SEQ ID NO: 71824 - DNA, 17 bp, Homo sapiens
tgaagcattggactgta

SEQ ID NO: 71825 - DNA, 18 bp, Homo sapiens
tgaagcattggactgtaa

SEQ ID NO: 71826 - DNA, 20 bp, Homo sapiens
tgaatccagcgatccgagtt

SEQ ID NO: 71827 - DNA, 40 bp, Homo sapiens; identical to SEQ ID NO: 66578

SEQ ID NO: 71828 - DNA, 41 bp, Homo sapiens; identical to SEQ ID NO: 66294

SEQ ID NO: 71829 - DNA, 24 bp, Homo sapiens
tgacaacattcaaaaaagagtacc

SEQ ID NO: 71830 - DNA, 17 bp, Homo sapiens
tgagtgaagcattggac

SEQ ID NO: 71831 - DNA, 18 bp, Homo sapiens
tgagtgaagcattggact

SEQ ID NO: 71832 - DNA, 21 bp, Homo sapiens
tgagtgaagcattggactgta

SEQ ID NO: 71833 - DNA, 21 bp, Homo sapiens
tgcaatacttaatttctgcca

SEQ ID NO: 71834 - DNA, 35 bp, Homo sapiens
tgctaatggtggagttaaagactttttctctgacc

SEQ ID NO: 71835 - DNA, 36 bp, Homo sapiens
tgctaatggtggagttaaagactttttctctgacca

SEQ ID NO: 71836 - DNA, 17 bp, Homo sapiens
tggactctgaatccagc

SEQ ID NO: 71837 - DNA, 27 bp, Homo sapiens
tggactctgaatccagcgatccgagtt

SEQ ID NO: 71838 - DNA, 21 bp, Homo sapiens
tggctgagtgaagcattggac

SEQ ID NO: 71839 - DNA, 26 bp, Homo sapiens
tgggtttaagtcccattggtctagcc

SEQ ID NO: 71840 - DNA, 38 bp, Homo sapiens
tggtagaattctcgcctcccacgcgggagacccgggtt

SEQ ID NO: 71841 - DNA, 39 bp, Homo sapiens
tggtagaattctcgcctgccacgcgggaggcccgggttt

SEQ ID NO: 71842 - DNA, 33 bp, Homo sapiens
tggtgtaatggttagcactctggactttgaatc

SEQ ID NO: 71843 - DNA, 25 bp, Homo sapiens
tgtctaacaacatggctttctcacc

SEQ ID NO: 71844 - DNA, 16 bp, Homo sapiens
tgtttagacgggctca

SEQ ID NO: 71845 - DNA, 17 bp, Homo sapiens
tgtttagacgggctcac

SEQ ID NO: 71846 - DNA, 18 bp, Homo sapiens
tgtttagacgggctcaca

SEQ ID NO: 71847 - DNA, 19 bp, Homo sapiens
tgtttagacgggctcacat

SEQ ID NO: 71848 - DNA, 20 bp, Homo sapiens
tgtttagacgggctcacatc

SEQ ID NO: 71849 - DNA, 34 bp, Homo sapiens; identical to SEQ ID NO: 71560

SEQ ID NO: 71850 - DNA, 33 bp, Homo sapiens; identical to SEQ ID NO: 68778

SEQ ID NO: 71851 - DNA, 21 bp, Homo sapiens
ttaaagattaagagaaccaac

SEQ ID NO: 71852 - DNA, 32 bp, Homo sapiens
ttaactaagtgtttgtgggtttaagtcccatt

SEQ ID NO: 71853 - DNA, 26 bp, Homo sapiens
ttaacttccaattaactagttttgac

SEQ ID NO: 71854 - DNA, 32 bp, Homo sapiens; identical to SEQ ID NO: 71562

SEQ ID NO: 71855 - DNA, 16 bp, Homo sapiens
ttaagatggcagagcc

SEQ ID NO: 71856 - DNA, 17 bp, Homo sapiens
ttaagatggcagagccc

SEQ ID NO: 71857 - DNA, 42 bp, Homo sapiens
ttaatctcagggtcgtgggttcgagccccacgttgggcgcca

SEQ ID NO: 71858 - DNA, 21 bp, Homo sapiens
ttacacttaggagatttcaac

SEQ ID NO: 71859 - DNA, 16 bp, Homo sapiens
ttagacgggctcacat

SEQ ID NO: 71860 - DNA, 32 bp, Homo sapiens; identical to SEQ ID NO: 67946

SEQ ID NO: 71861 - DNA, 21 bp, Homo sapiens
ttccaattaactagttttgac

SEQ ID NO: 71862 - DNA, 34 bp, Homo sapiens
ttccatagtgtagtggttatcacgtctgctttac

SEQ ID NO: 71863 - DNA, 27 bp, Homo sapiens
ttccatggtgtaatggttagcactctg

SEQ ID NO: 71864 - DNA, 33 bp, Homo sapiens
ttccatggtgtaatggttagcactctggactct

SEQ ID NO: 71865 - DNA, 34 bp, Homo sapiens
ttccgtagtgtagcggttatcacattcgcctcac

SEQ ID NO: 71866 - DNA, 33 bp, Homo sapiens
ttccgtagtgtagtggttatcacgttcgcctca

SEQ ID NO: 71867 - DNA, 34 bp, Homo sapiens
ttccgtagtgtagtggttatcacgttcgcctcac

SEQ ID NO: 71868 - DNA, 35 bp, Homo sapiens
ttccgtagtgtagtggttatcacgttcgcctcaca

SEQ ID NO: 71869 - DNA, 16 bp, Homo sapiens
ttcggctgttaaccga

SEQ ID NO: 71870 - DNA, 17 bp, Homo sapiens
ttcggctgttaaccgaa

SEQ ID NO: 71871 - DNA, 34 bp, Homo sapiens
ttctgtagtgtagtggttatcacgttcgcctcac

SEQ ID NO: 71872 - DNA, 16 bp, Homo sapiens
ttggggggttcgattc

SEQ ID NO: 71873 - DNA, 21 bp, Homo sapiens
ttgggtgctaatggtggagtt

SEQ ID NO: 71874 - DNA, 29 bp, Homo sapiens
ttggtcgtggttgtagtccgtgcgagaat

SEQ ID NO: 71875 - DNA, 31 bp, Homo sapiens
ttggtcgtggttgtagtccgtgcgagaatac

SEQ ID NO: 71876 - DNA, 32 bp, Homo sapiens
ttggtggttcagtggtagaattctcgcctgcc

SEQ ID NO: 71877 - DNA, 23 bp, Homo sapiens
tttaagtcccattggtctagcca

SEQ ID NO: 71878 - DNA, 16 bp, Homo sapiens
tttagacgggctcaca

SEQ ID NO: 71879 - DNA, 17 bp, Homo sapiens
tttagacgggctcacat

SEQ ID NO: 71880 - DNA, 31 bp, Homo sapiens; identical to SEQ ID NO: 71585

SEQ ID NO: 71881 - DNA, 139 bp, Homo sapiens
ctccttcagcgtctacggccataccaccctgaacgcgcccgatctcgtctgatctcggaagctaagcagggtcgggcctggttagtacttggatgggagaccgcctgggaataccgggtgctgtaggctttttctttgg

SEQ ID NO: 71882 - DNA, 974 bp, Homo sapiens
cccataaacaaataggtttggtcctagcctttctattagctcttagtaagattacacatgcaagcatccccgttccagtgagttcaccctctaaatcaccacgatcaaaaggaacaagcatcaagcacgcagcaatgcagctcaaaacgcttagcctagccacacccccacgggaaacagcagtgattaacctttagcaataaacgaaagtttaactaagctatactaaccccagggttggtcaatttcgtgccagccaccgcggtcacacgattaacccaagtcaatagaagccggcgtaaagagtgttttagatcaccccctccccaataaagctaaaactcacctgagttgtaaaaaactccagttgacacaaaatagactacgaaagtggctttaacatatctgaacacacaatagctaagacccaaactgggattagataccccactatgcttagccctaaacctcaacagttaaatcaacaaaactgctcgccagaacactacgagccacagcttaaaactcaaaggacctggcggtgcttcatatccctctagaggagcctgttctgtaatcgataaaccccgatcaacctcaccacctcttgctcagcctatataccgccatcttcagcaaaccctgatgaaggctacaaagtaagcgcaagtacccacgtaaagacgttaggtcaaggtgtagcccatgaggtggcaagaaatgggctacattttctaccccagaaaactacgatagcccttatgaaacttaagggtcgaaggtggatttagcagtaaactaagagtagagtgcttagttgaacagggccctgaagcgcgtacacaccgcccgtcaccctcctcaagtatacttcaaaggacatttaactaaaacccctacgcatttatatagaggagacaagtcgtaacatggtaagtgtactggaaagtgcacttggacgaaccagagtgtag

SEQ ID NO: 71883 - DNA, 1579 bp, Homo sapiens
  misc_feature (1447)..(1447): n is a, c, g, or t
accgctctgagctaaacctagccccaaacccactccaccttactaccagacaaccttagccaaaccatttacccaaataaagtataggcgatagaaattgaaacctggcgcaatagatatagtaccgcaagggaaagatgaaaaattataaccaagcataatatagcaaggactaacccctataccttctgcataatgaattaactagaaataactttgcaaggagagccaaagctaagacccccgaaaccagacgagctacctaagaacagctaaaagagcacacccgtctatgtagcaaaatagtgggaagatttataggtagaggcgacaaacctaccgagcctggtgatagctggttgtccaagatagaatcttagttcaactttaaatttgcccacagaaccctctaaatccccttgtaaatttaactgttagtccaaagaggaacagctctttggacactaggaaaaaaccttgtagagagagtaaaaaatttaacacccatagtaggcctaaaagcagccaccaattaagaaagcgttcaagctcaacacccactacctaaaaaatcccaaacatataactgaactcctcacacccaattggaccaatctatcaccctatagaagaactaatgttagtataagtaacatgaaaacattctcctccgcataagcctgcgtcagattaaaacactgaactgacaattaacagcccaatatctacaatcaaccaacaagtcattattaccctcactgtcaacccaacacaggcatgctcataaggaaaggttaaaaaaagtaaaaggaactcggcaaatcttaccccgcctgtttaccaaaaacatcacctctagcatcaccagtattagaggcaccgcctgcccagtgacacatgtttaacggccgcggtaccctaaccgtgcaaaggtagcataatcacttgttccttaaatagggacctgtatgaatggctccacgagggttcagctgtctcttacttttaaccagtgaaattgacctgcccgtgaagaggcgggcataacacagcaagacgagaagaccctatggagctttaatttattaatgcaaacagtacctaacaaacccacaggtcctaaactaccaaacctgcattaaaaatttcggttggggcgacctcggagcagaacccaacctccgagcagtacatgctaagacttcaccagtcaaagcgaactactatactcaattgatccaataacttgaccaacggaacaagttaccctagggataacagcgcaatcctattctagagtccatatcaacaatagggtttacgacctcgatgttggatcaggacatcccgatggtgcagccgctattaaaggttcgtttgttcaacgattaaagtcctacgtgatctgagttcagaccggagtaatccaggtcggtttctatctacnttcaaattcctccctgtacgaaaggacaagagaaataaggcctacttcacaaagcgccttcccccgtaaatgatatcatctcaacttagtattatacccacacccacccaagaacagggtttgttaagatgg

SEQ ID NO: 71884 - DNA, 33351 bp, Homo sapiens
ccgccacctccctgggttcaagcgattctcctgcctcagcctcccgagtagctgggactacaggtgcccgccaccacgcccagctaatctttatacttttaatagagacggggtttcaccgtgtcggcccggatggtctcgatctcttgacctcgtgacccgcccgcctcggcctcccaaagtgctgggatgacaggcgtgagccactgagcccggccttctcttgacgtttaaactatgaagtcagtccagagaaacgcaataaatgtcaacggtgaggatggtgttgaggcagaagtaggaccacactttttcctatcttattcagttgataacaatatgacctaggtagtaatttcctatgtgcctacttatacacgagtacaaaagagtaaaacagagagactgctaaattaaagggtacgtgaagttcttcatagtaactccgtaaactggaacactgtcaaaaagcagcagctagtgaattgtttccatgtatttttctattatccaataagtgaactatgctattcctttccagtctcccaagcacttcttgtccccatcaccacttcggtgctcgaagaaaaagtaacaaatcaaggaacacaactaaagaaacacacacacaaaccaaagacaactacagcgtctgcaaaagtttgctagaagactgaaactgttgagtataaggatctggtattctacgatcatgagttcacttcagagtttgttcaagacatacgtttcgtaaggaaacatcttagttagaagttattcagcagtaggtaccatccctaagtatttttcaccaaattcgtgacaataaagagctatctaaccagaaaaattagcgagtaccggcaccatccatagggctttgtctttacgcttcattagcacttaccatgccttacaatgtctaggattgaccctgatagcatttcgaaaacaagctaatgctttgtccagttcttcagtgaagacaagctcacgccctaatgcgctataggcataagcatcatttggatccacttcgagagttctctggaagaattgaatcgcaatatcgtgttcccgttgcagaccgaaacagttccctgcagcacaccaggcctctggctggcgaatttttatccatgtctgtgaagtctttggacagaactgaaagagcaacctctttcggaggatgccaaagtgttgtagagtagatctccatgccttcgactctgtaattctcaatcctcctaacctctgagaattgtctttcagcttgcgtggactctgaaagtttacaataggcccttccgatttggcacagtacccaaccggtattgcagtggtgagaagctagatggctcaagatgctgatagcttctttgccgtggtaagaacacaaagctaaataacctttccccctttcacgaagaaggctcatcaagccttccgctgctgctttttgtagattaaaagcctgaatctgaggcgcgattgtggctattttcccttctgaaatgacggaagagtccaattttgtcacttccaggctatcacttatgttcggtggagttattgctcctttattagttttacttttggttcttctgtttgggattttaggtggaaacttcatttttaattttctcctattctcctcggttgtggagctgtcactagtcaagagtcgtgaatttcttcgaggcggtgcatttgggggagatgccatagtggggctcaatacctgaggtgttgcccttgtcggcggaccagaactttgtgtttttgcaaggactggagttacctttcggctctttcccctctgcgagaagacagacggtgttccggtttggccgattctggcaacaggcttttttgaaggggctccggtggatggcacgtcaatgacagacggtgtctcataccagtgcagttttgtcaatagggtccgtctccgggacttggggtttctaatggcaaaatgccaacacttggggttaatggactaacagctgctggtcctcctaataaacttcgaccagtttttggtttatgttgaacctgtttagatcatatggaagttcctgttcccagtgggacagtatcaggtgaaaggacagctgaatcgatagaagacactggggagtctgtattcaaggagtactttgaattggaagattctaaattccatccgtttcattcgacggtgtcctggggtgtttccgtaagaacggtctcgggctgtctgtgacataaactaggacgaggtccaagtgttgtggcgcaacacttggacaggcagttgctaaagctctctagagaggtgaatcaaaatgtttggtcaggatctggcttttcccccctatttcacatcatgattcaaagggacaccagaggaaaggatttcaacgaaggctcttttggtcacattctgatcctttggtaagccgatctgtcttgcaatatacatgtcccgacgatggaaggggaaagcgagctgaatcaccaaactcaggaacgataatatcatcgtggcttttctgcttatgaaacactccacccgataagatttgatccccttctgcaagcttgctgagatcaacacaacatttcgcaagcaggcatttgcattgcggggtagtacaactgtgtcctttcaagagtctatatgttttataggcctttcctgagcggtaagaacaggtcgccagtaagaacaaggcttcttctgagtgtacttctgcataaaggcgttctgcgggggaaaccgcatctcggtaggcatagtggtttagtgcttgccatatagcagcctggacgggtccctgcagcaccgccatcctcgaggctcaggcccactttctgcagtgccacaggcaccccccccccccccatagcggctccggcccggccagcctcggctcatttaaaggcaccagccgccgttaccgggggatgggggagtccgagacagaatgacttctttatcctgctgactctggaaagcccggcgccttgtgatccattgcaaaccgagagtcacctcgtgtttagaacacggatccactcccaagttcagtggggggatgtgaggggtgtggcaggtaggacgaaggactctcttccttctgattcggtctgcacagtggggcctagggctggagctctctccgtgcggaccgctgactccctctaccttgggttccctcggccccaccctggaacgccgggccttggcagattctggcccttcctggcccttcagtcgctgtcagaaaccccatctcatgctcggatgccccgagtgactgtggctcgcacctctccggaaacattggaaatctctcctctacgcgcggccacctgaaaccacaggagctcgggacacacgtgctttcgggagagaatgctgagagtctcttgccgactctctcttgacttgagttcttcgtgggtgcgtggttaagacgtagtgagaccagatgtattaactcaggccgggtgctggtggctcacgcctgtaaccccaacactttgggaggccgaggccgtaggatccctcgaggaatcgcctaaccctggggaggttgaggttgcagtgagtgagccatagttgtgtcactgtgctccagtctgggcgaaagacagaatgaggccctgccacaggcaggcaggcaggcaggcaggcagaaagacaacagctgtattatgttcttctcagggtaggaagcaaaaataacagaatacagcacttaattaatttttttttttcccttcggacggagtttcactcttggtgcccacgctggagtgcagtggcaccatctcggctcaccgcaacctccacctcccgcgttcaagcgattctcctgcctcagcctcctgagtagctgggattacagggaggagccaccacacccagctgattttgtattgttagtagagacggcatttctccatgtgggtcaggctggtctcgaactggcgaccccagtggatctgcccgccccggcctcccaaagtgctggggtgacaggcgtgagccatcgtgactggccggctacgtttatttatttatttttttaattattttacttttttttagttttccattttaatctatttatttatttacatttatttatttatttatttatttacttatttatttattttcgagacagactctcgctctgctgcccaggctggagtgcagcggcgtgatctcggctcactgcaagctccgcctcccgggttcacgccattctcctgcctcagcctcccaagtagctgggactacaggcgcccgccaccgtgcccggctaactttttgtattttgagtagagatggggtttcactgtggtagccaggatggtctcgatctcctgaccccgtgatccgtccacctcggcctcccaaagtgctgggatgacaggcgtgagccaccgcccccggcctatttatctatttattaactttgagtccaggttatgaaaccagttagtttttgtaattttttttttttttttttttttttgagacgaggtttcaccgtgttgccaaggcttggaccgagggatccaccggccctcggcctcccaaaagtgcggggatgacaggcgcgagcctaccgcgcccggaccccccctttccccttcccccgcttgtcttcccgacagacagtttcacggcagagcgtttggctggcgtgcttaaactcattctaaatagaaatttgggacgtcagcttctggcctcacggactctgagccgaggagtcccctggtctgtctatcacaggaccgtacacgtaaggaggagaaaaatcgtaacgttcaaagtcagtcattttgtgatacagaaatacacggattcacccaaaacacagaaagcagtcttttagaaatggccttagccctggtgtccgtgccagtgattcttttcggtttggaccttgactgagaggattcccagtcggtctctcgtctctggacggaagttccagatgatccgatgggtgggggacttaggctgcgtccccccaggagccctggtcgattagttgtggggatcgccttggagggcgcggtgacccactgtgctgtgggagcctccatccttccccccaccccctccccaggggatcccaattcattccgggctgacacgctcactggcaggcgtcgggcatcacctagcggtcactgttactctgaaaacggaggcctcacagaggaagggagcaccaggccgcctgcgcacagcctggggcaactgtgtcttctccaccgcccccgcccccacctccaagttcctccctcccttgttgcctaggaaatcgccactttgacgaccgggtctgattgacctttgatcaggcaaaaacgaacaaacagataaataaataaaataacacaaaagtaactaactaaataaaataagtcaatacaacccattacaatacaataagatacgatacgataggatgcgataggatacgataggatacaatacaatacgatacgatacaatacaatacaatacaatacaatacaatacaatacaatacaatacaatacgccgggcgcggtggctcatgcctgtcatcccgtcactttgggatgccgaggtggacgcatcacctgaagtcgggagttggagacaagcccgaccaacatggagaaatcccgtctcaattgaaaatacaaaactagccgggcgcggtggcacatgcctataatcccagctgctaggaaggctgaggcaggagaatcgcttgaacctgggaagcggaggttgcagtgagccgagattgcgccatcgcactccagtctgagcaacaagagcgaaactccgtctcaaaaataaatacataaataaatacatacatacatacatacatacatacatacataaattaaaataaataaataaaataaaataaataaatgggccctgcgcggtggctcaagcctgtcatcccctcactttgggaggccaaggccggtggatcaagaggcggtcagaccaacagggccagtatggtgaaaccccgtctctactcacaatacacaacattagccgggcgctgtgctgtgctgtactgtctgtaatcccagctactcgggaggccgagctgaggcaggagaatcgcttgaacctgggaggcggaggttgcagtgagccgagatcgcgccactgcaacccagcctgggcgacagagcgagactccgtctccaaaaaatgaaaatgaaaatgaaacgcaacaaaataattaaaaagtgagtttctggggaaaaagaagaaaagaaaaaagaaaaaaacaacaaaacagaacaaccccaccgtgacatacacgtacgcctctcgcctttcgaggcctcaaacacgttaggaattatgcgtgatttctttttttaacttcattttatgttattatcatgattgatgtttcgagacggagtctcggaggcccgccctccctggttgcccagacaaccccgggagacagaccctggctgggcccgattgttcttctccttggtcaggggtttccttgtctttcttcgtgtctttaacccgcgtggactcttccgctcgggtttgacagatggcagctccactttaggccttgttgttgttggggactttcctgattctccccagatgtagtgaaagcaggtagatttgccttgcctggacttgcctggccttgccttttctttctttctttctttattactttctctttttcttcttcttcttcttcttcttcttcttcttcttcttcttcttcttcttctttttttttttgagacagagtttcactcttgttgcccaggctagagggcaatggtgcgatctcggctcaccgcaccctccgcctcccaggttcaagcgattctcctgcctcagcctcctgattagctgggattacaggcatgggccaccgtgcctggctgatgtttgtacttttagtagagacggtgtttttccatgttggtcaggctggtctcccactcccaacctcaggtggtccgcctgccttagcctcccaaagtgctgggatgacaggcgtgagccaccgcgcccagcctctctctctctctctctctctctctctctctctctctctctcgctcgcttgcttgcttgctttcgtgctttcttgctttcccgttttcttgctttctttctttctttcgtttctttcatgcttgctttcttgcttgcttgcttgctttcgtgctttcttgctttcctgttttctttctttctttctttcttttgtttctttcttgcttgctttcttgcttgcttgctttcgtgctttcttgttttctcgatttctttctttcttttgtttctttcctgcttgctttcttgcttgattgctttcgtgctttcttgctttcttgttttctttctttcttttgtttctttctttcttgcttccttgttttcttgctttcttgcttgcttgctttcgtgctttcttgttttcttgctttctttcttttgtttctttcttgcttgctttcttgcttccttgttttcttgctttcttgcttgcttgctttcgtgctttctttcttgctttcttttctttctttcttttctttttctttctttcttgctttcttttctttcattcattcattctttctttctttcctttctttctttctttctttctatctttctttctttctttctttctgtttcgtccttttgagacagagtttcactcttgtttccacggctagagtgcaatggcgcgatcttggctcaccgcaccttccgcctcccgggttcgagcgcttctcctgcctcagcctcccgattagcggggattacagggaggcacccccacgcctggcttggctgatgtttgtgtttttagtaggcacgccgtgtctctccatgttgctcaggctggtctccaactcccgacctcctgtgatgcgcccacctcggcctctcgaagtgctgggatgacgggcgtgagccaccgtgcccggcctgttgactcatttcgcttttttatttctttcgtttccacgcgtttacttatatgtattaatgtaaacgtttctgtacgcttatatgcaaacaacgacaacgtgtatctctgcattgaatactcttgcgtatggtaaatacgtatcggttgtatggaaatagacttctgtatgatagatgtaggtgtctgtgttatacaaataaatacacatcgctctataaagaagggatcgtcgataaagacgtttattttacgtatgaaaagcgtcgtatttatgtgtgtaaatgaacgagcgtacgtagttatctctgttttctttcttcctctccttcgtgtttttcttccttcctttcttcctttctctccttctttaggtttttcttcctctcttcctttccttctttctctctttctgtccttttttccttcgtgctttatttctctttcgttccctgtgtttccttcttttttctttcctctctgtttctttttcccttctttccttcgtttctttcctcattctttctctctttttcgtgtttctttccttcccgtctgtcttttaaaaaatggagtgtttcagaagtttactttgtgtatctacgttttctaaattgtctctcttttctccattgtcttcctccctccctccctccctccctccctgctcccttccctccctccttccctttcgccatctgtctcttttccccactcccctccccccgtctgtctctgcgtggattccggaagagcctacccattctgcctctccgtgtgtctgcagcgacccgcgaccgagtccttgtgtgttctttctccctccctcactccctccctccctccctccctgcttccgagaggcatctccaaacacccacgcgccgtgggttgtcttctgactctgtcgcggtcgaggcagagacgcgttttgggcaccgtttgtgtggggttggggcagaggggctgcgttttcggcctcgggaagagcttctcgactcacggtttcgctttcgcggtccacgggccgccctgccagccggatctgtctcgctgacgtccgcggcggttgtcgggctccatctggcggccgctttgagatcgtgctctcggcttccggagctgcggtggcagctgccgagggaggggaccgtccccgctgtgagctaggcagagctccggaaagcccgcggtcgtcagcccggctggcccggtggcgccagagctgtggcgcgtcgcttgtgagtcacagctctggcgtgcaggtttatgtgggggagaggctgtcgctgcgcttctgggcccgcggcgggcgtggggctgcccgggccggtcgaccagcgcgccgtagctcccgaggcccgagccgcgacccgcggggacccgccgcgcgtggcgcgggaggctggggacgcccttcccggcccggtcgcgggtccgcgctcatcctggccgtctgaggcggcggccgaattcgtttccgagtccccgtggggagccggggaccgtcccgcccccgtcccccgggtgccggggagcggtccccgggccgggccgcggtccctctgccgcgatcctttctggcgagtccccgtgcggagtcggagagcgctccctgagcgcgcgtgcggcccgagaggtcgcgcctggccggccttcggtccctcgtgtgtcccggtcgtaggaggggccggccgaaaatgcttccggctcccgctctggagacacgggccggccccctgcgtgtggcacgggcggccgggagggcgtccccggcccggcgctgctcccgcgtgtgtcctggggttgaccagagggccccgggcgctccgtgtgtggctgcgatggtggcgtttttggggacaggtgtccgtgtcgcgcgtcgcctgggccggcggcgtggtcggtgacgcgacctcccggccccgggggaggtatatctttcgctccgagtcggcattttgggccgccgggttattgctgacacgctgtcctctggcgacctgtcgctggagaggttgggcctccggatgcgcgcggggctctggcctaccggtgacccggctagccggccgcgctcctgcttgagccgcctgccggggcccgcgggcctgctgttctctcgcgcgtccgagcgtcccgactcccggtgccggcccgggtccgggtctctgacccacccgggggcggcggggaaggcggcgagggccaccgtgcccccgtgcgctctccgctgcgggcgcccggggcggccgcgacaaccccaccccgctggctccgtgccgtgcgtgtcaggcgttctcgtctccgcggggttgtccgccgccccttccccggagtggggggttggccggagccgatcggctcgctggccggccggccggcctccgctcccggggggctcttcgtgatcgatgtggtgacgtcgtgctctcccgggccgggtccgagccgcgacgggcgaggggcggacgttcgtggcgaacgggaccgtccttctcgctccgccccgcgggggtcccctcgtctctcctctccccgcccgccggcggtgcgtgtgggaaggcgtggggtgcggaccccggcccgacctcgccgtcccgcccgccgccttctgcgtcgcggggcgggccggcggggtcctctgacgcggcagacagccctcgctgtcgcctccagtggttgtcgacttgcgggcggcccccctccgcggcggtgggggtgccgtcccgccggcccgtcgtgctgccctctcggggggtttgcgcgagcgtcggctccgcctgggcccttgcggtgctcctggagcgctccgggttgtccctcaggtgcccgaggccgaacggtggtgtgtcgttcccgcccccggcgccccctcctccggtcgccgccgcggtgtccgcgcgtgggtcctgagggagctcgtcggtgtggggttcgaggcggtttgagtgagacgagacgagacgcgcccctcccacgcggggaagggcgcccgcctgctctcggtgagcgcacgtcccgtgctcccctctggcgggtgcgcgcgggccgtgtgagcgatcgcggtgggttcgggccggtgtgacgcgtgcgccggccggccgccgaggggctgccgttctgcctccgaccggtcgtgtgtgggttgacttcggaggcgctctgcctcggaaggaaggaggtgggtggacgggggggcctggtggggttgcgcgcacgcgcgcaccggccgggcccccgccctgaacgcgaacgctcgaggtggccgcgcgcaggtgtttcctcgtaccgcagggccccctcccttccccaggcgtccctcggcgcctctgcgggcccgaggaggagcggctggcgggtggggggagtgtgacccaccctcggtgagaaaagccttctctagcgatctgagaggcgtgccttgggggtaccggatcccccgggccgccgcctctgtctctgcctccgttatggtagcgctgccgtagcgacccgctcgcagaggaccctcctccgcttccccctcgacggggttgggggggagaagcgagggttccgccggccaccgcggtggtggccgagtgcggctcgtcgcctactgtggcccgcgcctcccccttccgagtcgggggaggatcccgccgggccgggcccggcgttcccagcgggttgggacgcggcggccggcgggcggtgggtgtgcgcgcccggcgctctgtccggcgcgtgaccccctccgccgcgagtcggctctccgcccgctcccgtgccgagtcgtgaccggtgccgacgaccgcgtttgcgtggcacggggtcgggcccgcctggccctgggaaagcgtcccacggtgggggcgcgccggtctcccggagcgggaccgggtcggaggatggacgagaatcacgagcgacggtggtgcgggcgtgtcgggttcgtggctgcggtcgctccggggcccccggtggcggggccccggggctcgcgaggcggttctcggtgggggccgagggccgtccggcgtcccaggcggggcgccgcgggaccgccctcgtgtctgtggcggtgggatcccgcggccgtgttttcctggtggcccggccgtgcctgaggtttctccccgagccgccgcctctgcgggctcccgggtgcccttgccctcgcggtccccggccctcgcccgtctgtgccctcttccccgcccgccgcccgccgatcctcttcttccccccgagcggctcaccggcttcacgtccgttggtggccccgcctgggaccgaacccggcaccgcctcgtggggcgccgccgccggccactgatcggcccggcgtccgcgtcccccggcgcgcgccttggggaccgggtcggtggcgccccgcgtggggcccggtgggcttcccggagggttccgggggtcggcctgcggcgcgtgcgggggaggagacggttccgggggaccggccgcgactgcggcggcggtggtgggggcagccgcggggatcgccgagggccggtcggccgccccgggtgccgcgcggtgccgccggcggcggtgaggccccgcgcgtgtgtcccggccgcggtcggccgcgctcgaggggtccccgtggcgtccccttccccgccggccgcctttctcgcgccttccccgtcgccccggcctcgcccgtggtctctcgtcttctcccggcccgctcttccgaaccgggtcggcgcgtcccccgggtgcgcctcgcttcccgggcctgccgcggcccttccccgaggcgtccgtcccgggcgtcggcgtcggggagagcccgtcctccccgcgtggcgtcgccccgttcggcgcgcgcgtgcgcccgagcgcggcccggtggtccctgccggacaggcgttcgtgcgacgtgtggcgtgggtcgacctccgccttgccggtcgctcgccctttccccgggtcggggggtggggcccgggccggggcctcggccccggtcgcggtcccccgtcccgggcgggggcgggcgcgccggccggcctcggtcggccctcccttggccgtcgtgtggcgtgtgccacccctgcgcccgcgcccgccggcggggctcggagccgggcttcggccgggccccgggccctcgaccggaccggtgcgcgggcgctgcggccgcacggcgcgactgtccccgggccgggcaccgcggtccgcctctcgctcgccgcccggacgtcggggccgccccgcggggcgggcggagcgccgtccccgcctcgccgccgcccgcgggcgccggccgcgcgcgcgcgcgcgtggccgccggtccctcccggccgccgggcgcgggtcgggccgtccgcctcctcgcgggcgggcgcgacgaagaagcgtcgcgggtctgtggcgcggggccccggtggtcgtgtcgcgtggggggcgggtggttggggcgtccggttcgccgcgccccgccccggccccaccggtcccggccgccgcccccgcgcccgctcgctccctcccgtccgcccgtccgcggcccgtccgtccgtccgtcgtcctcctcgcttgcggggcgccgggcccgtcctcgcgaggccccccggccggccgtccggccgcgtcggggcctcgccgcgctctaccttacctacctggttgatcctgccagtagcatatgcttgtctcaaagattaagccatgcatgtctgagtacgcacggccggtacagtgaaactgcgaatggctcattaaatcagttatggttcctttggtcgctcgctcctctcctacttggataactgtggtaattctagagctaatacatgccgacgggcgctgacccccttcgcgggggggatgcgtgcatttatcagatcaaaaccaacccggtcagcccctctccggccccggccggggggcgggcgccggcggctttggtgactctagataacctcgggccgatcgcacgccccccgtggcggcgacgacccattcgaacgtctgccctatcaactttcgatggtagtcgccgtgcctaccatggtgaccacgggtgacggggaatcagggttcgattccggagagggagcctgagaaacggctaccacatccaaggaaggcagcaggcgcgcaaattacccactcccgacccggggaggtagtgacgaaaaataacaatacaggactctttcgaggccctgtaattggaatgagtccactttaaatcctttaacgaggatccattggagggcaagtctggtgccagcagccgcggtaattccagctccaatagcgtatattaaagttgctgcagttaaaaagctcgtagttggatcttgggagcgggcgggcggtccgccgcgaggcgagccaccgcccgtccccgccccttgcctctcggcgccccctcgatgctcttagctgagtgtcccgcggggcccgaagcgtttactttgaaaaaattagagtgttcaaagcaggcccgagccgcctggataccgcagctaggaataatggaataggaccgcggttctattttgttggttttcggaactgaggccatgattaagagggacggccgggggcattcgtattgcgccgctagaggtgaaattcttggaccggcgcaagacggaccagagcgaaagcatttgccaagaatgttttcattaatcaagaacgaaagtcggaggttcgaagacgatcagataccgtcgtagttccgaccataaacgatgccgaccggcgatgcggcggcgttattcccatgacccgccgggcagcttccgggaaaccaaagtctttgggttccggggggagtatggttgcaaagctgaaacttaaaggaattgacggaagggcaccaccaggagtggagcctgcggcttaatttgactcaacacgggaaacctcacccggcccggacacggacaggattgacagattgatagctctttctcgattccgtgggtggtggtgcatggccgttcttagttggtggagcgatttgtctggttaattccgataacgaacgagactctggcatgctaactagttacgcgacccccgagcggtcggcgtcccccaacttcttagagggacaagtggcgttcagccacccgagattgagcaataacaggtctgtgatgcccttagatgtccggggctgcacgcgcgctacactgactggctcagcgtgtgcctaccctacgccggcaggcgcgggtaacccgttgaaccccattcgtgatggggatcggggattgcaattattccccatgaacgaggaattcccagtaagtgcgggtcataagcttgcgttgattaagtccctgccctttgtacacaccgcccgtcgctactaccgattggatggtttagtgaggccctcggatcggccccgccggggtcggcccacggccctggcggagcgctgagaagacggtcgaacttgactatctagaggaagtaaaagtcgtaacaaggtttccgtaggtgaacctgcggaaggatcattaacggagcccggagggcgaggcccgcggcggcgccgccgccgccgcgcgcttccctccgcacacccacccccccaccgcgacgcggcgcgtgcgcgggcggggcccgcgtgcccgttcgttcgctcgctcgttcgttcgccgcccggccccgccggccgcgagagccggagaactcgggagggagacgggggagagagagagagagagagaaagagaaagaagggcgtgtcgttggtgtgcgcgtgtcgtggggccggcgggcggcggggagcggtccccggccgcggccccgacgacgtgggtgtcggcgggcgcgggggcggttctcggcggcgtcgcggcgggtctgggggggtctcggtgccctcctccccgccggggcccgtcgtccggccccgccgcgccggctccccgtcttcggggccggccggattcccgtcgcctccgccgcgccgctccgcgccgccgggcacggccccgctcgctctccccggccttcccgctagggcgtctcgagggtcgggggccggacgccggtcccctcccccgcctcctcgtccgcccccccgccgtccaggtacctagcgcgttccggcgcggaggtttaaagaccccttggggggatcgcccgtccgcccgtgggtcgggggcggtggtgggcccgcgggggagtcccgtcgggaggggcccggcccctcccgcgcctccaccgcggactccgctccccggccggggccgcgccgccgccgccgccgcggcggccgtcgggtgggggctttacccggcggccgtcgcgcgcctgccgcgcgtgtggcgtgcgccccgcgccgtgggggcgggaacccccgggcgcctgtggggtggtgtccgcgctcgcccccgcgtgggcggcgcgcgcctccccgtggtgtgaaaccttccgacccctctccggagtccggtcccgtttgctgtctcgtctggccggcctgaggcaaccccctctcctcttgggcgggggggggggggacgtgccgcgccaggaagggcctcctcccggtgcgtcgtcgggagcgccctcgccaaatcgacctcgtacgactcttagcggtggatcactcggctcgtgcgtcgatgaagaacgcagctagctgcgagaattaatgtgaattgcaggacacattgatcatcgacacttcgaacgcacttgcggccccgggttcctcccggggctacgcctgtctgagcgtcgcttgccgatcaatcgcccccgggggtgcctccgggctcctcggggtgcgcggctgggggttccctcgcagggcccgccgggggccctccgtccccctaagcgcagacccggcggcgtccgccctcctcttgccgccgcgcccgccccttccccctccccccgcgggccctgcgtggtcacgcgtcgggtggcgggggggagaggggggcgcgcccggctgagagagacggggagggcggcgccgccgccgcccgcgaagacggagagggaaagagagagccggctcgggccgagttcccgtggccgccgcctgcggtccgggttcctccctcggggggctccctcgcgccgcgcgcggctcggggttcggggttcgtcggccccggccgggtggaaggtcccgtgcccgtcgtcgtcgtcgtcgtcgcgcgtcgtcggcggtgggggcgtgttgcgtgcggtgtggtggtgggggaggaggaaggcgggtccggaaggggaagggtgccggcggggagagagggtcgggggagcgcgtcccggtcgccgcggttcgccgcccgcccccggtggcggcccggcgtccggccgaccgccgctcccgcgcccctcctcctccccgccgcccctcctccgaggccccgcccgtcctcctcgccctccccgcgcgtacgcgcgcccgcccgcccggctcgcctcgcggcgcgtcggccggggccgggagcccgccccgcggcccgcccggccgcgcccgtggccgcggcgccggggttcgcgtgtccccggcggcgacccgcgggacgccgcggtgtcgtccgccgtcgcgcgcccgcctccggctcgcggccgcgccgcgccgcgccggggccccgtcccgagcttccgcgtcggggcggggcggctccgccgccgcgtcctcggacccgtccccccgacctccgcgggggagacgggtcggggcgtgcggcgcccgtcccgcccccggcccgtgcccctccctccggtcgtcccgctccggcggggcggcgcgggggtgccgccggccgcgcgctctctctcccgtcgcctctccccctcgccgggcccgtctcccgacggagcgtcgggcgggcggtcgggccggcgcgattccgtccgtccgtccgccgagcggcccgtccccctccgagacgcgacctcagatcagacgtggcgacccgctgaatttaagcatattagtcagcggaggagaagaaactaaccaggattccctcagtaacggcgagtgaacagggaagagcccagcgccgaatccccgccccgcggcggggcgcgggacatgtggcgtacggaagacccgctccccggcgccgctcgtggggggcccaagtccttctgatcgaggcccagcccgtggacggtgtgaggccggtagcggcccccggcgcgccgggcccgggtcttcccggagtcgggttgcttgggaatgcagcccaaagcgggtggtaaactccatctaaggctaaataccggcacgagaccgatagtcaacaagtaccgtaagggaaagttgaaaagaactttgaagagagagttcaagagggcgtgaaaccgttaagaggtaaacgggtggggtccgcgcagtccgcccggaggattcaacccggcggcgggtccggccgtgtcggcggcccggcggatctttcccgccccccgttcctcccgacccctccacccgccctcccttcccccgccgcccctcctcctcctccccggagggggcgggctccggcgggtgcgggggtgggcgggcggggccgggggtggggtcggcgggggaccgtcccccgaccggcgaccggccgccgccgggcgcatttccaccgcggcggtgcgccgcgaccggctccgggacggctgggaaggcccggcggggaaggtggctcggggggccccgtccgtccgtccgtccgtcctcctcctcccccgtctccgccccccggccccgcgtcctccctcgggagggcgcgcgggtcggggcggcggcggcggcggcggtggcggcggcggcggcggcggcgggaccgaaaccccccccgagtgttacagcccccccggcagcagcactcgccgaatcccggggccgagggagcgagacccgtcgccgcgctctcccccctcccggcgcccacccccgcggggaatcccccgcgaggggggtctcccccgcgggggcgcgccggcgtctcctcgtgggggggccgggccacccctcccacggcgcgaccgctctcccacccctcctccccgcgcccccgccccggcgacggggggggtgccgcgcgcgggtcggggggcggggcggactgtccccagtgcgccccgggcgggtcgcgccgtcgggcccgggggaggttctctcggggccacgcgcgcgtcccccgaagagggggacggcggagcgagcgcacggggtcggcggcgacgtcggctacccacccgacccgtcttgaaacacggaccaaggagtctaacacgtgcgcgagtcgggggctcgcacgaaagccgccgtggcgcaatgaaggtgaaggccggcgcgctcgccggccgaggtgggatcccgaggcctctccagtccgccgagggcgcaccaccggcccgtctcgcccgccgcgccggggaggtggagcacgagcgcacgtgttaggacccgaaagatggtgaactatgcctgggcagggcgaagccagaggaaactctggtggaggtccgtagcggtcctgacgtgcaaatcggtcgtccgacctgggtataggggcgaaagactaatcgaaccatctagtagctggttccctccgaagtttccctcaggatagctggcgctctcgcagacccgacgcacccccgccacgcagttttatccggtaaagcgaatgattagaggtcttggggccgaaacgatctcaacctattctcaaactttaaatgggtaagaagcccggctcgctggcgtggagccgggcgtggaatgcgagtgcctagtgggccacttttggtaagcagaactggcgctgcgggatgaaccgaacgccgggttaaggcgcccgatgccgacgctcatcagaccccagaaaaggtgttggttgatatagacagcaggacggtggccatggaagtcggaatccgctaaggagtgtgtaacaactcacctgccgaatcaactagccctgaaaatggatggcgctggagcgtcgggcccatacccggccgtcgccggcagtcgagagtggacgggagcggcgggggcggcgcgcgcgcgcgcgcgtgtggtgtgcgtcggagggcggcggcggcggcggcggcgggggtgtggggtccttcccccgcccccccccccacgcctcctcccctcctcccgcccacgccccgctccccgcccccggagccccgcggacgctacgccgcgacgagtaggagggccgctgcggtgagccttgaagcctagggcgcgggcccgggtggagccgccgcaggtgcagatcttggtggtagtagcaaatattcaaacgagaactttgaaggccgaagtggagaagggttccatgtgaacagcagttgaacatgggtcagtcggtcctgagagatgggcgagcgccgttccgaagggacgggcgatggcctccgttgccctcggccgatcgaaagggagtcgggttcagatccccgaatccggagtggcggagatgggcgccgcgaggcgtccagtgcggtaacgcgaccgatcccggagaagccggcgggagccccggggagagttctcttttctttgtgaagggcagggcgccctggaatgggttcgccccgagagaggggcccgtgccttggaaagcgtcgcggttccggcggcgtccggtgagctctcgctggcccttgaaaatccgggggagagggtgtaaatctcgcgccgggccgtacccatatccgcagcaggtctccaaggtgaacagcctctggcatgttggaacaatgtaggtaagggaagtcggcaagccggatccgtaacttcgggataaggattggctctaagggctgggtcggtcgggctggggcgcgaagcggggctgggcgcgcgccgcggctggacgaggcgccgccgccccccccacgcccggggcacccccctcgcggccctcccccgccccaccccgcgcgcgccgctcgctccctccccgccccgcgccctctctctctctctctcccccgctccccgtcctcccccctccccgggggagcgccgcgtgggggcggcggcggggggagaagggtcggggcggcaggggccggcggcggcccgccgcggggccccggcggcgggggcacggtcccccgcgaggggggcccgggcacccggggggccggcggcggcggcgactctggacgcgagccgggcccttcccgtggatcgccccagctgcggcgggcgtcgcggccgcccccggggagcccggcgggcgccggcgcgcccccccccccaccccacgtctcgtcgcgcgcgcgtccgctgggggcggggagcggtcgggcggcggcggtcggcgggcggcggggcggggcggttcgtccccccgccctacccccccggccccgtccgccccccgttcccccctcctcctcggcgcgcggcggcggcggcgggcggcggaggggccgcgggccggtcccccccgccgggtccgcccccggggccgcggttccgcgcggcgcctcgcctcggccggcgcctagcagccgacttagaactggtgcggaccaggggaatccgactgtttaattaaaacaaagcatcgcgaaggcccgcggcgggtgttgacgcgatgtgatttctgcccagtgctctgaatgtcaaagtgaagaaattcaatgaagcgcgggtaaacggcgggagtaactatgactctcttaaggtagccaaatgcctcgtcatctaattagtgacgcgcatgaatggatgaacgagattcccactgtccctacctactatccagcgaaaccacagccaagggaacgggcttggcggaatcagcggggaaagaagaccctgttgagcttgactctagtctggcacggtgaagagacatgagaggtgtagaataagtgggaggcccccggcgcccccccggtgtccccgcgaggggcccggggcggggtccgccggccctgcgggccgccggtgaaataccactactctgatcgttttttcactgacccggtgaggcgggggggcgagccccgaggggctctcgcttctggcgccaagcgcccggccgcgcgccggccgggcgcgacccgctccggggacagtgccaggtggggagtttgactggggcggtacacctgtcaaacggtaacgcaggtgtcctaaggcgagctcagggaggacagaaacctcccgtggagcagaagggcaaaagctcgcttgatcttgattttcagtacgaatacagaccgtgaaagcggggcctcacgatccttctgaccttttgggttttaagcaggaggtgtcagaaaagttaccacagggataactggcttgtggcggccaagcgttcatagcgacgtcgctttttgatccttcgatgtcggctcttcctatcattgtgaagcagaattcaccaagcgttggattgttcacccactaatagggaacgtgagctgggtttagaccgtcgtgagacaggttagttttaccctactgatgatgtgttgttgccatggtaatcctgctcagtacgagaggaaccgcaggttcagacatttggtgtatgtgcttggctgaggagccaatggggcgaagctaccatctgtgggattatgactgaacgcctctaagtcagaatcccgcccaggcggaacgatacggcagcgccgcggagcctcggttggcctcggatagccggtcccccgcctgtccccgccggcgggccgcccccccctccacgcgccccgcgcgcgcgggagggcgcgtgccccgccgcgcgccgggaccggggtccggtgcggagtgcccttcgtcctgggaaacggggcgcggctggaaaggcggccgccccctcgcccgtcacgcaccgcacgttcgtggggaacctggcgctaaaccattcgtagacgacctgcttctgggtcggggtttcgtacgtagcagagcagctccctcgctgcgatctattgaaagtcagccctcgacacaagggtttgtccgcgcgcgcgcgcgcgcgtgcgtgcggggggcccggcggggcgtgcgcgtccggcgccgtccgtccttccgttcgtcttcctccctcccggcctctcccgccgaccgcgggcgtggtggtgggggtgggggggagggcgcgcgaccccggtcggcgcgccccgcttcttcggttcccgcctcctccccgttcaccgccggggcggctcgtccgctccgggccgggacggggtccggggagcgtggtttgggagccgcggaggcggccgcgccgagccgggcccgtggcccgccggtccccgtcccgggggttggccgcgcgggccccggtggggcggccacccggggtcccggccctcgcgcgtccttcctcctcgctcctccgcacgggtcgaccagcagaccgcgggtggtgggcggcgggcggcgaggccccacggggcgtccgcgcacccggccgacctccgctcgtgacctctcctcggtcgggcctccggggtcgaccgcctgccgcccgcgggcgtgagactcagccggcgtctcgccgtgtcccgggtcgaccggcgggccttctccaccgagcggcgtgtaggagtgcccgtcgggacgaaccgcaaccggagcgtccccgtctcggtcggcacctccggggtcgaccagctgccgcccgcgagctccggacttagccggcgcctgcacgtgtcccgggtcgaccagcaggcggccgccggacgctgcggcgcaccgacgcgagggcgtcgattcccgttcgcgcgcccgcgacctccaccggcctcggcccgcggtggagctgggaccacgcggaactccctctctcacatttttttcagccccaccgcgagtttgcgtccgcgggacttttaagagggagtcactgctgccgtcagccagtaatgcttcctccttttttgcttttaggttttgtcttgcctttttttttttttttttttcttctttctttctttctttctttctttctttctttctttctttctttctttgccgctctcgctctctcgctctctccctctctcgttttctttctctttctctttctctctctctctctctctctctctctgtctctcgctctcgccctctctctctctctctttctctctgtctctctctgtctctctctctctctctctctctctctctctctctctctctctctctctctctccctccccctccctccctctctccccttccttggtgccttctcggctcttgacacttagccgctgtctcgccgtgtcccgggtcgaccggcgggccttctccaccgagcggcgtgtaagagtgcccgtcgggacgagccggacccgccgcgtccccgtctcggtcggcacctccggggtcgaccagctgccgcccgcgagctccggacttagctggcgtctgcacgtgtcccgggtcgaccagcaggcggccgccggacgctgcggcgcaccgacgcgagggcgtcgattccggttcacgcgccggcgacctccaccggcctcggcccgcggtggagctgggaccacgcggaactccctcttctacatttttttcagccccaccgcgagtttgcgtccgcgggacttttaagagggagtcactgctgccgtcagccagtaatgcttcctccttttttgcttttaggttttgtcttgccttttttttttttttttttttttctttctttctttctttctttctttctttctttctttctttctttctttctcgctctcgctctctcgctctctccctcgctcgttttctttctctttctctttctctctctctctctctctctctctctgtctctcgctctcgccctctctctctctctctttctctctgtctctctctgtctctctctctctctctctctctctctctctctctctctctctctctctctctccctccccctccctccctctctccccttccttggtgccttctcggctcttgacacttagccgctgtctcgccgtgtcccgggtcgaccggcgggccttctccaccgagcggcgtgtaagagtgcccgtcgggacgagccggacccgccgcgtccccgtctcggtcggcacctccggggtcgaccagctgccgcccgcgagctccggacttagctggcgtctgcacgtgtcccgggtcgaccagcaggcggccgccggacgctgcggcgcaccgacgcgagggcgtcgattccggttcacgcgccggcgacctccaccggcctcggcccgcggtggagctgggaccacgcggaactccctcttctacatttttttcagccccactgcgagtttgcgtccgcgggacttttaagagggagtcactgctgccgtcagccagtaatgcttcctccttttttgctttttggttttgccttgcgttttctttctttctttctttctttctttctttctttcttttctttctttctttctttctttctttctttctctctctctctctctctctctgtctctctcccctccctccctccttggtgccttctcggctcgctgctgctgctgcctctgcctccacggttcaagcaaacagcaagttttctatttcgagtaaagacgtaatttcaccattttggccgggctggtctcgaactcccgacctagtgatccgcccgcctcggcctcccaaagactgctgggagtacagatgtgagccaccatgcccggccgattccttccttttttcaatcttattttctgaacgctgccgtgtatgaacatacatctacacatacacacacacacacacacacacacacacacacacacacacacacacacacacacaccccccgtagtgataaaactatgtaaatgatatttccataattaatacgtttatattatgttacttttaatggatgaatatgtatcgaagccccatttcatttacatacacgtgtatgtatatccttcctcccttccttcattcattatttattaataattttcgtttatttattttcttttcttttggggccggcccgcctggtcttctgtctctgcgctctggtgacctcagcctcccaaatagctgggactacagggatctcttaagcccgggagggagaggttaacgtgggctgtgatcgcacacttccactccagcttacgtgggctgcggtggggtggggtgcagagaaaacgattgattgcgatctcaattgccttttagcttcattcataccctgttatttgctcgtttattctcatgggttcttctgtgtcattgtcacgttcatcgtttgcttgcctgcttgcctgtttatttccttccttccttccttccttccttccttccttccttccctccttccttccttccttccctcccttactggcagggtcttcctctgtctctgccgcccaggatcaccccaacctcaacgctttggaccgaccaaacggtcgttctgcctctgatccctcccatccccattacctgagactacaggcgcgcaccaccacaccggctgacttttatgttgtttctcatgttttccgtaggtaggtatgtgtgtgtgtgtgtgtgtgtgtgtgtgtgtgtgtgtgtgtgtgtgtgtatctatgtatgtatgtatgtatgtgagtgagatgggtttcggggttctatcatgttgcccacgctggtctcgaactcctgtcctcaagcaatccgcctgcctgcctcggccgcccacactgctgctattacaggcgtgagacgctgcgcctggctccttctacatttgcctgcctgcctgcctgcctgcctgcctgcctgcctgcctgcctgcctatcaatcgtcttctttttagtacggatgtgctctcgctttattgtccatgctctgggcacacgtggtctcttttcaaacttctatgattattattattgtaggcgtcatctcacgtgtcgaggtgatctcgaacttttaggctccagagatcctcccgcatcggcctcccggagtgctgtgatgacacgcgtgggcacggtacgctctggtcgtgtttgtcgtgggtcggttctttccgtttttaatacggggactgcgaacgaagaaaatttccagacgcatctcaccgatccgccttttcgttctttctttttattctctttagacggagtttcactcttgtcgcccagggtggagtacgatggcggctctcggctcaccgcaccctccgcctcccaggttcaagtgattctcctgcctcagccttcccgagtagctggaatgacagagatgagccatcgtgcccggctaatttttctatttttactacagatggggtttctccatcttggtcaggctggtcttcaacttccgaccgttggagaatcttaactttcttggtggtggttgttttcctttttcttttttttcttttcttttctttccttctcctccccccccacccccccttgtcgtcgtcctcctcctcctcctcctcctcctcctcctcctcctcctcctcctcctctttcatttctttcagctgggctctcctacgtgtgttgctctgttgctcacgctggtctcaaactcctggccttgacgcttctcccgtcacatccgccgtctggttgttgaaatgagcatctctcgtaaaatggaaaagatgaaagaaataaacacgaagacggaaagcacggtgtgaacgtttctcttgccgtctcccggggtgtaccttggacccggaaacacggagggagcttggctgagtgggttttcggtgccgaaacctcccgagggcctccttccctctcccccttgtccccgcttctcccccagccgaggctcccaccgccgccctggcattttccataggagaggtatgggagaggactgacacgccttccagatctatatcctgccggacgtctctggctcggcgtgccccaccggctacctgccaccttccagggagctctgaggcggatgcgacccccacccccccgtcacgtcccgctaccctcccccggctggcctttgccgggcgaccccaggggaaccgcgttgatgctgccttcggatcctccggcgaagacttccaccggatgccccgggtgggccggttgggatcagactggaccaccccggaccgtgctgttcttgggggtgggttgacgtacagggtggactggcagccccagcattgtaaagggtgcgtgggtatggaaatgtcacctaggatgccctccttcccttcggtctgccttcagctgcctcaggcgtgaagacaacttcccatcggaacctcttctcttccctttctccagcacacagatgagacgcacgagagggagaaacagctcaatagataccgctgaccttcatttgtggaatcctcagtcatcgacacacaagacaggtgactaggcagggacacagatcaaacactatttccgggtcctcgtggtgggattggtctctctctctctctctctctctctctctctcgcacgcgcacgcgcgcacacacacacacaatttccatatctagttcacagagcacactcacttccccttttcacagtacgcaggctgagtaaaacccgccccaccctccacccgttggctgacgaaaccccttctctacaattgatgaaaaagatgatctgggccgggcacgctagctcacgcctgtcactccggcactttgggaggccgaggcgggtggatcgcttggggccgggagttcgagaccaggctggccgacgtggcgaaaccccgtctctctgaaaaatagaacgattagccgggcctggtggcgtgggcttggaatcacgaccgctcgggagactggggcgggcgacttgttccaaccggggaggccgaggttgcgatgagctgagatcgtgccgtggcgatgcggcctggatgacggagcgagaccccgtctcgagagaatcatgatgttattataagatgagttgtgcgcggtgatggccgcctgtagtcgcggctactcgggaggctgagacgaggagaagatcacttgaggccccacaggtcgaggcttcggtcggccgtgacccactgtatcctgggcagtcaccggtcaaggagatatgccccttccccgtttgcttttcttttcttcccttctcttttcttctttttgcttctcttttctttctttctttctttctttctttctttctttttctttttctctcttcccctctttctttcctgccttcctgcctttcttcttttcttctttcctcccttcctcccttccttctttcctcccgcctcagcctcccaaagtgctgggatgactggcgggaggcaccatgcctgcttggcccaaagagaccctcttggaaagtgagacgcagagagcgccttccagtgatctcattgactgatttagagacggcatctcgctccgtcaccccggcagtggtgccgtcgtaactcactccctgcagcgtggacgctcctggactcgagcgatccttccacctcagcctccagagtacagagcctgggaccgcgggcacgcgccactgtgcccacaccgtttttaattgtttttttttcccccgagacagagtttcactctcgtggcctagactgcagtgcggtggcgcgatcttggctcaccgcaacctctgcctcccggtttcaagcgattctcctgcatcggcctcctgagtagccgggattgcgggcatgcgctgccacgtctggctgatttcgtatttttagtggagacggggcttctccatgtcgatcgggctggtttcgaactcccgacctcaggtgatccgccctccccggcctccggaagtgctgggatgacaggcgtgagccaccgcgcccggccttcatttttaaatgttttcccacagacggggtctcatcatttctttgcaaccctcctgcccggcgtctcaaagtgctggcgtgacgggcgtgagccactgcgcctggactccggggaatgactcacgaccaccatcgctctactgatcctttctttctttctttctttctttctttctttctttctttcttgatgaattatcttatgatttatttgtgtacttattttcagacggagtctcgctctgggcggggcgaggcgaggcgaggcacagcgcatcgctttggaagccgcggcaacgcctttcaaagccccattcgtatgcacagagccttattcccttcctggagttggagctgatgccttccgtagccttgggcttctctccattcggaagctttgacaggcgcaaccccacccagaggctggctgcggctgaggattagggggtgtgttggggctgaaaactgggtcccctatttttgatacctcagccgacacatcccccgaccgccatcgcttgctcgccctctgagatcccccgcctccaccgccttgcaggctcacctcttactttcatttcttcctttcttgcgtttgaggagggggtgcgggaatgagggtgtgtgtggggagggggtgcggggtggggacggaggggagcgtcctaagggtcgatttagtgtcatgcctctttcaccaccaccaccaccaccgaagatgacagcaaggatcggctaaataccgcgtgttctcatctagaagtgggaacttacagatgacagttcttgcatgggcagaacgagggggaccggggacgcggaagtctgcttgagggaggaggggtggaaggagagacagcttcaggaagaaaacaaaacacgaatactgtcggacacagcactgactacccgggtgatgaaatcatctgcacactgaacacccccgtcacaagtttacctatgtcacaatcttgcacatgtatgcttgaacgacaaataaaagttaggggggagaagagaggagagagagagagagagagagacagagagagacagagagagagagagaggagggagagagaaaacgaaacaccacctccttgacctgagtcagggggtttctggccttttgggagaacgttcagcgacaatgcagtatttgggcccgttctttttttttcttcttcttttctttctttttttttggactgagtctctctcgctctgtcacccaggctgcggtgcggtggcgctctctcggctcactgaaacctctgcttcccgggttccagtgattcttcttcggtagctgggattacaggcgcacaccatgacggccggctcatattcctattttcagtagagacggggtttctccacgttggccacgctggtctcgaactcctgacctcaaatgatccgccttcctgggcctcccaaagtgctggaaacgacaggcctgagccgccgggatttcagcctttaaaagcgcgggccctgccacctttcgctgtggcccttacgctcagaatgacgtgtcctctctgccgtaggttgactccttgagtcccctaggccattgcactgtagcctgggcagcaagagccaaactccgtccccccacctccccgcgcacataataactaactaacaaactaactaactaactaaactaactaaataaataaaatctctacacgtcacctctaagtgtgtgttcccgtgaggagtgatttctaagaaatggcactgtacactgaacgcagtggctcacgtctgtcatcccgaggtcaggagttcgagaccagcccggccaacgtggtgaaacccccgtctctactgaaaatacgaaatggagtcaggcgccgtggggcaggcacctgtaaccccagctactcgggaggctggggtggaagaattgcttgaacctggcaggcggaggctgcagtgacccaagatcgcaccactgcactacagcctgggcgacagagtgagacccggtctccagataaatacgtacataaataaatacacacatacatacatacatacatacatacatacatacatacatacatccatgcatacagatatacaagaaagaaaaaaagaaaagaaaagaaagagaaaatgaaagaaaaggcactgtattgctactgggctagggccttctctctgtctgtttctctctgttcgtctctgtctttctctctgtgtctctttctctgtctgtctgtctctttctttctctctgtctctgtctctgtctttgtctctctctctccctctctgcctgtctcactgtgtctgtcttctgtcttactctctttctctccccgtctgtctctctctctctctctccctccctgtttgtttctctctctccctccctgtctgtttctctctctctctttctgtctgtttctgtctctctctgtctgtctatgtctttctctgtctgtctctttctctgtctgtctgcctctctctttctttttctgtgtctctctgtcggtctctctctctctgtctgtctgtctgtctctctctctctctctctgtgcctatcttctgtcttactctctttctctgcctgtctgtctgtctctccctccctttctgtttctctctctctctctctctctctccccctctccctgtctgtttctctccgtctctctctctttctgtctgtttctcactgtctctctctgtccatctctctctctctctgtctgtctctttcgttctctctgtctgtctgtctctctctctctctctctctctctctctctttctgtctctcactctctgtgtgtatcttctgtcttactctccttctctgcctgtccgtctgtctgtctgtctgtctgtctctctctccctttctgtctctctctctctctgtccctctctctttctgtctgttcctctctctctctctgtctctgtctttctctgtctgtctgcctctctctttctttctctttctgtgtctctctgtctctctctctgtgcctatcttctgtcttactctctttctctgcctgcctgcctgtctgtctgtctgtctctctctgtctctctccctgcctttctgtttctctctctctctccctctctctctccctctctcgctctctctgtctttctctctttctctctgtttctctgtctctctctgtccgtctctgtctttttctgtctgtctctctctttctttctgtctgtctctgtctctgtctctctctctctctctgcttgtctctctcactgtgtctgtcctctgtcttactctccttctctgcctgtccgtctgtctgtctgtctctctctctctccctccctttctgtttctctctcgctctctctctctctctctctctctctctgcctgtttctctttctctctctgtctgtctctgtctttctctgtctgtctctttctctgtctgtctgtctccttctctctgtctccgtct
